United States Patent 7,868,149 (PLANT GENOME SEQUENCE AND USES THEREOF) - sequence listing, part 39

SEQ ID NO: 20376 - DNA, 1215 bp, Oryza sativa
  unsure (1)..(1215): unsure at all n locations
tctttagctgctcacactcattcttagaatcattcagctgctgatatatatatggattgcatctgtctaaggtttggctcaaccaaaccctgcatcctcgacttctcttccttatgctcttctgcctctccccgccattgccgccaaagtttgccgccgccgacgccgcctccaaatcccgccgccgccggagaagcctagggctaggtttatggttcactgggaatgcgccatgcaccgcggtcaaactgattccactcggtccctacatagtcatacataagggcattatggtccatacataaatacggtatgcacaaaaccgagtacaatcgcggatcaggcgtagaacgtggcatgtttctagttttatgcgatttgtaatggcaattttacaatttatcgaatagtaatggcatttttccaaaccttcgaatttataatggcatgtgtctaattaaccctgccatcatggccaaccgaaatgcgcatcctgctactggtcaccgccgcggcaattacagatttacaccggaagggaatagatggtctgggctcctccggatatgattggtagaatacattgcaatttggtcatagaggaaaaaagagaaggaagaggaagaaaaaggacaggggctaaaagaaaatatttactggtataatataaaaagtgacatcgcttatactccttccggttgataatacttgtcgttttggataaggacacggtctccaaaaaaaacaattttgaccattatgtttcattataatatgtataaaattgttagcaaatatatgatcttattaaagtacttttaagactaatctatacatgtagtcaccatatttgaaagacaaatattttaaaaatgattcataatcaaagattctaaagtttgacttcagccttgtccaaaacgacatgtattatcagcccggagggagtagctataaattatagttaccctgttaaaaaaaatatatgaactaaaatgatataccttaaagggttagttagatcatatcattataaatttgacagttttaaagaatactaccattattcgtataactgaaatggtaccactacaataatatgaaaattggattcataccatactgtacactaatttaaataggtaaatagtaatgatannnnnnnnnnnnnnnnnnnnnnnnnnnnnnnnnnnnnnnnnnnnnnnnnnnnnnnnn

SEQ ID NO: 20377 - DNA, 734 bp, Oryza sativa
  unsure (1)..(734): unsure at all n locations
nnnnnnnnnnnnnnnnnnnnnnnnnnnnnnnnnnnnnnnnnnnnnnnnnnnnnnnnnntaaatacaactccatcaaattgactaccattttctgaacagcaagcttccctttcagtcttctcttctcccacgtggaaggatcgttcagtttgctcaaattccgtggtctctgcttctcgtgaggtctgcaggaaacatcaatctggataaatggtcaacgtgaatttttactttccaccagaattgaagggacaggcccacaataaaacatttataccaaacatcaagtccggaaatagcaatttttacaatgtttatataagtagtaatgaatttttcttgttccttaaatggaggctggaacgtgcagaaaacatgaaagttcttgcagccattcagagcaggaatcaattttggcaaaatgcaattattatgtcaaaattcgcatagctagctactcaggcatacaggttgtatctgtagagcatgcgggcggcctggtcgacggcgagcttggccatggcgtcggcgtactgtatgaagacgtagtcgagaccgtcctcggcgctgatgcagacgaacttgccgacgccgaccttcttgtgcacgacgtactccccggcctccagctcccgcgggtccacccggtgacccaacgagctccccgccgccaccacccccttcctcctcccccctcccccttcgtctccgtccccgtcgctctccccctcctg

SEQ ID NO: 20378 - DNA, 727 bp, Oryza sativa
gtgccctcgcgagaactccctcgaccttgcctgactccgtcccgcagaccagcaagtcatgtcccatgtcccggacgagagctctgagatcttcccgccgctgcaaaagactgatggcacgcgcccggaggatacaaagctccggcatcccgatcacgcaccaggtctccctcgcagacaaatcatcgaacagtataggtgcgtcctcgagcgggtaacagccggagacaacaactaccacggacttgtccggctcgagatcggcgaggtcccccaggcgcaccaggccttggaggctggagatatagtcgaccaggcgagggggaggaggtaacgcgggggcgtccatggcggcgaggcgagggcgcggttgggcgcgtcgcgtcgcgtggggattcgaagcgcgagagcgaggcgaggcgaggcgggcgagtcttcccacgtggaatgaccaagctgcccctccgctccctgtgtcaactgttaaagtcactagagaggaaacgaagagcgggctgggctgggccgggccgggactgcaaattcgtcagtttgtatcggacctaaaattctagattttttttcatttttagatttttttaaaaaatatttacagaaataatctatcggccaaaaaaattataaaaatagaccctgccgcccactatggggcggcaagctgacgtggcagacggcgggtcgaccgcaccgtctgccgccgtcggcc

SEQ ID NO: 20379 - DNA, 87214 bp, Oryza sativa
  unsure (1)..(87214): unsure at all n locations
tgcttgcgatcatggtacgcgatgagtcccttttactattttgcaattgatggtctgtggttcaattttatgatagctcataatgtcctaccaaaaaaaaaactttaagtagattcattttcattttctggaaattgtgctcccactatttgcataaggactgcaggctgtagttatgaacagactccatatgccgtcataactgtccatttgatcttatgcattccaaatttacttattaaaatacgggaccaacattcctattttacggttgacttaaatttttctgtcatggaatctctgcataaggaaaattgatattgctgagcatggtggatggtccttctgttaaccttcttagcaaattattagtcagattctcacaaatatctttgacgagattgaagcttgccagcaagctgatgtgaagaagttgcagttgttagtcattagtaacagatcatagtattacttgtatttcagcttagactgttgttcagctccctttgttgctctttcgtacaactgtactgacctctgcttctcacttagtacaaaaatatgcaacacttctacacccacaaaagtagatatgcttagcaattgtgtatagcttcacatcttaccatcaaatgtgaccacatcaaattgcattctatgtttgatttttcccttaagtattgttgctatgtgtaggttggaccaaggattaatggatggttactcatgtccaacttgtcgaagacctctctttctgtcatctcaaggtcacacaagatctacagcagaggtaggaaacgtccagttaattgcagaacaacttaatgcggggttgaatcagcagagggttcctggtcatgaacatcctattgaacatcagaatcctgcagatgctgtttggaggtgtgtataacaaacttggaatgatctattttcttattcttcacattgctcatcatattcatgttataacaatgtcttgtcaaattattgatgtgatttggggtaaattcaatgaacctattcatgtcttgtcaaaacttcaaaactatcacaaacctacacctttaaggacccatcttacgatagtttttgtgctcgattttatgaaatcactacatcccatcagtcccacatattagctaacaatgtggatccacaagtcagcctgacagcctcccatcatttgttactcaatgctagctggatagccagttgcaaccttcaggcaggcctagctatatatagagagagataatatggaagagaaggcagctaatgtggaaatcagcagtgcaaagactaaatgggagcttagaggagcaaaaacagcaggtgcctctgaggaggctgctctgcagtttgtgccaatgaagaaacaaccaactgcatctgttgcttactcagagtgagtatgccactctatgacctcttcgtttaccagtttcttgcctcctcaccagcatgctctatgtgttccataagcgcttcctgcatgtgtttctacatcaacaagagtacgggaatgaacaaaaaatatgagaaaagaaaaggttaacttttgctgtctagaaaacccctgtacattggagccatcattgattcctgaggtgctggatcaaactttctcagaaattttatctttgaacatcctattgtaatgccttttgtccagcatccgagctaattccactacattcttggtgatcagttgttgtatggtagattgaacttgacataattgtagagttcctcccaactatctcatttcaactgccaattcattaatttacaactgcctaagcaaatataatttatcacaaaagccgcctgatttaccctggtagctgttggaacgatggagtatgtagagataatatgatcaggatcttggactgttcctggcactggttgtgggctgtggcacttggcaaggatgatccttggtggtatgcgtgggcaatgccaacaagtgttatctcgcagcttataagtcttagggagggtggtgatctcacacagggtaaagaagcgagaggctatctttctgctgcagtgccaaattgcttaccagattactgtagtgtaggtggtggctgtcgtggcaaagacagtgcagcagagatcatgtccaattgtccctgtcgctgtttaccgtgaatcccttgtgtgtgccataggctgatgtgcacgaacaccttccacctcacccctagcggtcgactccattatgcatgctagatctgaattgagcacacatcctgctcagacaaggaggaagatatgcccttttcggagatagaaggaagaggaagatatgctctttttgctgaaagaaggaagatgatgatggcttgtagaacagcacaatagagtgcactcacaggagggaaaatcctaaatttgtcattcctttcattcttcgccaacatggccacattcatagcactatcacttctatgtgaagttctcaggaaacatcattgtccccttctcatatctggctaccattgcctcacctaagcaccatatctctgcagctcatttgtcacaaaacatatttttcccagcccatattcatctgccgtgaccgtgaacataaccaagatcnnnnnnnnnnnnnnnnnnnnnnnctccactcatgcatgtcttccctattcttcgcccctggtgttcattgtcacaacttaagctcattttataaagtgattgggcaaatgtctgacattatatcgttatttgaaactaggccttgatagactacctcagttatttgagtgtatgaatggtatagtttgagggcatttttaatttcctgttctctttcaagttactaccctcgcaaagattttgttagccttatggcatgcacattttctatctagatactgtgataatctttaatccgatgaagctattgtttgttgtaatgtatcacttaatggtggtcctagtttgtggttcaattgaagttttaaatgggtatgaaagcgagtttaccaggcctagttgatctaaagaaaaaggaagaataatagccatagtttcatttcctaatggactttatctttgttcataatgatgaaccaaagtctttcaatgcatcttttcgaatcttattcattctaggtgaaactaagtaggtttagtatgtcaaactgatggtgctcacctgcctattaccatcattattttgaatattttgttccagtcagattgatttatactggcaggtttagcatatttttaggattgaatcttgattgaacattgaaattgtaacctggtagtaataaagacttaccaaaggaaacataattttgaaaacttggcaaagaagggatccccaaagatgactaaaactcatgctcactcaaaattaccagaagatatatgttttatcttcctattaatcacctatacaacaaaatgctgatcctgtgtgcaaatacgtatccaatacatggatgtggtgggatacaacttacaaggggatatggtatcgggtattgttgatttgtttaatttccaaaataatttgaataagtaatgatattttcctggtacttttgtacctttgatatagtgtgcgtttagctcctgttctcgctcccccaacttcctgaccatcaaaaacgcattatctcctggccgcttgctaccagctcttccatattgcaactatgcaagggagaattctaccttgattcgtggcagtgaggcagaagaggtaggtcgaggatagagagcaggggggcagggggagtggggagagtaattgtgagggtagagaaacctagatggagaaagaggtgaagctgctactgtcttgcatacacatggagtcagagataaggggctaagttttatagagcacatctgtgcaggtttggttggttgggctggaaagggccgaaagagacgcatacactcatgcgtgcaggtgggttggatgggtcaaactggtccatctctcgtctattccttttatttcttatggttgcctgatggctcttctgtgcctacttgtattgtatatgcagtatgacttatctctcagatgctattataatttagcacacatacacttgctatatcagtgaatcctcgtttttggaaattgtttgttgatcaccataaccctatagttgtactgctatgcatacgattctgcagcactgatgcataggtgttgggtggtgcagaggtgctggtcttgattctagctgggcaccaccatggtcgagccctgggatggacaatcccagttcttccagcgccgtgacatcagtggggcttagtggagttcagatgatgatgaggcagttgacttcagtgactgataattatgggcatccagatgccacctggagtctatggcctgagccagttgcaggatcttcggttgttccatcctcttcctcgaggcctgatggtgcttcagctgctggcttgcggttccgaggcactgcaagacccgcgaatggtagcatgtcggaggttctctccatggtagatagagtacgagaagttttaccccatatccctgacgagctaattattgaggtacacttctatttcctctcaactctagttttagctattaccttacgcactggtatgcactgatgttttttcttcaccaatttgtaggatctgatgagaacaaataatataaacgctactgtaaataatcttctgctgatgcaataaaagataaaccagcaatacaacatataagcacgatgtttaccggctataagttcatatatgaaaggatgtatagttaagttaaagacgaacctgggtgtccaagcacctcttggttcttgtaataagtgttttttttagtttatttcttcccaatgtactaaaatgccccggctttgtatagtaatcacagctgtataatattatgctcaatatggcgtaggatagcatgtgtagaagatgttatcatccaaataaaagtgtgtttgtcatcccaataaaattatttgtcgatgagagccaatgaatagtgaaaacgtctaaacgtgtgctgctgttcttgtgtgcctccttcattggatatgaaacgctgacagctgtttgatggacatctgataaactgtctttaatcttcgttttctacctcctagtgggtttttttttttgtaatatgttactggttttgtaaattgcataatatctccttaatatcggagtctgccagatatgttgcatggtttcttccccctttttttttggtatgaaactgatgcgtgttgatcttgattaaaacaagattgatatcatattgttgaagtgttttcaaccgtcctggagtctcatcatacattcatgcataaccgtgtccacagttaggcaccaaatgcaagaaagattgatatgttcacaccaaggcctgatatatgctaaaataggaaccacaccaaggcactacatttttaagaattacacagtacactactcgcacttaattaacttagactattatacttacaatcatcagtcagaatcgaactaatagaacctggaaaaatagaaagccaggtggtaaaactactcgaagactctccttgagctaatctgtgacccttgcgctttcgaaataactcagctttatcttcaggtcttgggccaaagtcctacaaatctatctgttaactttcctctaagcatctccggatttgctataaatctttcgacagattttttagttacacatctgtcaattttctggccgtaggatttgtgtcaagattcgtgctgtactggtgggaaaatataaaacagatgcccacatgtgagatcgatctcgcggcctgcgcttcccgctagaaccactacgaccaaccgagcaagcatgcaatgctggaaaatagttccctcaaaaaatatatatacaataaatattgattagagttacaacgataaacttacatcgtaactattatgtaattctagaaaatacagtgtaactttatataattaaagtgtaactattataaaattacagtataacttttatgtaattgtagtgtaactattatgtaattgcaatgtaactatactgtaattatactgtagctaatatgactataatgtaactgcatgtaactttttaagtagatgtattagtaatatttattcattcatctcgggttttttctagacaatcaaaatgaagggatgtcttggctttttttttttcttcaccgagcaatcggttagaacgattaactagtaaagtcgttcactcggcaacgtgtcatccggatagacgttgaaaaatctaagtgaaatggatgacaaaaatcattcgaatgtttgctagacactcccaccattctcggtcggtcacttccaaagaatcagtctcaataattagtttagatactcctaactcccttacaatattagtcgctctgcgataaggtagaattttcgccatggtagcatcctaatccttagatgatattgttaaggtgtttgaatcttctaaagatgaagatgaagatgtagattaagtgtttcacgcaaaacgaggtggtaataacgtgtgattaactgagttttaattattacaaacttgaaaaatagattaatctgatattttagaacaactttcatataaaaagtttttgcacggaacataccgtttagcagtttaaaaagcgcgccactttaatccgaaatttaatccaccttttcaggacattcgaatggggcagaaaatctccgcggtcatttcgcaagactaccaccgctgctccaaactagtgtgccatcacaaaaacgccccatcagtattcgccttcacccaaccaatctaaaagtaaagaactagccgtgcacctaatgtttggacacagtaaattccattatgcacacacaactcataacacgtaataagagaatatgttgtttctattatacatgaatagaaaaagtgtattcttgttgccaacaaattgcatcaatacaacttacaaattacaaaaatgaaaagttgaagatataagcagaagaaaaatagaatgaaatgaaggaattatatataataggataataatacttggacgacatcaatgtcgtataacaacgtataaatagtcgatcaaaacggtatatatatatatgtatgtgtttttttttgcgaggatcaaaacgtacgtagggtaaatttaagcggacataaaccccataattgatgatatattaacccatgggcatatatatatgcatggatctggggttgaataaggcgatcgacgttgggaatgaattaattaatctggtggtgttggatgatgaaatgatatgatcatcagtgagctctggctctgatgatgtcgaggctcatctcgctggggtctgtggcctgaatctcgcactggattccgtccagctccctcctgaacctgtccttggagctcgcgtacagcatcttgctccttgtcctcgccgtgtcaggcgacctacacatacatgcatggcactttctgtgatctttactggtataacagaaatgatacctcatcgaaatgaaattgaacttagccacgcatattaatttcgatggtatagctatataggggaatgaattctaaaactctctgtcgttcttttcttgcatcttgtcccttttagtaatgaaaaatttagtaaaaaaagttatcaagatagattattatatacacaaatatactattcaaattcaacctttacgatttgtaaaaagcaaaaaaattaaactctagctaagatgcgtgtattcagtcatatttgtttttcttttgcaccttgttgaagtcaggttcaaattaatgatatatcacatattaatatatcttattaatattttaattttttttaactatttagacgtgagaaatgagaggacgtcccctcaaaagattaggatatatttttaagtacccataccaggagaagaagaagatcttgctcttctggcagttctcgtcggtgacgaagtcgaggtcgtagacggcgtagcggcactcgtcggcggggagggtggcggcgaagtcctcgtagccctcggcagtctgcccgagcctctccaccttgatctccatggccttgtcgtcgatcttgaacacgatgaacctgaaccccctcctcgtcttcagctcctggaacttgaacttgcactcgtcgttcaccgccagccctgacgcagaattcgcctgccattctcaaatcaaatcactctattaattttttttttgcgggggaaatcactctattaattgcaattcatcattgaccatgcaagaaactgaaattgcaattgtgcttaatttgtagcgagagagagagagagagagagaaagaaagaggagatcgatcaccattggtgctcctgcgagtgagttcttcttcttcttcctcctttgcgcggtaatgcgaatggagggagaggttggaggggagaggatggcaatggtaggcaagctagctaggaagcttttgctagggatcggaggaggagcggacaatgcgctgcgtttcgcgagaggaacgcggcgaggaggagagataatttaaggcgattgcagttgcagagattgatatgatgccatgcacgtcctcctctctgtgtgtgcgtgtgtgtgtggtgaagggaaaatatggaggcaatggttgacttggtcgcttgattcctctctttctctttgtttatgtttaggccttggccttggcctgccagccctaaagacatgttccccacaccttctcctgcatgcaatgcaagcatggccatggccatggctgcctctcacaaagataatcatggaggtgagatcgatcaaatagttggttgcaacttacatgatcagatgatgatgatgatatagtttgcattattacatatccaattgttttctaccttgaataaactttgaaggcgttttttttaaagaagagagctttttataaatgtatacctgttcatttattcccacatcggatattgatggttgacgccttgacgggacggcttacaaattgggggcatacatcacctatcacctacaaatttttacaaaactattgataattttatcaaattatcataaaactatatatttaaaagatgcttcataaaactacaaatttaacaccggagttattgtgagactaaagatttaaggcattgtatcccaaaactagcacggccaatgagactacaaatttctagattctattccaatctcttaggaggctatcaaataaatttatttatgaggatgaagtaaaacaatttctaaacttaagacttacttttatgaaaactcaaagcacactgttttagtgttctacacttgcattacttacttacttagggatgcaaacaaagcagatattaacaaataatactcgtatcatatttgtttcatatttttagttggatacgaaaacaaatatgaataaatctgtcgacgtttgatgtcgcaattctggtatttacatggtatagggatcgttggtactagggtatacacgagactgaggtaaaagagatggagacagggatttttatacaggttcgggcccctgaattgtcagataataaccctacatcctgttggctgaagccggtcgttgatcttattcaccataatcataccagtacaatattttgggtagcctatctaactgttgtcgacatggcggtctgaaggtctgactcgtagtcgacaacagggtagtcttcctcctcgaatccatgcccggcgagatcagagatagcgctttcgtctttcctgacagtatccggagacaccgtagaggactagccatacctatctccgaagttgatatccggcgtcttgtcttggcttatgttggcttgtatgttgtggcttctgttgttccgtgtatgttgattgtgttgggtgtgtattgtcccccctctcctcctagggggccttgtatttatacccataggtgtccccttgtccaaatagaactagagaaaccaatatggatacaatccgagtagtccttgtcgtttccatgtagaactttgattgtctttccttatctggaactcctcctatatccgaaggttgtttccgtataggacatggtatgtggtgggtcttgccgagatttagtcaactactattaggtatgtggtatccataaccctgacaaaatcgaatacataaagtaataaaaattatctcaaaaataaataaggatcgaatatgatcggacatgaatatgaaaacaaacatttctcgtaacaccaaaacaacccaaacttctatctaatagaaataactatcatcatacataatattgagttcaacacatataacattacagcacaaatgcatgcttaactaatattataatagataacatataatataattcataaaattatttaaaagttcaaataatattaataggagcttatgccactgagtttatctcatttcaataatttgtcatcgacactgtctatttctataaaataccggcaagtttatcaattgttctgcatatgttgttaggcaaggtcattgtcagggttacgggttaggtataccctttaccctttgatatacgtcgcatatcggtatggtatacccacgcgtatacggatactctccgcatatattaaggaaacccctcacggagtttacaaatggaaggagtcctactcggacaagactgggtcgtcaatgtatcgtgtaaggttcgatgtttccgagttctacttggaaaccgcctgacttgtgatataaaagggaccccccagggaggacttagggcatcgaatctcagatccaacacaaccctcacagcctacgaagtcggagcctgcaaggagccaaatcgccggggatctagtcgaaccaactcgaccacaatctcgccggatccgtcaagttccactgttccctttgtaacctgtgttttccatcatataatcccacatcaactggattagggctattacctatcaaggggcctgaaccagtataatctttgtcttttgcctacttgatgtcgtattacgtagatccttgtaccaacgtaccccaataccctctatatccggtctacgggtatcacccgtcgacagtggcgcgccaggtagggggacttggtactcaaggttctactactatgttatccggcctcgtcgacaacagtgtcaacaccaacctcggccaagtattccctgcttcaacgatgctggtgtggactcaagtcggcgaaatcgtcttcccggtttacaccacaatgccgatctcaaccggtccgccaatgaccggaaacaagaacgcagtggctacaaaccaagacgactccatgtcgaaagatccaacctgtcgacagactctgacctccacgtttcacacatcttcggaggttccacaacgtactcctcgaagcgagagtacaaaaaagtggaacgcgaagtctgttcaacatggtagggggctgcacccaagatgaagtggtctgaacagaagatagagttctcggaagaagaccaccccaagaccgccgtcatcccaggacgatatccgatcatggttgaacccactattcggaacatcaaggtcgcgcaggtcctcatcgacggtggcagctcaatcaaccttcttttcgccagcactttggacgcgatgggaattccgcaaagcgagttgacaccaaccgatcaaccctttcatggaattacaccccaatcctcatccagaccatttggcaagattacgttgcctgtgactttcggccaagccaacaacttccgaacagagcagatcacctttgatgtcgctgaattcgatacagcttacaatgccatcatcgggagaactgcacttgcgaagtttatggccgcatctcactacgcgtatcaagtgatcaagatgccgggaccgaagggaacaatcactattcaagggaacgcaaagctggcggtgcaatgcgacaaacggagcctcgacatggtcgagcaaacgcccagcccacccgccacgactgagccacccaagaaagtgagcaagacaaacaagacgccgaaaccggacggcgcaatcaagatcgttccactctccagtgccaaccccgacaagaccgtcaagatcggggcaacactaagcgagaaataggaactcgcgctcatcaccttcctccgcgacaatgctgacgtgttcacttggcagccgtccgacatgccgagggtccccagggaggtgattgagcacaaactcatggtgcgacccgatgccaagccagtaaagcaaagactgcggagatttgcactagaccgaaaataagccatacgagaagagcttgacaaacttctcaaagctggcttcatcagagaagtacttcatccagagtggctagtcaatccagtcatggtgcggaaggccaacggaaaatggagaatgtgcgtcgacttcaccgacctcaacaaggcgtgccccgaggatcacttccctcttcctcgaatagatcaactggtggactcaatagccggctgtgagctgttgagctttctcgacgcttactctggctaccaccaaatcagcttggcaaaagaggacgaagagaagatagcattcatcacgccgttcggggtattttgctatgttaaaatgccgttcggactgataactgcagggaatactttccagcgcatggtccagggcgcacttagcgaccagctcggcaacaatgtcgaggcatatgtcgacgacatcattatcaagaccaagacaggcgactcattgattgacgatctgcgggaaatgttcgacaacctccgacgatatcgccttatgctcaatccagagaagtgcacgttcggagtaccgtcgggcaagctgctcggtttccttgtctttggcagaggaatagaagcaaatcccgagaagatcaaggcaattgagaacatgaagtcgcccacaagactcaaggaagtacagaaactaaccggatggatggcagcattgagcaggttcgtcgctaggatgggagaacgagggcaacctttcttcgctctgctgaagaagcaagaaaaatttgtatggacacaggaagccgaagaggcattcgttgcactcaagcgctacctatagaacccccctgtacttgttgccccccaacctaatgaagaattattcctctatatcgccgccacgccatattccgttagcaccgtcatcgttgtcgagagagataaattacaacgaccagtctattacgtcagcgaagctctccacgacgcaaagacaagatatccacagatccaaaagctgctttacgcggtcatcatgacatcaaggaagctacgccactactttcaagcccacagagtcacagttgtctcctccttccctctcggtgaagtcgtgagaaacaaagacgttgtcggccgcattgcgaaatgggtagtcgagctgagccagtttgatgtcaattttgcgctacgaacagccatcaaatcccaggtactcgccgacttcgtagccgattggactatgcctgataacaaatcagacaaccaagtcgacaacgaaacgtggacaatggcgttcgatggtgcactcaacagccaaggagttggggcaggatttatcttgacgtctccctccggagatcaattcaagcacacaatccacctcaactttagggcgaccaataagagctgcagccgcacttggggtcaagcgactaatcgtgaaaggggactccgagctagtcgcgaaccaggtacacaaagattataaatgctctaactccgagttatccaagtatctcgcagaagtcaggaagctagagaaaaggttcgatgggatcgaagtccgacacgtctaccgcaaagacaacatcgagccagatgacctagcacgacgtgcgtctagacgagaaccgctcgagcccggcacttttctggacatcctgacaaagccatcagtaaaagaggttagcggcgaagttagcccggtcacccccgacattagctcggaggccacaaaggcagaacaagccgttgccgatatcgagaccacagacgactggcgcatcccactaatcaaattcatcaacagcgaggagttgcccgaggacgatacagagaccaagaaaataacccgtaaagcaaagatctactgtatggtcggcaacgatctatacaagaaagcgccaaacggggtacttctcaaatgcgtctcgtccgacgatggcagacacctcctccttgatatatatgaaggcatttgtgggtcacacgccgccggtcggatattggtcgggaaagcttttcgacaggggtttttctggccaaccgcccttaaagatgcatgcgacatggtccagcgatgtgaagcctgtcaattccatagtaaacacacaaagatacccgcgcaagcgctccagactatccctcttacttggccgttctcgtactgggggctagatatactcgggccattcccacgaggacagggcggctataggttcctattcgtggcgatcgacaaattcactaaatggatcgaagcagtacccatgggggaaatcaaggccgacaatgccatcaaattcatcaaggggatattttgcagatacggactactgcaccgcatcataaccgacaacggctcccagttcatcagcgctgatttctaggattactgcatcgggctgggagtcaagatatgcttcgcctcggtctctcaccctcaaagcaacgtacaagtcgagagggcaaacggcatagtactacaagggatcaaaacccgcgtctatgacaggctcatgtcacatgacaaaaaatgggttgaagaactcccatcagtaactatgggctgtacgcaccacaccgacaacgtctaacaaggaaacacctttcttcctcgtgtacggctccgaggccatgctccccagcgagctacgacatcagagtacacgagtacagaagcactccgatgaggaccaggaggagcagcgaaacgtcgatgtaaatctactcgaggaacatcgcgaacgagttgccgttcgagcagccagctatcaacaggccctccgccgttaccacgagaagcgcatccgagcagcatactttcgattggcgactacgtcctccgacgggttcaaagccaagcagggcgaaacaaactctcacccaaatgggaaggaccctacacgatcacacaagttttgcggtcatgcgcattcaaaattgcagacgacgatggtcgcgagttagcaaattcttggaacattgaccaactacgtaaattctatgtatgagtcaatacaatccgtacctgtaagacaccttacagtatcaataaagcctattcttaggcccatattacaatcaaagtgtttccgcccaatgatcccttaccctgatgacacctagcgttgaaacctatcctcatgtccctttacgccgtcttgacaaggcctccgaggaacctaagggatcttcggttggggacgcccagagccgataaggccttgtcagatcctgtagagacgaaagaccatgtaagatctggtcgtgtaagagttctcgccgtgcgtattaaccaagccgcgaaatcggaaattaactttccaacttcacggctgggggctaggatcagagcttattcaaccaaggcaggtcaaaggtccaagagccttatcctccaagaaaattcctccgacgacaaggctgggggctagggagagtgtacgactcaaatgactgactaaagtcgtgaactgagaacacactcttacacacgacatccggagtaagaaagatttgttaaagatagatttcttttctatttcacaaaatacttcttacaatttttacacaaatccaaagctatattacacctttttcctgagatatctatcacaggttacgaagactaccaagaaggccaactccagtctatagactggaagatcttctccgccaacggcgccatcgacctcgccaggtggtctatctccgccggagtcctccgagaacgagcaaaaccctcacggagaaaatcgaggtccaggcgcgggcgatgatctcgtaggcaagccaacacgtgtccttcggcatatcggctcgatcgacgacactcctgcttcaagacctcgtcgatacgcttgccgacgccgtcgagttgagcacaggctccattcagccaagagatgtatccggccgccgactcctcgggatctccacggggcactcgaagttctctacaaaccctggccatggatgtgcagcaactcttcaagtacgagttgaaccacacctcacgacctcggagcgtttccacagcttgctctttcttcactgcaagcatggttctctcgagttccgctacttcaaattttgtcttccaatattggatacgacgatcttggccagcaagagcactctcgagatctgctcaatgtgggaacaactaagtcaagctacgcgcctctttcgagaacatagttgatctagtcggaggagcagaaagggatgaatggacaactaacctaagaaagtcgtcgccatctccgtccccgtagcaagggtctggtctacattgtcgggcaacgcatgtggttcaaacgcgagaaccggaatagtcgccggtgactcgggctgcccgcgctgctggacatcctcgtcatcaacatctctacaagggacaaaagttttcaagatcaacatgcaagagtaagctagaataataagtgcacatccaaaggcggttaagattcagttttacacagcatgtcttgggagtacaagaggtcctactcttcaaaaagggggagaacagattcccccagatcaccgacttcttccatcacctccttacgcgtgttgctagccgctgtcacgcccagaaattttgcccaaatttccagactattttgtgtattaaatccctgtccaggaccagccagggtacacaaaacgataagtaataaacagttccaaatgtaaataaagcgtaaaatacttacagaagaggcacttagtcctcacaacgaaagagaacgacagcagcggaaaaaggcgatcctagcggggcttcagctccactccacaggcaaaactcaactggggtctgagccttggtcttctaactttgtcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggtggttgtaaaacattttattgagcaaaatagtaaaactgttgagtaattaaagtaacattaaatctccactgatcaacgctataccacgttgaacaggcccaaccaacccacctgaactacagtgcattgagtcgatttattaaggagggactaatcacggtgaatctggtcgaccgcccataaccgcgggcacgactattcgaatagttttactctgatcagaggtgtacaactgtacccacaagacacagccccacgacacgtttccgtgcgccgacatgccaccacaacataccggaaagaggccgtgacaggacccttcgcataaccccctctaaccaagcacaccacacctcaggtttcacccccactcctcgcanagcagncggcagtcccctctcgtgcctaggtgaaatccgaagcccgatangcccgtcgcagggcccatccaaactccatcacgcccacccttgcctggatgcgtcggctagagtaaagctacactacaagcccagcagttgcccatgctggcttgtggtaagtacgataagttcttccagggcatcccgtgaaccggtccttaattgccatgggtgcgactagcaaaaccatgcacccacagcccaccatttagtcgcattttagttggacaattacgaccatgaagcatggccgggtgtcttgagcacgcagctcctcgtgatactaaaaaggtctaatactgcagttatcccatcaactgagctagtggtaattaagcatggctaagcatattgttctagctaggtcacataagtaacatgagctagtcgatttattacccaatattgacaaaggacagatatcaagtaaacatggcacaagtgagcagataggtaaaaccctgatcccatgtaattagcaagacatgcaattttatttgcaatcgataaaacatttgtaaattaggatcaaaatgctcaaggggaatgtgtgacttgccttgattcttcactttgatcttccgagctcttttcctcgcgaccgcggacttccgaaacgacgggaactacacgctggcacgcaaaatgaggaaaactctaataaaaaccaagaaaacagtacataaaaagtaaaaaaaacatgtagagctcaattttagatgaattttgcaagttgaatggcccaattcggagttcgaatgaattagatatgaattttagaaattttgagccaattaaatgaatttctagaattattaccgatttattgcacaattattatttaatttttcaaaggaaaaggcacagccgctgacgtcatcaaaggggaagggcgcgccgataggtgggccccacacgtcagcgggactaggggagggcgcacggtggactcggtccactgcagcctggcggcaccatggacccagaccacaggagtggtccacgggtggccaaagtacaggcgcggccgagcggcggcgaacgacgacggcaacgcgcggccggacggcgaccaccggcgacgacaccggcggcgcgggtcggcacgcggagagcggcggaaagagcggagaggggatgctcagcaagcggcacggcaccaaagggaggcgagatggcggcggcactcctcggggtggcacggcaacggcggtccggcagtgttccgcgagcgggaaccggcggacggcgaccggaaggatctggggaacaaggagggaaagttagggaatagggaggaggcgcaaggcggcgggaaaactcggccggaagccggcgatgagggaaggagctcacctctcacagcggggaaaggatttcccgcgacgaagagcttggatgaggggatgtcgggctccctatcgttgctgcggagccgacgaaggagagtgtgaggttggaggtcgctcgcggtggcggcgaggtggtggcggctcgggctgacagaggagatggagttccggtgatggaacggggaaacgaagcggagaccgagcttgcccgcgtggcggtgaagccgacagtggaggcggcgcagcacaacagcggcgggagcggcggtggcgcgtggctggaggcgacaacggcggcggagagaggtggtgcgtgaggcagcgatgttccggaggcggagaggggaaatggagtaggggcctggctgcagcacggcgccgcgaagccgacggtggtggcggatttgtgcggcggtgggtggagcagcggtggtgggcggccggagctcgccggaaagcggcggtgcgcgggagcggcgtggggagagcgagggagagagtgccgggctctggaaagagggggaaacggaagaggagagcacggggagggtttatataggctcgggagggtgaaattgtggccggacgtggcggatttgatgcggcaacggccggcgacgtgggcgacatcgtgggcgaagtgggggctcgatttggcgccaaaaattggggaaaagtgggggatttggtagaggaggtggaggggaaccgattttatgcggtttgggcgccagggagcgagtgggagggccggaatcagcggcgacgtgggcggcaacgggtggcatggcggcttcgggcggttgctggccgggatggaggaaggttggggatgaacctcacaagtgggtcccgcggtcccacttgtcggcctgagagagagagggagcagggggttatttacacttcaaggacgagcgggccgagggggagagagagaggcccgagagggggaggggcgcgcgggccgcgggggagaggaaggattcttgggccgaaaatggcccaaggaggaaggggagtttttaatttgttttctttttatttaattgattcaatgaactttgtgctattaaaattacttcttgagctccgaaaattcacggaaaattccggagagtacattagggcacaaagaatattacaaaatattcccggccttgatttttaaaggaaatttttaattccctcaataatttcacttgattaactagctttaacttttatttaatttctagaaagtgcattattaaatgatttttaatcccaaacgaaaatcggggcgttacaaatctacccccttataggaatctcgtcccgagattctgggatggctagagagaaaactggttgtgcgggcggtttgaccgatctgactgatctagacactgcactgtttttttctgtttcggattgactgattgtttgattgctcgatggaccaaacctgcataattgaactgatcggcatcgaccattcgtttcttttgcttcaaacaactgaactgactggcctcattggattagatccctggagttctggtacccaacacgatcgattaactgatcaaacctatacgagcaatctggctggattcaaccctgttgtcccattgcttcccaaaactgaacttattggttctgcttgaactgacccaaactagggctgcggatgctcgtgaaactctcttatcttgggctgaaccgttgatactagcaatttgataacctgacagttcaccaagctggctagagaaggatggagttgttcctaagacttatctctggcattcgtaaatcattgacccttaattcgcttgggctgctcttgacatgaacagtaagtattctaagaagctgcttgatcaatctttcgtctgaactgcaactgtccctgatgctgcttctctaagcggagttgttgatctggcctcacgggtgtaccttagaattcaatcggatgccctgagatcggcttagctcttctgataccttgcaacaggcttcttcaagtgctactcggattgctgcactaggttgaaccttcactaaaacagcgacgaactgagccaaaactcatctccgagacctaccccccttacagggagtagtcttactttcgcctgactgggaacaattggactattgtccttgaaaaataaccaacacttctcttacttacaaaggccctcactttgaaaattgaacttcaccgattcatcaaaatagagaaatgacgacgcactttcatcccagcaagatttggaacttaaccctcagttgctgataggaaactccacataaagaaattctcatttcgctcctgatcttactaactcttgactacttccccaaccagttctaactgctggtacaactatcttgcttctgacttgatttttggtgtcatatgcctaaacagattgcatagttaacattccttgaaacaagcactgatcacttaacagatccaactcaagaggtcctttccatggcatgacatttcacttcttcgaccatcctttgctgactcttcctgggttgacggactatagatcctgcaacaactttccggaaaatactgcaatctgaacaactatcggaaactgactttgatgctgctgagagtttctgctctttgatcataaccacttcgctttcatatcttcggtaaagatgatttgttgaaaatagattctctgccatataccttgttgactacacatttctatttctggaccaaactcttgtatcttcctgactcatgtatggaacaatttcttttttcaacttttgagaaacattgagatgattcctggaacttatactgaattcatgatcacaccactagggcgtaattgccgattaccatcctgtaacagcttccaaggttagagagttcccaagattctttatatgatgtcactttcaaatattccatccctcttttcatttgagtaccactgatgctgcctttaaagagatctcatcatgtcaagtgttgagtgtctaaccattttcactccgttggttaaccattcctctattggctagcaaacaggttttggagctcaacaaaattgcgatgagttagaagagaaactcttggtttcttgtggcaccgacagatacacataataaattgcttctgcatgctcaagatgaaccataaaaggagaggaactggctaactcatattttattcaacatttccttttcattacatggctgccataaacatatatgtacaaggagaagtattacaaaattaaacactggtagactgctactgattagaactgcccttttcacgactgaacttgaaaagtagaagtcttgtctagaactgctattgcttccattatttaaacctaactgacttgtttctttagttcctactaacagaagttgcatcggaaacattgctctgggcattgatcttcgaggagggaatggcaatcctcttgacagctgtagcaggtaggatcttctagctcatgggattaccgagtgatgatttgccgatgggcctccggattggagcaatacgaggtgcattgctaggattggcaatagttgggcaacctgatgctggcaacacttgctgcgggtgctgacgaaggagcatactgcctctttgtagctgtagcgagctgttggtttcctggcattgcttaccctgctggcgctggtgctgaaggcttgaagctgttgctggtggaacaatgcggcctttgacggtgcccttgacgataatccattgaggcggaggttgcacattcagctgtcgattggtgtcgtgggcagtgctggtaacttgtgaacaacgatgaactgcctttgctgctcttggaagaggacaatcgctgaaacaatgtcctggtttacgacagttgcgacataatcgacttgcttggtcccggggtgcaggcttctgattgtgcactttggcagctgaaactggaacaagcagtgatttctgaacatccctggcgatgttgcttcttccatggttggcttccgctggagctggagttggaggaagagcagaaggattgtgactgctgttgtcgtctgccattggtcgacgaatgggttgcacggttgtcccttgttctttcttggtcttagctatgaccgtgttcaactgatagtccttaggcacatgatctgttccttcacacaagaatcatgtaaccttcctcaaagggcatgatctgagtaatgggtatattcaccacagcgacatgtggggaggcataaactagcagtgtgtccgactatcccacatctagtacatgctttgaactccattcctctttccatgaaactgttaagtgtcgcctcatcctcatcatcatcatcatcgtcattatcatcatcgtcagcagagaaccgctctcctgattcatcatcttcgggtctgggcgggccgtactttatgaggtgtcgggttagctgacgtactccacggaaggtattttttcttctctgacgcttgggtatccttgcggcgtcttcaggagtaaattccaaaccagtgatgatcatggtcctaccattatccatcttccatattactgtcctgttcgctccatagttgggctgcaaagtaccatccttcttgtcggtagactggcttggagcttggttacttcctgagcactgcttctcgtatttttcaggtgacctggtgaacaccttccatggacagttccttgcatagtgaccttgctcaccacagtcataacaggtagcacttactttcctttggtctgacgatgactcggctacagttatcttcggggatctggacagcattttgacaggggtcttcggtgccgatattgggaactcctgactctgactctgatttgggttccgggctggcatttggacttgcacctgcgattggagacattgacgtggctcctgacattgccattgcatttgctgcatctgatagatctggtaccgacgtcgcatctgttgtaacaactcttccactgtctgagtctgattagccatgacttaaggttgaagctgatcttcatgaagttgacgtggaatgcccataggattgcaccgagttgatccatgaaactgttgagatcctgacccaatgcaactatccctcatactgaccaattgctacgggcacaagagagggagggggagatgagaggggttactaaagataaggtcttaaaccgattgcctactgatctgttgttaatggatttttatgattcaagttgcttaagcaaacaacctagtatggtcgcatccccaccaatgatgcaatccatacccctacacacaagcaaacaacacacgatctaaaagctaacggaactactcttccgggaaagattgggtttaggtaactccgggaaaactcttcttgaccttcgcggaacgacgactctgaactgaccttctcgctctttgctgcacgaagcttgatgcttgacttgacttccgaacagacacgaagctgacggtttgtcctccaggttttacaactaaaagaattggagggacatcgaggagaattttaaaaaccgtttcgcaaagaaatgccgaaggacgagaggagacattttgcaaatagggttttcagaaaacttgtccttagggtttgaccatttggctcaacctacagtcgagttggctctgataccactttgtcacgcccagaaatttagcccaaatttccagactattttgtgtattaaatctctgtctaggaccagccagggtacacaaaacaacaagtaataaacagttccaaacgtaaataaagcgtaaaatacttacagaagaggcacttagtcctcacaacgaaagagaatgacagcagcggaaaaaggcgatcctagcggggcttcagctccactccacaagcaaaactcaactggggtctgagccttggtcttctaacttcgtcttcagctcagaagcactacacttctgaaaagggggaataatagcaaggctgagtacaaccaccgtacttagcaagccacaccaacgatgcagacgtgcaaggggaacacaagaacgatttgtggctatttgcataaaggcggttgtaaaacattttattgagtaaaacagtaaaactgttgagtaattaaagtaacattaaatctccactgatcaacgctacaccacgttgaacaggcccaaccaacccacctgaactacagtgcattgagtcaatttattaaggtgggactaatcacggtgaatttggtcgactgcccataaccgcgggcacggctattcgaatagttttactctgatcagaggtgtacaactgtacccacaagacacagccccacgacacattttcgtgcgccgacatgccaccacaacataccggaaagaggccgtgacaggacccttcgcataaccccctctaaccaagcacaccacacctcaggtttcacccccactcctcgcaaggcagcgggcagtcccctctcatgcctaggtgaatccggaagccgcataggccgtcgcagggcccatccaaactccatcacgcccacccttgcctggatgcgtcggctagaggaaagctacactacaagcccagccgttgcccacgctggcttatggtaagtacgataagttcttccagggcatcccgcaaaccggtccttaattgccatgggtgcgactagcaaaaccatgcacccacagcccaccatttagtcgcattttagttggacaattatgaccatgaagcatggccgggtgtcttgagcacgcagctcctcatgatactaaaaaggtctaatactgcagttatcccatcaactgagctagtggtaattaagcatggctaagcatatagttctagctaggtcacataagtaacatgagctattcgttttattacccaatgttgacaaaggacagatatcaagtaaacatggcacaagtgagcagataggtaaaaccctgatcccatgtaattagcaagacatgcaattttatttgcaaacgataaaacatttgtaaattaggatcaaaatgctcaaggggaatgtgtgacttgccttgcttcttcactttgatcttccgaactcttttcctcatgaccacggacttccgaaacgacgggaactacacactggcacgcaaaacgaggaaaaactctaataaaaaccaagaaaacagtacataaaaagtaaacaaacatgtagaggtcaattttagatgaattttgcaagttgaatggcccaattcggagttcgaatgaattagatatgaattttagaagttttgagccatttaaataaatttctagaattattactgatttattgcggaattattatttaatttttcaaaggaaaaggcacagccgctgacgtcatcaaaggggaagggcgcgccgacaggcgggccccacacgtcagcgggactaggggagggcgcacggtggactcggtccactgcagcctggcggcaccatggacccagaccacgggagtggtccacgggcggccaaagtacaggcgcggccgagcggcggcgaacgacgacggcggcgcgcggccggacggcgaccaccggcgacgacaccggcggcgcgggtcggcacccggagagcggcggaaaaagcggagaggggatgctcaccaagcggaacggcaccgaagggaggcgagatggcggcggcgctcctcggggtggcacggcaatagcggtccagcggtgttccgcgagcgggaaccggcggacggcgatcggaaggatctggggaacatggagggaaagttagggaatagggaggaggcgcaaggcggcgggaaaactcggccggaagccggcgacgagggaaggagctcacctctcacagcggggaaaggatttccggtgacggagagcttggatgaggggatgtcgggctccctatcattgctgcgaagccgacgaaggagagcgtgaggttggaggtcgctcgcggcggcggcgaggtggtggtggcttgggttgacagaggggatggagttccggtgaaggaacagggaaacggagcggagaccgagcttgcccgcgcggtggtgaagccggcagtggaggcggcgcagcacagtggcggcgggagtggcgatggcgcgtggctggaggtgacggcggcggcggagagaggtgttgcgcgaggcggcgatgttccggaggcggagaggggaaatggagtaggggccgggctgcagcacggcgccgcgaagccgacggtggtggcggatttgtgcggcggtgggtggagcagcggtggcgggcggccggagctcgccagaaagtggcggtgcgcgggagcggcgtggggagagcgagggagagagtgccgggctcgggaaagagggggaaatggaagaggagagcacggggagggtttatattggctcgggagggagaaattgtggccggacgtggcggatttgaggcggcaacggctggcgaatattataatagataacatataatataattcataaaattatttaaaagttcaaataatattaataggagcttatgccactgagtttatctcagttcaataatttgtcatcgacactgtctatttctataaaataccggcaagtttatcaattgttctgcatatgttgttaggcaaggtcattgtcagggttacgggttaggtataccctttaccctttgatatacgtcgcatatcggtatggtatacccacgcgtatacggatactctccgcatatattaaggaaacccctcacggagtttacaaatggaaggagtcctactcggacaagactggatcgtcaatgtatcgtgtaaggttcgatgtttccgagttctacttggaaaccgcctgacctgtgatataaaagggaccccccggggaagacctagggcatcgaatctcagagccaacacaaccctcacagcctacgaagtcggagcctgcaaggagccaaatcgccggggatctagtcgaaccaacttgaccacaatcttgccggatccgtcaagttccactgttccctttgtaacctgtgttttccatcatataatcccacatcaactggattagggctattacctatcaaggggcctgaaccagtataatctttgtcctttgcctgcttgatgtcgtattacgtagatacttgtaccaacgtaccccaataccctctatatccggtctacgggtatcacccgtcgacagttttttggaaatactaaaaatacccttgaagtcatacaaagttaaaaaaatgatttatcccattagaagtttttaaaaatatgaagtttttagcctccttactcaagtgtgtatataagtttcatgttttttctggtatttctattttttaaaaaacatagttatttttgtttggtactccctccatctacttttgatagtcatattgcatcttggcacaatgactaaggataagtaattctacttattatccatttaaacatgctactagttatttcccgtaaacaggcgattcattaatatttatatttctcgatgcccatgtagccaatcttgtgtggaagaatagagagtcacgcattaaatccgaaaaattcattaagaggataggttgttgattgaaatatgcctatcaaaagtaaaattttcagatttggaaatatacacatcaaaagtagatggagggagtatatgagagagaaattagttatgcaaaaataatagcataaaaatatttttgtgtagcctaagaaatatgatttacattaaaaacaacaacacaaaacatattctatataacatataactgataaattatattttataaaaagtagaaatacaaaaatcttgaacatatacattgtgtaaagaggctaaaaaaattcataattttttttgagacttatgacaggataaaacaattgttaaccttttatatctataagtgtgttagtgttatttttaaaaccatgcccaactcaatggataatggtatattgtaggagaattgataaacttaccggtatattatagaaaagataatgtctatggtaaatcgttgaactaagataaactcaaagacaaagagtatattctctcaattaatagtgcgagctagtgctagtggggtgtgctattattaaactctaaagatataccccgtcccataaaaaaaaacctaggatgagatgcgacatatcctaatactacgaatctggatagaactagatgtgtcacatctcatccttggtttttttatgagatggagggagtatatcgaaggtgagttaaaaagatgtgggacatgtttcatgcatttggcgatgtccaaataacactattcactggatattcgtattatttgtttccgtcgaataccatgattacatatttgcatctagcaaaaacttacccgcattcattttcatatccgagttatattcgtatttgtttttctttagagcggatggaagctatcctctctgctatccgctctatttttatctctactcgcctacgttgtgcttcaaaacttaacaaagttaaaagaagccattttgctaacttgaacttgggcctcaataaagtttgccgttgcatctgatcgggctcgaccgctagaaacacttgggctgaggcatatgaatgtgaggtgaccagcacctttatagctgggcttgccttccttgtgcacattattttttcttctttcatttgtttcattccataagactgcaacgggctcgttttcaagctaaacctacccagagataccgatgttagcttcgttgtgacgtcttaaccaaaaagcttcattgtggcatatctatccacacgtactgaggagaccggcctacgacttggaagcaaagaaacaacaacaacatcatatattgcgttgttgcatcattcaaaaatgctagtccagtcttttctctatcaaagacgtagcgacactgtagcgacactgtagcgacgctgcctatcgaactcccgctgttcgatacgtccatgccacgcgccctatcgaactccccctgttcgatacgtccctatcgggcattgtagcaagtacttttttattttttttcttggacaactagcctgtcgaactagggcagttcgacagtaccctgtcccagttcgacagggcgctaaacttgtgatttcgtctagccgacctaaagttttgtgattttccattaaaataatattattttcaaaaaaaattcaccgatcgtataccttactctttaaaaattaatggcgcgcggcgtacatgtactggttctcagtgaacctgtacgtacagtaagctagtggggatggctttgtctgcgtacgaggacgacacgccatttctctcccagtgctagcatgtacctccgtcccataatataaatcgtcttattcaaaaaaatttatgtaaatataaaaattaaaaaattgtgcttaaagtactttggataataaagtaagtaaaagaataattttataatattttgaataacacgagtgatcaaatagtgtaagtaaaaacttaaaatcacttatattataagacggatagagtatttgtgttagtacacgtctacatatatcggctggagcggctaatttcattatattcacaccaccgctggcacgcacttgtagctgaaatgtccgagatcgatcgcgtgtacgtacttctaaattaaatcactactcaccaaacaaatcggtaacggactaattaattcacttgaaaaattaatagatactactccagtatatttctgttagttggggatggagagattaggtgtgtgatgatcgtcggtgcaatatgtgatctgatgccacacgtttatcctttctcaggggtctacgctgaatgatcgatgtgccgaaacgtgcttttctctctcaatagtgtactgataaggacgttctgttcgatctgttgatgaccgactagacatgttggtgttgtgatgatgctctaactcgaccatcgtgacgatatatagtcttttcaaaaacaaaaagaagaaaagataatattttgtagtttcttttaatctaaggtactttatattatgggataatttcgtttttaccctcactttcatgtttaaatattgattttgcccctgttttttgtggttttcgtttttgcccctgcttttctgaaatgaaatagacgtttatccctatttttaacggaagttagccgacctaggattatggagctaaaacgtagagagaaaaagaaatagtgattttttaattcgttgatggacctttgtacccctggtgagccataaccaaagccgtccttcttgccttccccaatcccacctatggtggcgagcagaaggcggcgcgtatcaaggcaggccaggcgacggcggctcgacgaggggacaagacgaaggtgggctcttgtccagacggtagcggcttgacggaggagcaagcgacggcggcgtctcggttaggcatcggcggcttaatgcgggaaggcggcgacggctcgacgcagagaggaggcgacggcaggtggcccggccaagcggtggcggcgagcacgccaagcagcaggccgcgcgcagcgagcagttatcaggggcactgcaagctgttggcaagcagggcacgacggaggtgcacgctgcggcaagcagcatcaacctggctcggctgtaaacaggcgatagggaggagcgacatgctactggactgtatttgcttggcttcatgatttggatttgcttgattttgtgtgattttgtgatgattgctacatgtattttgttagctgtgtaaaaaccatgccgaaattgtgcccaaattctgtctttttttcttcaaaatacccaaattttaccaaatttgtggaaaaattatatcaaaattttaatattctatcaaaattatcatatttgtaaaagtttatcaaaatacaagctgcatgtaaaaagggggcaaatacacagttattaaataaacattcagacaaatatgcaatatcaaataagggtatgattgtcttttcgccaaagatttaacgccgtcaacttgtccatctaaagtaggggtagagtttgctttcatttaaaaaaaaaaaggggcaaaaataaaaacccttaaaaacagggtaaaatcaacattgaagatcaaaagtaggggtaaaaataaaattgccccttatattattgttgttgtgggaaggtatttatagttgtacgtatgtgaaagctgtaaataaataattaactacgggacatcatggacttgttaattttgtcttccgcgaaatggataaagccgaccaacggctgaagaatatatattatatatattagcagtcctactttcccatcttcccactgcgctcactcgcgtagcttacttatgtaaccaccggatctaaaattaattgtatccctaatttgcttataacatatccctacttatataggcatggctagttatatcatatgaatatattactactgatttacaaaataggtagttgagaaaacaagtactccctccgtttctaaatatttgataccattgactttttaagtttatgtttgaccattcatcttattattaaaaacttttgtgaaatatgtaaaattatatgtatgcatataagtatatttaacaatgaaacaaattataagaaaaaaattaataattacttaaatttttttaataaaatgaacggttaaacatatttaaaaaagtcaacggtgttaaaagatttagaaacgtagggagtacttactttttttttctccaaaaattacaatctataataggatttgaccaagtcctaaactgattatattcaggttcgttatcgtagaaagagtcaaatccaacccatcctaatttgtaatattttttatatctgtgaatgaaggatattacgtaaacagatgatatatctagagattaaccttaatcaccggacatgagttagaccaagaatcaggcgtgcggacacgtcagcgtcagccgactcacgctgacgcggccggtcgccctcgcgcagacgtggcccaatgggcccaagatatccgactgacactatacaaaacgatttttgcagggctttagccttcaaaaggcggcttaaatttgtaccgtatatgaaagatagctgatgctgcttcgaacacgactacacaacgatcggtcgttggtttgattaaagccgcgatcacttcctccacgtataaatctccttagctaaattgtattttttttcttacctatttgataacttgtactctctccgttccataatataaggcacaactattttttttaagatgtttcataatataagatatacatgcatgcatataattaattaggaccttttctccattaaattattacttttttaaatcctccatcctcaagatctctaattctattagatgtatgcattatatttattagagtgattcaaactaggagatgataataattgtttcttggtctttgagttaagggtggttgtgccttatattttagaacggagggagtatctcttaaattatatattatttttaaaatctatttgcttcattgtactccacttaaaatatgagataaaacaagatcaatgttaaatatattcaaacattttattaacttaaaagtaatttatttaaattgtagaagtaacctagctatgcaatagaagtaactctctatagcattagaagtaattacattacgactgagttggaatacaaaactatgtggaataaacttacaactaaagtgtagagaagatgtccaactttatttaaagtaatcactgtattattttagaaaaaatcaaatcttacgttatataaaaagtaatccttcattatattaaaagtaactacgctactggatgaaattaactttttgaaaaatagacggaactcttcataatattataagtaaatacacttctagaggaaagtaactaagaaacataaaacataaataactatttaaggtattagaaataactgtattgctagagaattaacttatcacggcgttgaaagtaacgacactgaggaagtaactctttaactatccagcgagaacagttcagaaaaaaaaattaatttgaatatattcaatattagacttatttgttacatattttaagtgaaataggacagttcaaacgaatcttacaaataatatactgtctataaaaaaaatataagtcatcaaagattctataaaaggaaaatgtgctagtgtaacgatatgttagcctcgtaagagcaagtttaataggatagctaaatatttactctaaatcgtctatagttaatctaatagctcattcatacaatagttgactataaaatcatgctataccattaatacctggtcccacctctcatacacacataacatcttagagtccgtactgcagctgactacaaatctgtagcccgctttcttctatctcttctcttttcttctggatatgtggttatagctggcttatagcttactattgtacctgctctaacatgcacgtgaatcaacatgacaactactccctccgtcccaaaatataataactttttagcattcaagatttatcctaaaatataacttctccaccaacattcttttcccaacgaattataaccttccaccattcactttttcaacttacctccactactcaaccaatcaccaccctccatcattcacttctacctactttcttaataaccgtgcccaactctaaaaatgcttatattctaggatggaggtagtaatagatagcatgtggttctctttttctcgcaagtgatcttgtttatctatataatattcacgtgtttgtacctcaatcatcattaactgatcggacttatgaaagggtatctaaataagatgaaataaaaagcgtatactcatgggagcaaattttccccttaggtcctgggttcgactctccatgggagcgaattttttaggatttaacagctttgtggtttcagtggtaggagatggatccgtcgataacgaggcgtctgtgatgactttatcaatctcgaggatttgtcggcccagtcttcgaagatgctcataggggtaggatttgcgtgcatacgtttataggggttagtgtgcgtgtgttttgagtgtatatgttgtactgtttaactcttttaaaaaaatagaaagcgtatactgaatagattttagcatcatgcgtatactctactccgcttgaaaatatcagtacgtatctgacgtggtggtgggccgcagtgccgcacgcgaattgtcgtttacggaacgtccacgtgggagcccgtaatttatctgatttccccctcggcttagtgcatattctatttttctcttaatttatctgattttcccctcggctcagtgcatattctatttttgccctgtttggaacattctgacacctctatccttctttcagaatttctagctgtcagaaacctttttaaacagttaaaattatcactaccccttcgtcttaaaaaaaaaaaactctagctacgtaactggacatgatgtatatccagataaataactagagtttgtctgttttgggacggatggagtaaactttaaaaattagaatccataaaacaaataaaacaaattagaacctagaatttgagaaacctagtttttcggattcttgacctctcaaataacccctctatcctatttttttaaaaagtgattaatttgtggtttgtttgcgctttagatggagattgctcatgatgatgtttttgcagcactcagcgctcgccacagattcttttaggcgctcttctttttcaatactagttgctgacaaatactcctgtcatgtcgcaattacgacgaaattaaaccagtgagagaacgatcaataatgccgcgtgatctctgaaaaaagagttttagtacgcggcacaccgaacgcgtgtggtgtgaaataatacggttgctacagttgtgaaatactccattttaatttgaaagatgataatatgggatactgatagtagaatcgattataagcactactacataaaagattttcgcatataactatagaatcgatagatatgccggtatagtctttcggatatgcttatagaggtaatgtgtgtgtgcacgttcatagagatgactgtgtgggtgttgggtgcttgcatttgtaatgtgtttctaaaaaaagatcaattttcataggtgcatgggtggcccacttgcacctaggtgtctgcgaaaatcgataattttatatgcgggtatagcaaccgcatgcaaattaaattcggtattttcgcatacgaacgcttaagccgaccgactgtaaaaataattttggttaaagaataccaaaaagaaaattccgctgaaaccctagcttctgttgcactcgggctcgtcgtcgcccctcctggggttgagggtggtggcgccagatttgccgctctcgagctccaccgtcgccacctgccgtcttcatcgcccctccctaggcctaggggcagcagcgccagatttgccatcctccagctccgacgtcgctgcccaacatcttcatcgcctctctagggccgaggatggctacgacggatcagccaccctcgaactccaccgtcgctgcccaccatcttcattgcctttcttggggccgagggcagcggtgttagatccgtcgccgcccgcttgccgccagagaagagaatggggatacggaaggggaagagatgaggagaggaatgcagaagagaagtgggaaaaggtgtggagtgaataaaatgagtgggagaggaaagatgcagtggagaggaagaggaggatgagaaaaagaggtgtggtaaaattcgtgggacccacttgctatccagccggtatgcttgcgagaataacctattatagcagaccgacatctgatctgggaagtgatttttgcatatagaagtagttatgatccgcttataatttattggggattttgtccgaaaaattcgattacgtaacagcgaagagagaagaaatggtgtgaaaatcagtacggggggactcaaacgctggcagtcaatagtactggtagctctcttaccaccggattactatgctcttctcatggttgtgaaagtatgatatcaaatcaagcaaatttaccctaaaaaaaaaaggtgcggagacacactctcatggtcttagcagaatattaccgcaaaatgtaaccatgtcgtaagcgtcgtaaaagctatatttaggccatgtttaaatcccaccccaaaattttacatcatgtaacatcgaacgtttgaacacctacatgaagtattaaatataggctcaaaaataactaattgcatagattgcgattaatttgtgagacgaatcttttaagactaattgctctatgatttgacaatgtggtgctatagtaaacatttactaatgacagattaattaggcttaataaattcgtctagcaatttacggacggattctgtaattagtttttttattagtgcccgaacactccttaccacacccctatataatacccgatgtaacacgccaagactttacacccctgaatttaaacaccccataactatatttacccagagaaactgagaaagctattatatgtgatgtgtggtacgtagatggtgcttcatgtagtgtaagtaaacgttcatcatagttagattgctggtctaaggatcggcttggtttgatattgtaccaaaattttggtggtgtgtgtaagttaaacgctcactttgttataaaatatagctagaggatactagcgtgaaaatggattgaggaacatgtgtttagattcttagtgcaaaaaatctaatttagttttagattgctacatttggaacggagagagtagtttaatttggattgatgctaaaatatgcatataaaaagacaagctatgttttttatgggttagctaaatgtttatttttgcctttttcactagccaaacacgtcctaagatgaaaatatctattaacttttggctgaaaaaaaatacttagggagtgtttaattgaatgccttaaatttgtcaaataaagtttagacacgttacttaggaagagtttggttgatgatttgtgatcatggctaggcacattaatttttcaaccgcacaatcctacgagttgatgacttcaaaacttttttttttcaaacttgcctaagaagcggctaacatccctatggtgtttgaatctcctgaagatgaagtgtttcatataaaacgaggtggtaataacgtgtgattaattaagttttaattattacaagtttgaaaaattaattaatctgatgttttagaacaacttttatatagaaaattttcgcacgaaacataccgtttaacaatttgaaaagtgtgacatgaaaatcttcattttcatccaagcccagttacagaatcgaacgggaccaaagatgtagtatgaactaaacatccccttatactaaacggggatgttagcagttccgatcgaggaaggacattataaacggggaacatatcctgcctatcttattccatttccatgtcatctagtacctcattatatagtaaattaattatcatctctttgatcccctaccctagtcaggctagtttttccaccaaagatgtgcacggagtagctaccttctcatgtctcttatttaatctacatacttggatcattagccatgcattatatatgcgtgcttgaataattgttttgaagaactagctaggttgtgcactaactgatgcagtgcacaaatacttggcgttggagtacaaatacataaagtttaaccatttatcttaatcgtaaaaagttctataaatactttaggttgcgtccaattgcatttatcaagcacacttttttactgctaaatgatctgtattttacaagagactttttatatcaagtaaatacatttttaagtttataatagttaatacttaattaattaattttgtactaatcactcactccgttttacatgcaactgaaagactcaagctaactgttgatttgaacaaagctttaaatggttattgtatttgtggagattatgagtaccttatatccacatggctggtttatccgactggttgtagaggataggttatatctctagaatatgtaacggattatgattaaggtattaaggaaacgtcttaaagtcttatttcgacaatattgtaaagtagatgccgtaggttaggtttttatatgtaatcttgcgcttcgacctatataaagagggcatgaggcctctcaagggcacaaccaacaccaagatcgtcaaatcaatacaacacccggtagattccaatccttaaataagagcagagtattacttctcgtcgagagtgtcagggttacgggaaaggtataccctctaccctttgatatacatcacatatcgacatggtatgcttgcgcgtatgtggacgttttcggcataagttggggaaatccattacggagttcatagatgtaaggagtcctactcggatagaactgggtcgtcattgtatcgtatcgggtctgatgtctccgagtcctactggagaccagttgacctatggtataaaagggaccccccgggaggacctaaggcatcaaatctcagagtcaacacatccaccacagcctacgaagccggagcttatcggagccaagtcgccggggatctagtcggatcaactcgactacgatcttgtcgataccatcgagttccactattccctttgtaatatgtggtttccatcatataatcccatatcaattggattagggctattacctaccaaggggcctgaaccagtataatctttgttttctacctgcttgatgtcgtattacgtagatcctcgtaccagcgtaccctaataacctctatatccggtctacgggtatcccctgtcgacagtggtgcgccaggtagggggacttggtgctcaaggttctactactatgacatccagcttcgttgacaacagtgtcaacaccaacctcaaccaaggagttcctacttcaacaacactggtgtggactcaagtcggcgaaattgtctttccggtttataccactatgccgatctcagctggtccgccaatggccggaaacgagaacgtagtggctacaacccggggcgactccatgtcgaaggatcctcccgccgaagcggagatcggagcgtcgacgacatccgagcccaagaaggatcctagtgcggccaagccttgtctttccgacaggaatcacaagccgacgaggattacttccaaggtgacaaggtcctggtgtcctatccacaaaaccaggaaaaacaccctgcaagcctgctgggtctttctcaacgtccatgctgaaattcgtgcctgcaaagagcatggaattcagcgtacctctccaactcgtgatgtctattgtcctattcacaagacaaagaatcacgacctctcgagctgcaaggtctttctcagcgccatgaaggcgccatctcctaaggtccagcagtcacacatccccatcagggataaagacaaggaacaaggagcgacgccaatttcggatcgatttgttggggtaatcgacatcgatccccacgaaccatcagtcttgcacctcctcgaagactatggatcatcgacaacgagcacgccgcgtgaggtattggctatcgacgatgtcggcgcgtcagcgcgcaccaatgcggaagcggagaatcaagtgactactccggcccagcatatcagagccgtcaacgcaatactgagggaaaccccctacgatcccgttctgaacgacgatctcgcacgttggacagaacgattacgggaatcagtgaccaacctcagcaacgcgttcgaagaggccgctgctgtagcgcacccggaacagccaccaactggcgatgctaatggtgaaaaccctgaacagcgggaatcgcctcatcgagccacccctccacctcgcagcattggcgatctccgcgatcacctgaatggccgctgagaggcgcgacgcacacgagataacgagaaccgttcccgacatcgcgtctcttcacggtgtcacgataacgaagaacgaggaggccgttcgagcgaagaccgagaccgtgataactgccacaaccgccacgatcacgatgatcgtgaacggcgggtgccaggcgatactggtcgaggaaatcgccataatgacgacgatgatggagatcggcgccgagacaacaacgggagacgacgacaggattctcgagaacccggtcgacgtcctcgtaatcgcacgccggaaccaagcgactcatcgtcatcatcatcatcctcgtcatcttcatcatcagatagacatccacgaagaacgtatgatcgccgacaacccactgcccccagcactgggtgtagagctttcggtcgttcacttcgggatgtccgatggcctgaaagatttcgacctggagcaatagagaaatacgatgggagcaccgacccggaagagttccttcaggtttactccatggtactctacgctgccggagcggacgacaacgcattggcgaattacttgccaaccgcattgaaaggctctgcacattcatggctgatgcatctcccccctactcgatctcttcgtgggcagacctgtggcagcaattcatagccaacttccaaggaacttacaagcgccacgcgatcgaagacgacctacatgcgttgacacagaacccgggcgaatacttgagggattatgttcggcgctttaacgagtgcagaaacataatccccgagatcaccaatgcttctataattcgcgctttcaaatccgatgtcagagatcgctatactactcaggagttggcaatgaggcgcatcacgactactcggagattattcgaaattgtcgatcgatgcgctcatgcggatgacgcactgagacgcaagaacgacaaaccgaagaccggaggagagaagaaaccagccaaggacgcacctgagtcgagcaagaagaaaaatcgcaagagtgggaagaggaaagctcaatcggaagttttcgcaacagaatacgcggaccctcccaagtgcctagacccacaaggcagcgacatgaagaaagcatggtgccatatacacaagacggacagacactctctagaagattgcctcgtcttcaaaaagtcactcgcaaaacacatggcatcggaaaaaggcaagcgagtacatgtggttgagaaggacgctaaggcgcctactcaggaatcggactcagcataactagattccgacattcatgtctcacacatcttcggaggttccacggcatactcctcaaagcgagaatacaagaaagtggaacgtgaagtctatttgacatggcagggggctgcgcccaacatgaagtggtccgagcagaagatagaattctcagaagaggaccaccccaagactgctgtcatcccagggcaatatctgatcgtggtcgaacccactattcggaatatcaaggtagcacgagttctgatcgacggcgacagcctaataaacctcctcttcgccagcaccttggacgcgatggggatcccacgaagcgagttgacacccaccgatcaacccttccatggaatcactcctcagtcatcgtccaaaccattgggcaaaattacgttgcctgtgactttcggccaagcaaacaacttccgaacagaacagatcacctttgatgccgctgaattcgatacagcatacaatgccatcattgggagagctgcactcgcgaagttcatggccgcgtctcactacgcgtatcaagtgctcaagatgtcgggaccgaagggaacaatcactattcaagggaacgctaagctggcagtacaatgcgacaagcggagcctcgacatggtcgagcacacgccaagcccacccgccatagctgagccacccaagaaagtgagcaaaacaaacaagacgctgaagccggacggcgcaatcaagatcgttccactctccagcgccaaccccgacaaaaccgtcaagatcggggcatcactagacgagaaataggaactcgcgctcatcaccttcctcggcgacaatgctgacgtgttcgcttggcagccgtccgacatgccgggggtacccagggaggtgattgagcacaaactcatggtgcgacccaatgccaagcaagtaaagcaaaaactgcggagatttgcaccagatcaaaaacaagccatacgagaagagctcgacaagcttctcaaagctggtttcatcatagaggtacttcatccagagtggctagccaacccagtcatggtgtggatggccaacgggaaatggagaatttgtgtcgatttcaccgacctcaacaaggcgtgtcccaaggatcacttccctcttcctcgaatagaccaactggtggactcaacatccggctgtgagttgttgagcttcctcgacgcttactccggctaccaccaaatcagcatggcgagagaggacgaggagaagacagcattcatcatgccgttcggggtattctgctacgttaagatgccgttcggactaataaccgcaggaaacactttccagcgcacggtccagggcgcacttagcaaccaactcagaaacaatgtcgaggcctacgtcgacgacattgttatcaagaccaagacaagcgactcagattgacgatctgtgggaaacgatcgacaacctccgacgatatcgcctcatgctcaatccagtgaagtgcacgttcggagtaccatcgggcaagctactcggcttcctcgtctctggtagaggaatagaagcaaatcccgagaagatcaaggcaatcgagaacatgaagtcgcctacaagactcaaggaagtacagaggctaactggatgcatggcggcactaagtaggttcgtcgctgggatgggagaacgaggacaacctttcttcgctctgctgaaaaagcaagacaaatttgtatggacacaagaggccgaaaaggcattcattgcactcaagcgctacctatcaaatccacctgtacttattgccctcaacctaatgaagaattatttctctatattgccgccacgccatattccgtttgcactgtcattattgtcgagagagaaggtgcaacgaccagtctactatgtcagcgaagctctccacgacgcaaagacaagatatccatagatccaaaaactgctctacgtagtaatcatgacatcaagaaaactacgccactacttccaagcccacagggtcacagttgtctcctccttccctctcgacgaagtcgtgaggaacaaagacgttgtcggccgcattgcaaaatgggtagtcgagctaagtcaatttgatatccacttcgtgccatgaacagccatcaagtcccaggttctcgccgattttgtagccgattggaccatgcctgataataggtcagacaaccaaatcgacaatgaaacgtggacaatggcgtttgacgggcgcactcaacagccaggtgttaacagtggaatttggcaagcccggagtagtcatcggcttagagtcagcatcggcttcgatgtcctgagattagccgatgagagttgtcaagtcgtcggttgtcggattcttgctatattcggttaaggaaattgatctactaaaggaagcttatccagaagagactgagttcaaagagaatgcggcatggcaagttatctattaattaggaatagttcgttagtttccttttatcttcaggaaagtgtgtttagtgtcctataaggactttatcttttccttttatctttagtaaagtttctttcttgtccgacaaggacttgtatcaacccatgggtataaatatgtacacccggggtttatgtaatttatcctcacgatcaatacaattcggcgcatcgccaccttttaccttttctactttattttatcgtccagcgggacttggcacccgacgcggggctgcatcggtgttcgatctccggtgaaggggtaagtccaatgttccgttggtccaggcaattgtatcgtctacgttggcgtcgttcaaggctgcatgagtacattcaacctcttggattgctctggtttggatgatatatttgcctacctatttatcatatgtctctgttaatctagtcttagcatatcaatttagctctaatggctgcttctcgttttagggtttctgcaggtatcggctaaatcgtgttgctaaattagattagcttagacatctaccaccctgaaaacaaagtcaacggcttgattgtctagatattatgtttcttttcatacttagtgctgcatcagttaagtttgatctactaagtcgtgcttagaaccataatctctagcctgcttttttactgctaataagggtttcatcggggtttcagccggtgagttatctggacgttgcatcggctcataaggattgcatatatatataagttggatttagccgatggcaacaaaggtttcactgtttaatctaatcttgtggatttcatgacatcggacctccagccgatgtgtgctttaaccttcggatcaatgcttatttgtcatatcattatttgccgattggtttctactggactatattattgttatattttattatcatcagccgattgcctttatatcgttatctacattggacatatagccgattgcttaaaccctatcgctatcggctggtatcggcatcggctattatcgctatcggctggaactactccatcggcttgtcagccgatcggctgttttgatctactatttgtatatcttgtcagttgcaggatcaaactgactggcacgctcgcatctcatcaatctctggacctgcactggagctaagcagatctcccaggccggtgtgttcgatttttttcatcaacaccagggagcaggggcaggattcatcttgacatcactttcgggagatcaattcaagcatgcaattcacctcaacttcagggcaaccaataacacagccgaatacgaaggactactcgccaggatcagagttgcggctgcactcagagtcaggcaactgatcgtgaaaggggattccgaactagtcgcgaaccaggtgcataaagattacaagtgctctagccccgagttatccaagtatctcgcagaagtcaggaagctggaaaaaaggttcgatgggatcgaggtctgacatgtataccgcaaagacaacatcgaaccggatgatctagcacgacgtgcgtccagatgagaaccacttgaacctggcacctttctagacgtcctgacgacgccatcagtgaaagaggcaagcggcaaagatagcccggtcgcccctgacaccagctcttgggctacagaggcagagcgcgccgttgccgatattgagaccacggacgactggcgcaccccactcattaaattcataagcagcgaagagttgcccgaagacgacgcagaagccaagaaaatatcccgtaaagcaaaagtcctactgtatgatcggcaacgatctatacaagaaggcaccaaacggggtactcctaacatgcgtctcgtccgacgacggcagacacctcctcctcgacatacatgaagggatctgtgggtcacatgctgccggtcggacattagtcggaaaagctttccgacaagggtttttctggccaaccgccctcaaagacgcctgcaacatggttcagcggtgttaagcctgtcaattccacagtaaacacacaaaactgctagcgcaagcaccccgaactatccctcttacttggccgttctcgtgctgggggctagatatactcgggccattcccacgaggacagggcggctacaagttcctattcgtggcaatcgataaattcactaagtggattgaagtgacacccacaggggaaatcaaggccaacaacgccatcaaattcatcaaagggatattctgcagattcggattgccccaccgtatcataacggacaacggctcctagttcatcaatgccgatttccaagattactgcatcaggctgggagtcaagatctgtttcgcctcggtttctcaacctcagagcaatggataagtcgagagggcaaacggcatagtactacaaggaatcaagacacgcgtctacgacaggctcatgtcacatgacaagaagtgggtcgaagaacttccatcagtactatgggtcgcgcgtaccacaccgacaacgtctaacaaggagacacccttcttcctcgtgtacggctcagaggccatgctccccaccgagctacgacatcaaagtacacaagtacagaagtattccgatgaggatcaggaggagcagcgaaacgacgatgtgaatctactcgaggaacatcgcgaacgagttgccattcaagcaaccgactaccaacaggcccttcgccgttaccacgagaagcgcatccgagcacgcacgctttcaatcggcgactacatcttccgacgggttcaaagccaagcagggcgaaacaagctctcacccaaatgggaaggaccgtacacgatcacacaagttctgcggccaggcgcattcaaaattgcagacggcgatggtcgcgagttggcaaattcctggaacattgatcaattacgtaaattctatgtataagttaatagtatccatacttgtaagacatcttacagcttcaataaagcctattttcaggtcaagaccacaatcaaagtgttcctttcctatgatcccgtacctagatgacacctagcattgaaacctatcctcatgtccctttacgccatcttgacaaggcctccgaggaacctaagggaacttcggctggggacgcccagagccgataaggccttgtcggatcctgtagagatgaaagaccatgtaagatctagtcgtgtaagagttctcgccatgcgtattaaccaagccgtgtaatcggaaataaactttccaacttcatgactgagggctaggatcagtgcttgttcaaccgaggcaggtcaaaggtccaagagccttatcttccgagaagaattctccgatgacaaggctgggggctagggagagtgtataactcaaacgactgatcaaagtcgcgaagtgagaagacactcatacacactacatccagagtaagaaagcttagttagatagatttcttttctattccactagtatttcttacaattccatcaaagtccaaaactatattacactttttcctaagacatttgtgatagaacacagagactaccaggaaggccaacgccagtccatcgactggaagaccttctccactagcggcgccatcaacttcgccaggccatctatctccgcagggttcctccgagaacgtgaaaacccttcgcggaggaactcaaggtgcagctgcggatgatgatctcgtatgcaggccaacacgtgcccctcagcatatcggcttgagcgacgacactcctgcttcaaggcctcgtcgagacgttgaccgatgccttcgagctaggcgcaggctccattcagccacgagatgtatccggctgccgatccctcgggatccccacggggtactcggagctctctacagactctcgacatggatgtgcaacaactcttcagatacgagttgaaccacacctcacgaccccggagtgtctccatggcctggtcctttctcacttccagcatagtcctctcgagtcccgcgacctcaaacttcgtccttcaatactggatgcgacaatcctggtcagcaagcgcactctcgggatttgctcagcatggaaacgactaagtcaagctgctcttctctcccgagagcacaacaaatcaagtcgatccagacggaagggaaaaggaaatgataacaaagacaaccaacctaagggagtcgtcgccatgctcatttccacaggcgaacttcgatctacatcgccctccggcacatttggctcggacgtaagtaacggaacgaccactggcaactcaggctgcccacgctgctggacatcctcgacatcaacatctctacaaacgacaacaaagcactcaagatcaaaatgctaaagaaagctaaggcaatgaccgcacacactagggcggttgggaccaataaaagttttacaaagcatgactaaagagtacaagagagctaagaccctactcttaaaaaagcgggaggacggactcccccagatcgccgacctcctccatcacatccttgtgcgcgtcgctagccaccccctgatccaagatcttccacagatcgagttcagggtgcgccagcctcacacacgcaaggacgtggcacgccccggtgtagatcccgttagacgtctcttctccgatcctggccgcatgcttggagggaatttcctccatcgccgtcaccagctccgcaagagaagacgtcagcgagaactcatcgggattcgccgggatggtggacttgataccgcactccccggcaagctggtgcagaccagtataggtgacctgcaacgagccacggatttccgacaagctgttctcaagctccgacatgcggtgctcgagcccctgccgttgtcgctcgttgccggccaccagttctctcatcttctggaggtcctcgcgaacctctgccagatcacgcgccagccgatcggcgcgctcattcgccgacgacgccaccgccgccctcgcctccgcgatctcacaactaatgccgcgagcaccagccccgaggaggcgccccatctcgacctggagctcctcccaggtgaggacggcagccggcggaccccgaccagccgcaagatcactggccggtccactaggcgtcgcttcgcagctcctgggcacggccacgacgtctgtcgaggccacagcaggagacgcgctggaggttcctccagacccgtcttgcgccgcctttgcctgcgccgctctgcgaaaggttgcaattgagacaggctaaatgagtttggcaaagtgacaaaacctcaaattcatccgcttacttctcgccaagcatcacaacccgccgctgtcgcggaggcgggggagacgcgtctgaggcctggagcataacgggtatgatgtaagttggaagtttgccgatcacgcgatgaaggaccaggaagcttatcgagggagtgggtgtcttccgacgatttccgatcacggaggagaatttcctccccctcttcggaacgttgccgccactcgttgtggcagcagcggcggcaacatcggacacctccttggcgatgttctccttcagtgacgccgccgccaggtgatccacgagcggtccgatgatgtcagtcagagagagatcctacgctttatgaagtcacgatgcgatcttgggaaaaaagtgcaaaagagctgtcgagtacacttacattgatggtagcttcgcgttcggctgcccccttctcgcaaaggggaacagggacgttcttgccattgtcgggccactgatcatcatctggctgacacagcgctccacggcttcgctgctcagacctgtgaatcgagaaccaaaactcccttaaatagacgcacctttgacggtgcgaattccaaggaaaggggagagatggccgccggaaatttctgggtccgttacgcgcggcagtttctcggacttcaatttaaattcactcatgaccattgagcttcacccggcattgtcgatcacttcttgtctctcggtcatcacaccgagaacgacgacaacttcgacatcagaagtcgcgatcggtttcacgagtttattcaagcagaagtcgggggctactgtcagggttacgggaaagttataccctctaccctttgatatacgtcacatatcaacatggtatgcttgcgcgtatgcggacgttttcggcataagttggggaaatccattacggaattcacagatgtaaggagtcctactcggatagaactgggtcgtcattgtatcgtatcgggtctgatgtctccgagtcctacttggagaccagttgacctatggtataaaagggaccccccgggaggacctaaggcatcgaatctcagagccaacacatccaccacagcctacgaagccagagcttatcggagccaagtcgccgaggatctagtcggatcaagttgactacgatcttgtcaataccatcgagttccactattccctttgtaatatgtggtttccatcatataatcccatatcaattggattagggctattacctaccaaggggcctgagccagtataatctttgttttctgcctgcttgatgtcgtattacatagatcctcgtaccaacgtaccccaataccctctatatccggtttacgggtatcccccgtcgatagagagggtccgaacctatctagtaaaactttgtctcacaacccatttattttagctcttgtgtgctacctttttttattgccgattcctactgtcaacagtattatcaaagtgtgttttgtgacttttgtccttcacataaacttttgtttctggtatcacatccactactgaagaaaccatctttgcctgatcggccaaaaaccacaatagtcctggttgcagtaaaaaccgggactaaagatggtatttagtcctagtttataagcaagatggggctatgtgatctttagccccggttcacatgctgtcaggggttgtcaggcccctccgtttggatctttagtcccaatttgtgttaataaccaggactaaagatcaccgtgatctttagtcccggttggtatcacaaaccgggactaaaatttgatgtaccgtatataatccttaggacttatcctcttaactcctcatctcctattcttactctctcttatctttttctttgccttatcctctccttcaactcctcatctccttttttctttgctgcatgcagatcgagcgagccgaggtccgcggggccggcgcgcggagggcggcgaccgccgacacgcggagggccgcggccggtgtgcggagggcggcggctggcgcgcagaggctgcgcccggcggggccgtcgcacgaggagggaagccggggaggcgccagcgggcgggcgccggctgccgaggcggtgggcggcgcgttccccaggcggcggcggagcccgaggcagctgggcgggaggccggcgaggcggcggacggccggcgcctgatctgtaaaatctgtgcgatgtggatttttttccttaatatgtgcgatgtgtacagccgatctgttcgatgtggatttttttttcctgatctgtgtgacatgtgatgtgtggatgaatttgtggataattttgttatagattttggagatgtttttgtgattttgtgaatgatttctgatgtatttggggatatatagaaaatgcaacttgatgtatttggggattttgtgaatgatttgtggtgttcgaatgatttgtggataattttatgaatgatttgtgtatttcgaaatcatactagcaggaaaaaaaagaaaaaaaaatattactcctgttggagttaccaaccgggactataccgttcatttttagtcccggttatttcaaccagatctaaagatgggtatctttagttttagattcttagtcctggttgcataaccgggattacaggagttgtaaaccgggattaaaaaggatttctccaccagtgttctaacagtttaaaatctaatactagtcaaaatttgaacagtaaaagtaatagcgaccagtaaatacaaacataaggagtactatgcgaattttattttcttgacttgtactctaacaagtccatgtcaacgtcaagtcagtcaaccatatggtttacgttgagtatctctcaagtctggacccatactcctgttccttcgcgctagctgtaccctgcattattttctcagcacattcaaccaggccactccatattcaattttctttgcagtgtaccagcaaactagaactactcagtccaggactcccctgcaaaaattgttcagcagataattgaaatgatagtactccggcctggttttgttcccaattttttcttcaaactttcaactttttcatcacatcaaaattttcctacacacacaaacttctaaattttccgtcacatcgttttaatttcaatcagacgtgaactaaacacaaccctatcaaatccttttttttcttgctttatggtaccctctgtcctaactgaaatgatagtactccctccatatcaaaatagttatagttacttatgaaggttttaaaggatattaaggattatggtgcaagataaaacgacccctcattatattcttagagttaagtagtcggtgtgatatagatggttaggggtaggatgagaaagtaagatcatcttttattttgggacatttaacttcttaccatttttaagatgtggtaattaattatttgccactcactgtctatgacatgtgggccctcatgtgtatatgacatatgggtttagtggcaaataatttagcaccacttgtaagagtggcaatattaggtagctatatttaaaataaatttaaaatttaaaggtaattatattttggaatagagggagcagtagaatctaaatctaaccattagtttccataattattttaaaaaaatatttgaaagttttaaaggaataaattaaaccattaatctattatagtgtaatctatttgaaagtactccctccgtattttagtgtataacgctattgacttttttgtcgacttttggtctttcatcttatcaaaaaaaattatgtaattatcatttatttcattgtggcttgatttatcatcaaatgttctttaagaatggcataaaaaatcaacgacgtcatatattacaatacggagggagtatatttgttctacagtcatgccttccaattttaattttagttatccctgtaaaaattataaacccattttaataggtgcagtataatggaaccaaaaactattggatccgatgcaatagatagatactagtagctcataatcatcaatcctagattagcatgaaaacgcccttttttccgagattgtaaaataatgatggttgttatactagcaaacccacatgacacgcgtcaatgacaaaatgttgttggtgctcattgacttgacgaaaactaagcaacaaaatcgtagtcaatcaaaactaagcaattgctcataaattttgaaaagagaagtggtctcttatacaaaagaaaatataaaaaaattgcatgatttggataggaatgcatgtgcaaaataaaggattgtaaaatacaagaaaaataaaaaaaatgtcctttgaatatatcacagggatgtaaattgtatcaccgatacattaacttgccaagtgggtccaatctagtgcatgaacttgtagaatactcgttttggtgcataaaattgtctggtgcgtgcgaaggaaggcaaaaaggaaactacatggctaatcttattattcaggggctgattaatatactatgtaaacttatatctaggaaggttgctattaaacatacaccttctcaataaaaaatagaatatgatatagtgatagtagaaaaaaatgaaaaaaaccgaacaatgatatttaggtcctcgttcgcacaaactagacaagttcatgtgctgaaatgggcattttataagtttatgtactaaattgcaccatcctaacagtttgtgtaccaccaatgcaatttactctaccacaggaaagacgtgagaccccggagagagatagactcacataaatatcttttaagaggttggagctattgttaacttttctctaaaattttataggattatctgttttataggatttcaagaaaatgataggattaattaatggtttcaaagacctttcctttggaaattttcatatatagattaaaatcctttaaattctactccctccatttcaaaatatttgacaccgttgactttttagcatatgtttgaccatttgtcttattaaaaaaatttgtgaaatatgtaaactatatgtgtacatgaaagtatatttaataatgaatcaagtgatatgaaaagaataaataattatttaaattttttgaataagacgaatggtcaaacacgttattataaagtcaaagtgccaaatattttgaaaatggagagagtacgttttttttataaattaaatggtgctaaatgggaagaaaaaaagagaggttggttgcaccggcacgtgcgtgcagtccccgactagttttttggttagtgcatgtcgagtcaagaaagaaaatgagagctgatctgcaattatcatgtgatgatacgacgactaattaataaaatctgctaaactataaactagcagtattacatcgtggggtaggtagttatattgttaaaacaaaaccaaataaaaaaaaatcagcgccagtataatgcccccaaaaaccgccagtgcattgacggttgactagcactgcaatgataggtaaggactgttaaaaaaaacgatgggattcagcgtgataattatcacaaaaggaccacaagtaaatgggggtattagtgtgcaagaaagcaagcaggaaaaaaggggaataataatcaagcaagcaaacaccaagaaataaacagacaaaacagtagtggccagccacagtagtgaagggtcagcgtcggaatgcgacggaaatgacagcctctcgttgatccgtcgccacgcttctgatccgtgtatgtatattccacctgtcgctgttaacccaatccttttgattatttacataaaaaaatcttggttaatcacatctaataatcatattaaaaaacagtaagttttgaacagaacaatccttgattaattttacctaaaacgaaatctctttcattgttcatttataacaaaaacggtggctgaaattcctgagcgttcgaaatatcattttcgtaaaagtggtaccattttcaaccaatatactccatctgtttcataatgtaaaacattagctcacattgatataaatattaatgaatctagacacacatatatatttagattcattaacatctatatgaatgtagacaatgctagaaagtcttacattatgaaacggagaaagtataaattttgatttttttttttacatatctatcagaactatattgtaatcgtcactaaatagttaagttgatgtatatagaaaaaattcatgaccaaccaaaaaccgttcccataaaaaataatatactgtttccgaccatgttctactgttttcacccttatactagcaatgcaagtacagacaacaaaacacaatcctgtttgggttcctcctaagagagcatttaatccttgtttaaataggcactgctgtttctaaattaaccccttttcacacgctggtttcggctcagctcctcccaagcagtgtaataatatcttaataaccttaacacgcaattaagcaacaactatttgcatgtgtttctcgctctataggctggggtaatgatctgcctctctatatctatccctgtccatctctctcttacgtcttcggggtcgtcgtcttcttcttcctcctctcgctagctacctgccgttttcatttccctaccatacgttggggttttctccggctgctcctccgtgtggccagttgtcctcatcttcctcctcctctctccttgttgccgcgaagaggatagataacccatagtcccgtacgcttctctttctctctctctctctctctctttcctctccactttgaatcaatcaaaacggagaagaagaagaagaagaagaagaagaagaagaagaagacatcaagaacacgtggagcagaagcttctctgccggcttctatcgtagctctcaaggttaccaccctccctgctgacacctctgcatgttttgctttgctctgaatattccggatttgctttagttcttttctagagtccgtcttgtgcttctgcgtggctgatttagtctgtttttgggtgaatttaatcatattctgtttttgtacccgagagaagttttggtatgtttgtcttggctttttcttcacccccctcttttgttttgaaatttgtattagttatttttgttgaacggatgaaagttattagttaggtaactaggtaagggaggaagaattcttagattgtttactatgagggctgcagatttgtttatggtactctgagttgaggaagggagatgaaatttcagttcctataaaaccgtccaaagttcaaccaaggaggcacaaaaatgtgaaaacagatcctattttctctgttgagatctccaatttaatttcatttggtccttgctccatctatttaatgaagtgcctgaacttcctagagaatagagactatcacatgaataaacatgattttgatatctgatgtatgtatggatggatgcaacatcatggagcacttcacttaactccaatggtgacaccctcccccatctcttagccatcacctgccaaccttttccaataaaggtgcaagaaatggtccatgctccatggtgtccatccatcaaagtttctcttacttttttttctccattctgagctcatgcccatttgtgcttttaattgaacaattcaaatgctacctttcagacctgagaatcctgtttcttcatttatgtcatctgaccacatatcactgttaatcaaagcgttttccaggaagctaattaggctgtagtaatagtaaacaggcatcgtattcataccggcttatgcttcttattttcttgttttaataaaaattgatgtttctgttatgttataataatatttttgatcaattgtttatgtggttacaatggatgtcccaatcagaaaagagggtggccggtggcctctcactttccctacccctcacatctggtctaccaaatgctgctgagggtttacttgtaacttattatttcagcacattttatacgcatgcatgcagctatctgtggattgaatttaatatgtgtttagagtctaaatgttgattgatgactatgtgtgcatcaacatgtcatcatctgggtataattgaattttttaaagatacttctattgtagtaaagatacttgtaggatgtaattaatagagatttcaagcgtacacgtatgtagcaaccctccaaagatttgaaattgaggcagaatactcctatcatgatagatagcttccatctgtaaagatgtaaattccagacagggagttaaaaactgatatccagctgatgtgaatacaaagatctgcagaaaggagacatactttttcttctttatcctttcatgttgttgtcaacacttttcttgttgaacattctgtgcgggatatgcttcaaacaacctgatgattcctactaccaatcttatgattccttgggaaaaagtaaatcttgtgggcattcgatatcccaacaaaactttcccaaccaactttagctggcacaactttcttctgcaataaccttcttttgttttttcatctcttgttgcaaccaagaacatttgtcaaagtggtagttacgctgccagctacctctctggtttcagcaatggcaggtttctaaatacatgttcttgttctaatttcaggataaagaaaatctgctgcagaggtacaagatctagtggcagaacatgatgagcaatcttaagcttggggtggaggttaccagtgctcatgacctcctaccaaaagagcagggcacatgcaacccctatgtcgagatcgaattcgatgaccagaagttccgcacagccatcaaagagagggatatcaaccctgtctggaacgagcagttctacttcaacatatctgatccatcccgcctcactgagaaagacctcgaggcgtatgtgtaccacgcaaaccgcgccagcaattccaagacttgccttggcaaggttcggatctccggtacatcctttgtcagccactcagatgccacacctcttcactaccccctggagaagcgcacgatcttatcccgtgctcgtggtgagctcggtctcagggtgttccttacagatgatccatcagtcagagtgtccgctcctggtcaggagttcgacttcataagcacgcctacgactgcccaagagcaggtagccgccaatgccattccaaatcctttccaggagaccagagcagatcaagtgaggcaattccaacacttaccaaaagaacagcaccagcaccgtccgcagccaatgactgcgcagccatactaccctgaaagttcatacggacaacagcaacagaaaacctactctgctgtcgggaacaaagctgaaggtcctccacctccagtcatgaggatgtatgctcaaggtccacagcagcagcctgtagaattccagctgaaggaaacaagcccaacacttggtggcggacgtgttattggcggccgggtgatccccggtgaaaaggcaggggcatacgaccttgttgagaagatgcagtacctatttgtgcgtgtggttaaggcccgtgatctgccccacatggacatcactgggagtcttgatccttatgttgaggtgcacctcggaaactacaaaatgaagacaaggcactttgagaagaaccagaggcctgagtgggatgaggtgtttgctttccctagggaagtaatgcagtcaacgtcacttgaagttattgtgaaggataaggacttcattcgggatgattatgttggccgggtgtcaatagatctaaatgaggtaccactaagggtccctcctgacagcccattggcaccagagtggtatcgacttgtggggaaggaagggcacagggataaaggggagctgatgctcgctgtctggtatggaactcaagcagatgagtgcttcccaagtgccatccacgcaggatcagaaccaattgattcccatcttcacaactacatccgtgggaaggtctaccctgtacccagaatgtggtatgtgagggtcaatgtaattggggcacaggatatatttccaatggagaaccacatacctgatgtatttgttaaggtgaggctgggccaccaaatgctgaagacaaggccagctcgctcaccaaccagaaacttcatgtggaatgaggagatgatgtttgtcgcggcagagcctttcgaggaggacttgatcatacaaatagaggatcgagttgctcagaacaaggatgaagtgattggtgaaactatgatacctctcgcaaggcttccaaggagggctgaccataagccagtgctgccagcatggtttgatctcagaaggccaggactgattgatctgaaccaactaaaggaagataaattctatgcaaaggtgcaacttcgtatttgccttgaaggtggttaccatgtgctcgatgagtccacacagtactgtagcgatctccggccaacaatgaagcagctgtggaaaccaccaatcggtctgcttgaagttggcattctaagtgcaaatgggctcaatccaacaaagaccaagcatgagcgggggtcatgcgatgcatattgtgttgccaagtatggtcagaaatgggtgcggacacgtactattgttgacaacttgaaccctagattcaatgaacagtacacatgggatgtcttcgaccatggaacagtgctcaccattggtttatttgacaactgccacatatctgcagacagcaaccacagtagttcccccggccatatggacaagcccatcgggaaagtgcgaattcggctttcaactcttgagactgggagggtgtacacacacacgtatccattacttgtcctccacccatcaggagttaagaaaatgggagaactccacctggccatcaggttcacagccacatcccttctcaatgtgctcttcacatattctcggcccctcttgcccaagatgcattacgcgcaaccactgtcaatagtgcagcaggaaatgctccgccaccaagctgtgcaacttgtcgcacagcgtctagggcgcatggagccaccagttcgcagggaagttgttgagttcatgtcagatgcccgctcacacctgtggagcatgcggcgaagcaaggctaacttcttccgtcttatgcaagtcttctccggattcattgctgcaggaaagtggtttggcgacgtttgtcagtggaaaaacccagtcacaacagttttagttcatgtgctatttatcatgcttgtcttctacccagaccttatcctcccaacaatcttcctctacatgttcttgataggattgtggaattaccggttccggccgcgtttcccacctcatatgaacacaaggatatctcatgccgatatgacaaacccagatgagcttgatgaagaatttgatacattcccaacatcaaagagtccagatctggttaggatgaggtatgacaggctacggcatgttgctgggaggatacagacagttgttggggacattgcaactcaaggagagaggctgcagtcgctgctcagctggagggatccaagggcaacatctatgttcctattgttttgcctgcttactgcagttatcttgtatgtgacaccattccaagtgattgcactctgccttggtttcttctggatgaggcacccacggtttcgtcataaggttccatcggcacctgtgaacttcttcaggaggctacctgcaaagacagattctttgctataaatattttcagagatcaatatccaattgtgtatttattttttgtttttcagtatattgttgtatgatagcattaagggaaatacattaatatttgtaattgttgcttcatctgagaggataaaataagtccagttcaacagataattttcttgacttgatattgaaattcaaattgcatactatgagtagcttacaagaatcattatcaacagtagtttgtccaattgaatcaacattggcacaatcaaggagtaccgaatttgatacgtctgaggaatctatcctatgttcaataaaaattaatactcatgcttgaataaattctctttcaaataaatagccgtgcttaaataaagtctctttcaaataaatagccgtgcttaaatctgagcataaaaatctgaatgtattacgagcatgagaatcagtacctactgcctatgaaaaatctggagattcattctgtgctcttcatttgaagcagcacctttaccctcctaggatctgaagaaccaaaaaaatatatggcatcaaccaacatattggagagcaacaatagtgatggaattacaaggctgcctgcaaactagtggtagctatgattcacattttttaacatactcaagtcatgttaagtaaaagaataaaataaaaatgtaaaaatcaaccatagcaattaggagcagataaaacactatacaagccttacaaatttgagagtagcacagaccttcatcttttctggctccatcatgcaatcacatggaatctgcttaagtacaaacataagcatgaagagcaaaaaatagcatgaaaaggtactatgtgcacgtccaataagtgtccatgataagataacactctttaagttcccttcataatgcaactagcgtagctattgagtgcagacctattcatatgagaatatttaaactttaaaataagttgaccgaacaaacaacacgtcaagaaattgtatatgtgttaacacaatcaagtgatcacataggatagatcaaatgatggctaaacggagacagggtaatagtagaacaaacaaacaaacaaacaataaaaaggatctttattgctttcttttgaatggagttagaacaaagtgatgaagatagtctttatagccaatttacagataatgatattatgtcaccatgggttgaattgaataacccactatacaaatacggagctcataagcacacatatagaagaggaaatgaagtgaaacactggatgtagtattttatattgccacacaaggtaaatcttctcctttgctggtgtgtgccatttcagattatagcatttgctgtcttggagcgcgagttattatgtataattgctgaaacaatgtcattacatgttcctgcagtacatgatttataaaagaatcagtacataacacaacataccagaatataaactatcagtatgcagatatacataataaatatatatttcgggtagtcaattcatgaggccatcaggccatgaatgaacactctctgttaacaattaatttatctctttttaataaagctcgtgtttccccaacagctaataatggtgcatttataaaagagatgtagtaacaaggggtccatcatcagataggccacatgtggagtagcatgtccatgctttgaaaccaaattgcagaaaatctaaaaaccatttctagctgttaactttttgtgaaagcattaaacacttactgcacatataaaaaactaaaaaagaattaaaagcatatgaccccaaaaatcatatagcagtggtagttaccttgcattagctactgcctactggataacagcaactgactaggggaggcggagcaactgattgacagccaagtctagtgaatcaacattcttccgtaaaatctttcttttacaaatattaaggcttacaaaatgaataacagaatatacttcagaactaataaaactgcacagcaaaatggtgtttgattaattatatgacatagatccaggagaacaaatttataaaaactaacaaaggatacagttgcatggctaggctttccagacctctcatttcctcattcaacctgcaatataggtcattaaaataatgtatgaaggaactgaaagcaaaattactatttcatatataaacagtccacagtttcaaggatgaatgcttttacagttacagatgaaacaggaaagggaacacccatacaataagctataaaatcactacaattagcccatctacattcatagagaaaaaatagatgtagcagaaaacggaaagatgacgaagattagctgaaagtgatcacctcaagcacgaattgatgtacttatttcctttcgaagaagcttcgagtgctgcagggacagagtaaaaaggtaaaaatcgccacctggtcgaatctaatcattcttttttatccagaaaaataaagcaaccaaccaacgatacaatcaacattaggacaccccaactgtacaaagagaaaatatgacagtccaatgcgcaagcaaacctggcgaaatgatcgaattaccaactacaatatcaaaataaagggcaccatgtccggatgcaaactactaccatacaagaattagcattcagaggtaaatgtcgcacactcttacagccttacccccctataacataatttttccccccaatcgtttacccttatgatgaaatcgagagaaatttgcagattcgtaagcaaacatcctcaccggattcttggaggcggccgacgacgtctcccaggcactccatgttctccgccgacgtcgaggtgacctttttttttaaaattcaattttgcggcaagagggttaggctacaatatatcagtgagcgaagcgaacgagcagcaaacgaagcgaggcggagaaatgggagaagcgagcgaagggtggagggtggaagaagccgcgggagcttagtccagttacgcgtgcgtgagtgcgtacgtacgttggcgagggcgacgcggagggaggcgaagagggaggcgtagctgtcggagatggcggcgacgtcccgctccaccgcctccatcgccgccgccagctccctcggccccggaggaggcgccgcggcggccggagaaggcgcggaggagggggagggggaggggtcctccggcggatcgggaaaggcggcggcggcggcgggttcttccatcttgggttgggcttaccgtgccgtgtgggcaggccgtgtcgtggaacagaagggggatgggagagtgaggtgattttccttttccttttttgttaattagatactcctatatgccattagaaattaggtggtttcaaaatatgctattactatttgcatatctataatgatgccactaagatagtattttgtatgtattggatgaaaatgtccccatcttctacctctgtctttcctcattctctcctctttctctgcttatgctcctctcagacccaaatctcggcgctgacaatgcctccccgctgctctctgattgcactggtgaagttgttccagttaaggtcgaactcggtccacgccaggagcgccatgaagttgagcatgtcaagactaccaccgagccccaacccccggatctacagtttcgcataaggcaccatgaggaaacctagcgcagcgaccatgatgaggagcacgaccgtgtcgatcgcggccatcaatgagtagtcgtagaacgccgtgatataaaaatataaataaaaactacatccaaaatctagaaaccaatgatagacgtgagagaggatgacagaaaaaccgacgggagtggtatggttctaattttagaacttttcagtggcatgtagccgatacgacgaatagtagtggtattttttaaatttagcaaagttgcagtggcatggatttaattaacccttaaatttttaccctaccttcaatggctcccactaagatcctattgtcgccatggctatcgctatcgtcgtggtcaacacataccataaccttcttccaacaacattgaaatggaacccttgtgtccgagaacgtgtgaggcatccttgttcttgttttccctaccttctctcctctatgtatatgtttcatcaagaagaaagagcacaattcaaggctagtactgagcacttgtgtttcagtccaaggacatgccacatagtcaagccgaaagaggcttataccagtgatacaatcctttcggaggtccatggatacaatcacaaaagaggaaatcacatcgtaataaaagacacgggactttgaactgtttccttcacatacaaattccctcatctccttttctctgtcctcataaggagattccatcgagcacataccacaccaatcaaaatgttacctaaagaggaagaaggcaaagggaaaatacaaagaacttgctaggaggcctctgcggcagtggagatttggcgtgccatgataaattcatcccaaattataaatcattctctaaaataaataatagaatttattaaaatcctaaaaaatataacaaacaataaaacaagaaaagttcgaatgtatttttcttaaattctccatagcctaaaatgaaccctaaaattttgcttcaattttcataggactataaataattctaatcaacataaccaatttttagagttttataaaaagaaaaatataaaataattctgtctctcctttgggcctttttaagcccaaaattctcccccctctcccttcccagcccaaagtccccttcccgtccctctatttttcttcctccctcctcgggccaactccctgttgatatttcttaacaacattaatagaaatataattcaaagcaatgacaccgaaatattcttggtaaatttatggtcacagatataatccgcaatcgcacgtatataccattgtagcatttcatccatgagtaatccaaggtatcatatttatttaatcccaatggaacatatgataagagagtactatgctaataattcatatattacttgtatagatcaaaatctatgttggggttaattaattcgtgagtatgataagggtgacacacagaagaaagaactaagaactactctgccaaaatataatctaggctaagtggaggatgaataaaaaaaagaatcgttcatatacttctaatatatagttgtcagtagtttacacttgttagtatacaatcatgtagccaataccccctaactatgtcctcctggtgtttcgagagaccacctctgatacggtgcgctgctgtaaattgtgttatgccgagggtactgtcaggcatatcctccggtgccaagccgatgcgggtgcaagttcctaccctggagtgcccgataaccctcgcttatggcccaggattcgggggtcgacttcttgtcttagaactactcccacacagttcgtgtgatgaacgggaaggtcccaaatggctccagagtagccgggttgaggacgtactcactgaccatcctggacttaaagtttttccaagaatttcccatattcttgaaagccgccctcttgagcctatcctcatcggctgcaagatagtcgaagctctccttgaattttagctaagcagcgttcttctcggcttcgggtactaggttgatgtcatcctccaaaatgatgaaggtctccctcgctatgaccccgcatatcaacttgtacctcttcagaacatttgggggacttatcaacactcctaggtggttcacctctattatggtgtaccgttccttagggatttaatttgttccctatcctaggggtccgtgtccttgtggaccctctagttgtcatcaatattggttcgccttgctgaggcatcgtctaaataacttacaaaatcacaaaattaattaaattagtaactcacatcacaaatttcatacatttgcattaaacccctaaaataccctaaacatacatatttcctattaaagttccttaattatcaaaaataatagaataagaagtgctctgggtgccaaggtgtcgtggtcggttccgtccaagcactaacccgaccaaaccaacttggcacccaaagaacctcgtattttgtgatggtttgataacctaggtactaaatcctaaaatcactatgatcctcaaattgtgttattatttgataaccaaggaactaaatccatacataaatgaataattatcaaaaaaatgacagaatacgaggtgcgctgggtccgaaggtgtcttaatcagttctgtgaatgcactaactcgataaaaccaaattcggaccctatgcaccttgtattatgtgataatttgataacctacgtactatctacactaaaatccatcatccatacatatatattcactaattcacaaatatatcctaatacttcactaattcatatatataaaaatatcctaataattcactaaacatatcctaataattcaccaattcacaaacatatcctaataattcactaaatcaccttaacatcaataaaataccctagattcactaattcaaaaaatatcctaataattcactaattcaaaaaatatactaataattcactaattcacaaacatatcctaataattcactaattcacaacaatttcactaagtaccatcacacacaaacatctcaaatatatttcactaattcaaaaaaaatcctactaattcaaaaacatatcctaaaaatcctactaattcacaaaaatttctaaccagcggaggaggaggtgaggcggtgggcgtgctcggggacggcgggggacgtcgatgcggtggtggcaaggacgggggcaaggacggtgtggaggaggtcgacggcggccgacgctggcttggggttggcgccgggctcggtggacgacggtgttgggctcggggatggcagcgggctcccagagggcggcgccgctagggttcagagagtggcagagcttagaaaaattttcgatctagatctgagtgagagtgaaccctagtctttatcttcctgattttgtgcaccacttcctgattcatgctcatgatcttcatcttcttgattttgtgcaccacttcctgattcttgctctctatgcttcacccaacatgtgtagtcctccatgaaacctctttgtatcagataagcgtgtacgtccacagtccactctgctatcaaatatattctcatgtttgtaatctgcacatgtacaacacatgtaatcgctatttcttgttttcctatcctcctccgcgacgttaataatatccaatacaccatttctatactccttggtatgacgtcatacagtttttcccatacatccaactttggtccatccctgagctgaaaaaagtggaaaagtattatatataaattttgcaggtaagtatttactaaatttatgagaattgactactatttttcaattccatttgcaatttatgattttcttggaaaacagagacaaaaatcggcccgctcacactcccatcaaaatagtgagaagtgggataaccattacactaggtagttcgggtatttgtactgtaataaatatctataacggccaaaaaaaacttacaacagtgatgggtttcagttatctttgtcgagcctaagcaaaagctcgtcatcaatgatgagcctaatagttatctcaaccgggccttaagttagagcccgtcaccaatgatggacatcggtgacgggcttctattagggcccacaaagatatcatcggttatctttgtcgggccttaagttggagctcatcaccgataggtgtcatatgtgacgggctcgatttctatgcatatctaacatgtctatgcgagtatatctttgtcggtctcttttttttgggccgtttgagatgaattcattgtgacggcctgcaaaactcaaacatgtgaggggccgtcatagatgagatgatatgtataatgtaaatatagttattagcttaaaaaaataggagaagatatagagtaggagggttggagggtggccggatagagagagtacgtacgtacttgcccacagtgggggtgaggctaccttgtgtttttgggactatctataaatctataaatctgttgacatattttttggcaaaaaaataataatcagctttttagcccttggatttcacagatcaacggttgatcaacatgttagcgtgcgttgacaataattatttgaaagttagagtcaaccgtacgtactgctaagagcatcaccaagagattgacaatgatcaattctcaaaactattttttctcagagctcctaaacagaatatagaaagtgagaaaactaatctcactctaaaagatagcctaaaattaattcctgtaatgaaaagtgggcactccctttaactaccaacagataaaattagtttttctctcctcccctacacctacatctcgcgatttttttctccgtgcgcacgggagagagcaattcgtaaaaaaaaaatcgctcccttaaagcggggaacgagatatccggagttgggaactagtattattgggagacaggttagggattacgttggatgcaatttttgactgaactttcctaaatccgaggagcatgaccaacagcttccttagtctgtgttctttgctcactgttcccaacccctctacatcgtgttctgcgctcacgcttttcaaactgctaaatggtgtgtttttttaaaaaagtttatatacgaaagttacttaaaaaacatattaatccattttttttaaaaaaatagctaatacttagttaatcacgtgctaatagatcgctctgttttctgtgcggagggaaatagttttcaatccacagaaaagaacgcgcgcagccattctatttagtatcctctcccagtgatccaggttctcaactccggatatctcgttcctcacctcaagagaacgattttttcccaatctctctcttgtgcgtgcaaggagaaaaaatgaccgcgcacggaaaaaaaataatgagatgaaggaggagctggccacgtggtgcgcgcgtgaggagtagaaaaggcccacttttgattataggaaattaattttaggccttctcttctataggttttctcactttaggaatttattattgaaatactgtcggtgatgctctagtacatcggaaaaaagatataggaattcgtatttgaaagttagtgctaaattagaatgcatgtatgtagcacaaaattagctgctatagctgcaagcgggactcttcccgagaaaaaagtcggatggaagcacagatctttaacatagatccaacggcagctagagtactgaatgtaaccatagaagaaaaaactgtcgacacaactatagtaaatcccatttttaagagatttaatggttaaaacttatggatgcaccaatttaataagaaatcaatggttagatatttatcaatttttttttattttttttctaatttattagaacaccacacgatagtttatgagcgtttataaaaggccatgtgacagcttgagagtgtttgtaggaggtttaatggatgtttaagtatataattgtagcatataggtcctgtttagttccaaagttttttttcgaacctccaacttttcatcacatcaaacctttcatacacacgcagcttttttatcacatcgtaccgatttcaaccaaacttctaaacttcaggtaaactaaacacaaccatattggtgttggctaaaataccctttaagaactaagaaaattggcagaaaggagccagagatacgctatgtgttcgcgtggatacttgtatagcaacaacgtccgcatatctgccaggaacagaaatgttagtatattcgtattcgtatctcctcccaaaaaaaattcctattcatatttggtagaaattatccatattcgtaacagagatttgtcacgatcgtatttgatttttctccggagcggaccgaaaagctctattttcccaggattgctaattcgcgcgctagcaacattgctggtggctccttcccacacgaccttttctcgttgggaaaactgcaaaaaacactccaaatatcactctgagtttgagatgcctcaccataagaagatttgttgcaaatctccacctcctaattcaccttggtttgatttaggcaccttctctccacacgtgcgtgattcctgaagaatctcgtggcaaaatcaaccgagtcccacttggcgggtgcaagagattatgatgtttgttcagtataaactgatcatttcgttgtgatgtcatgaccatttcactgtgttttttatggtatcctagctatatattccaaatcgatatcttttggactgaacaacatatccgttttttttttccagggacgtaatgagcatatagaaacatttgaacattaagcagtaatcatatagttagattagacctgatgatttcatatgttgtaattgatcagatgacccaaaatagcaagtttagtacggtttaatcagaaaattaaggccacacaatctaatgcaaaaagggacctgttgacaaatcatcacgatgagcgggacttggctaattacgccatgagatgcctaaatcacgcatgtgtagagagaaggtgcctaaatcgaaccaaggtgaattaggaggtggagaggtggggatttgcaacaaatcttcttataggggccatctcaaacttatagtgatatttggggtagttttttgcaattttcccttttttttcctttttcttttggcgatatttttttctttattttctgctttttttttattacacgtgttttttcaaatgttttgagttgaaagttttaaaatcatgacttgaaaatttttaaatcttaacttaaaatttttcaaatcttaacttaaaaattttcaaatctaaacttgaaaattttcaaacctcaaattgaaagttttcaaatcttggattgaaagttttcaaatataggtttaaaattttaaaaatttaatttcaaatatagatttcttttcaatttgttagttgaaaaaagtctcgtgaaaaaaaagaaaatcttaactactaccgaaattatctctaccttacttgagaaaacacgcgcgccaactaccgaccccctatttttcaatcctataactacagcctactgcgtgccctacctctacctgtttgttgttagcgtggaatattatccgctacccataaatgcaaccgatagaactgcacgtcctgaattaattttacatattcactccgtactcataaagaaagtcgtttaggaaaatgtttaagtcaaatcttaggaatataaatcataaatatctctcaagttgttgagtttgaaaatgtaaaaattatatgaatagatttgtcttgaaaaatactttcataaaagtatacatatattacttttcaataaatatttttatagaaacaagaagtcaaagttgtgttttagagaccgtgtcgctgtcctaaatgacttcctttatgagtatggagggagtacaaatctataaaatcacacaaaataacttttttttacataataatcacacaaaataactaaatttatttaacttatttcctgtaagtactggtaattttgccacctactgtgcttaaaccaagcctggatacactttttttttttggtttggatacacttaaatgacgttcaccaaagatcgtacttatcatggttggtttgactagagggatcatatatatcaggccaaagtcagttcattgaaccattctctacagttgattaaagcatagctcgagttggagttttccggctatttggtctagttggtctaagtggtgggctagttggcctaatttcgagcctcacgtacacctcaataaaatggcaatggcaagaaccagacgccctattttttttaagtattgggtgctttccaatggcattagaaatctaggagcgccaatcttttacactattgtattctcaaataacataatttttacatttgcaatataatggttgtacaaagaaaattcactctctttcaaagcgttggagttggagcacatgcttcttttttttttcttagcgtgacatcttaacattaagcaaatccttttcctgtcttgccgtgacctgcactcaaaaataagggagcacctgtattaaatcctaataaattctattggcccacattaagtgctatggataataatatcactttggaaatctaagtgaagaggtctcaacttaaatacggagctagtggagagtttctgttgaccggttaagatggtgcgcggacaaccaagtggggcgaggcgaggagaggcgaggcagacaactgctgcgctatctcgttttgtaacggatggtaataagcacggagaattgatttcgtatcaatgaactttatggaattaaacgtcgtgaattgattccgtcggttacggaattaaatgtcatgaattgattccgtattaacgagtgcgtcggttacaaattaaacacccgggttgatgactccgaacgttactctcgcgctcgcatatatatactccgcagtgatccaaaggacggaagaagttcttcacgactcttgcacttcgagttcctcctcctttgttcctgagctgcagaatccttccccggttctgttcacctgtgcgcacaggtgtacgggacgagcaggtgcctccggaactccgtccgcttgagaacttgcacgggtaggcgggcgatcaagtttttgggtagcgcttcaagcgtgactgctattgttcttcgcggctactgctgctgcatcggcaccttcaccaagatgtcaacggagattggagacaagaagatgaacgacatcaatggaggcaatactacctcaaaatccagcggtgggacgttctcggggtatactttcattctcccgattttattagatgtttctttgttaatactcttcgcaatggcagcattgcgttactttgtaaatgttgatgcttatttcatattaagcatactcaagttgtatacatctagcactgtcactagatctactcatattgtaaatgtcatgtttattatcttaatattttggattaaaatatgccgaattatgaccaaatttccaacaatccaaaaacttgttaggtctttttcggtagttggctttgctgcatcactaaaaccacatgctttcgatggttcaaattataaaagatggaaagcacgtgcacttttgtggttgacggtgatgcattgtttctttgtctcacggggcaaaccgagtgaaccgcctctctctcttgaggaggaggctaagtttgaggctacagattgcttgttccgtggagcaatgatcagtgtgctcgccgataatattgtggatgtgtatatgcacataccttcagggaaggacatgtgggatgctcttgaggccaagttcggggtttctgacgctggcagcaagctgtatgtcatggaacagttctatgactacaagatggtcgatgaccgttctgtagtggaacaggctcatgagattcagatgctgaaggaacttgagaacaacaacggcgagttgccggacaagtttgtggctggaggcattattgccaaattgccaccttcttggtcggattttgctacttctctaaaacacaagaggcaagagttcagtgtcactgatctcattggctctttgggtattgaggagaaggtgagggcaaaggataaccggtgcaaaaagatcgagggaggttctagcgccaatttgatgcagaagaagaaccctcacgcatccaacaacaacaacaagaaagtcaaacctgacgtcaaacccaaggctacaaccaattttaagaagaaaggcaagggaaaggtaaaaggagatttctttttgtgtggcaagcctgagcattgggccaaggattgtcctgagcacaaggacaagaagtttgcaaacatggttattagtgagggtagaggaacattggggtatggtaaatttttacctacagttctctctgtgtgtcactcacctgattggtgggttgatactggtgctaatattcatgtgtgtgcggacatttccctgttttcttcttatcaagtcgggagaggttcctcctttttgatgggaaacggatcgcttgcggctgttcatggtgttggtacggtcgatctaaagtttacttcgggaaagattgtgcagctgaagaatgtgcagcatgtcccttcaataaagaagaatctagttagcggctctctactgtgtagagatggttttagacttgtgtttgaatccaataaatgtgtcgtatctaaatatggaacgtttattggaaaaggttatgacagcggaggtttgtttcgcttttccttggatgatatgtgtaataaagttgtgaaccatgtaaacgatgatgatgatgagtccaatgtgtggcatttgcgactttgtcatgtgaattttggttgtatgacacgcttagccaatatgagtttaattccaaaattcactttagtcaaaggctctaagtgccatacttgtgttcaatcgaaacaacctcgcaagcctcacaaggcatctgaggcgaggaatttggcaccattagaacttgttcatttcgatctgtgcgaaatgaacggcgtgttgactaaagggggaaagaaatatttcatgacactgatagatgattgcactagattctgctatgtgtacctattgaaaacaaaggatgaagcattacattactttaagatctataaggatgaggtagaaaaccaactggaaaggaaaatcaaacggttaaggtctgataggggtggtgagtatttttccaatgagtttatttctttttgcgaagagtatagaattattcatgagaggacgcctccctattcaccccagtcaaatggggtagctgaaagaaagaaccgcactctaactgagatggtgaatgccatgttagacactgcaggactttccaaggaatagtggggtgaggcaatattgactgcgtgtcatgtcctgaatagaattcctactaagcataaggaagtaacaccattcgaggaatgggaaaggaagaaattaaatctctctcacctgcgcacatggggctgtttgaccaaggtaaatgtacttatagccaaaaagcgtaaacttgaaccaaagaccgtagattgtgtgttccttggttatgctatccacagtgtgggatataggttcttaatagtaaattctggagtacccgacatgcgagttggtacaattactgagtccagagatgccacattttttgagaatgaatttcctatgaaaaatgcacctagcacttctagtcaagaacctattttatcccctgagcactttgtgccgatagaacacattgatcaaacgcttgaggaaaatcctgaggaggataacattgtagcaactcgaaagagtaagagacaaaggactgcaaagtcttttggatatgactacattgtatatcttgtggatgatactccaagaaccattgaagaggcatattcatctcctgacgctgactattggaaggaagcggtatgcagtgagatggactcaattatgtctaatggtacttgggaagtcgtcgagcatccatatgggtgtaagcctgtaggatgcaaatgggttttcaagaaaaagcttaggcctgatggtacaattgaaaagtacaaggcaaggcttgtggccaagggttatacccaaaaagaaggcgaggattttttcgacacttattcatcggttgcttgcttgactacgattcgtgtactactcgctctggcagcctctcatggtctactcgtccatcaaatggatgttaagacagctttcctcaatggagagttggaggaggagatctatatggatcaaccagatgggtatgtcaggagggaatggtgtgcaagctgttgaagtccttgtatggtctcaaataagcgcctaagcaatggcatgagaagattgacaatatacttacatctgctggctttgttgtgaacgaagctgacaaatgtgtgtactatcgctatggtgggggagagggagtgatcttgtgtttatatgtcgatgacatattgatctttgggaccagcctcaatgtgattgaggaggtcaaggactttctgtccaaaagctttgaaatgaaggatttgggagtggctgatgttattcttaacattaaactactgagaggagttgagggtgggattacacttgtgcaatctcactatgtggacaaggtcttgagtcgctttggttatagtgactgcaaggcagctcctactccttatgatcctagtgtgctattaaggaaaaaccgaagaatagcaagggatcaattgaggtactcccagattattggttcattgatgtacttagctagtgcaacgaggcctgacatctcatttgctgtgagcaagttgagccggcttgtttcaaatccgggagatgatcattggcatgctcttgaaagagtaatgcgctatctaaaaggggcaatgagctatggaattcactacgccaggtacccaaaagtgctggagggctatagtgattcaaactggatatctgatgctgatgatataaaggccacaagtgggtatgtgttcacacttggaggtggcgctgtttcctggaagtcttgcaagcagaccatcttaacgaggtcaacaatagaagcagagctcacagctttagatactgccacagttgaggctgaatggcttcgtgagctcctgatggacttgccggtggttgaaaaaccagtaccagcaatcctgatgaactgtgataatcaaacagtgattattaaagtgaacagttcgaaggacaacatgaagtcatccaggcatgttaaaagaagactgaagtctgtcagaaagcagaaaaattccggagtgatagcattggactatgtccagacggctaaaaatctggcagatcagtttaccaaggggctaccacgtaatgtgatagactgtgcatcgagggagatgggcttgagacccacttagagttgcacatggtggaaacctgtccattgtgatcggagatcccgtgaatttggatggcgaaacaaactattgtgtaactgagagaagagaccctaaaatgggctttatcttcatgatgcacttctcttctaatctgtatggtaggatggtatacaccttaatatgatccgagtggcttttcataaagcagagatgttggcctacagaacatcttagaaggaacacacctatatgagtccgactgctagtcacagtctatgagatctgggtgatatctagatactcatgaaaaggccaggagtatgacttatacgctccaaacagaggggatgcaaacggctgcctagtaccagttaagggtttgagtgaaacctgaatcgcactagactgacaattcaaggcatagtccattattcagttgtgatctggtgtagctcttttcctaggtggaagttcaacttaacagtctccaccgaaacactggtataacaaacaggatcagaatcgagagcatttcctgtgagccatgaaatttggtggggattgttagattaatgggctaggcccaattaaatcctaataaattccattggcccacattaagtgctatgagtaataatatcaccttggaaatctaagtgaagaggtctcaacttaaatacgaagctagtggagagtctttattgaccggttgagatggtgcgcggacaaccaggcggggcgaggcgaggagaggcgaggcagacaactgctgctgctgcgctctctcgttttgtaacggacgataataaacacagagaattgatttcgtatcaatgaacgcgtcagttacggaattaaacgtcatgaattgattccgtcggttacggaattaaacgtcgtaaattgattccgtcggttacggaattaaacgtcgtgaattgattccgtattaacgagcgcgtcggttacgaaattaaacaccgcggttgatgactccgaacgttactctcgtgctcgcatatgtatactccgcagcgaccagaaggacggaagaagttcttcacgactcttgcacttcgagttcctcctcctctgttcctgagctgcagaatccttccccggttctattcacctgcgtgcacaggtgtatgggacgagcaggtgcctccggaactccgtccgcttgagaacttgcacgggtaggcgggcgatcaagtttttggatagcacttcaagcgcgactgctcttgttcttcgtggctactgctgctgcatcggcaccttcaccaagatgtcaacggagattggagacaagaagatgaacgacatcaacggaagcaatactgcctcaaaatccagcggtgggacgttctcggggtatactttcattctcccgattctattagatatttctttgttaatactctttgcaatggcagcattgcgttactttgtaaatgttgatgcttatttcatattaagcatactcaagttgtatacatctagcactgtcactagatctactcatactgcaaatgtcatgtttattgtcttaatattttggattaaaatatgccgaattatgaccgaatttccaacagcacctttgctctgaacttgcacaagattattcttcacttctgagcaatatcagagctatatgcttgtgtgcacaggcagcgcgcgcgtgaagatgatctatttcccgtttgaaatacgaagattaagtgatggcacataaaactggagtcattaacaactgattaatggtgttttaacaattataaattaaaaatagatttatatgatattctaaaacaacttataatcaaaaagtttttgcctatgaagaagtatatcatttagtaatttgagaaccgtgctaacggaaatcgaggaaaaacggtatcttcatcaagtttttagtatgcgatgtacatcagtagcataagatttccttctataaacatatcaacaaaatgttaaggtctacagcttgacactgaatctatgtacttcctttacttattatagcactgaatctatgttaaggtccacgttgactttctctaggaggagcatgtattaacgtctgcgccggcatgagagggagggagtggggggatgtcagcgtgggacatggagggagggatggaatgggggagtaggggatctgagaggtgtggactgtggagtggtgcggggcgggggcatatatatcgaccccattcacaccgctggtcacaaaccaccacctcccacgaagtacggacgtttgggaaatcccattggtttcgcttccattccatcattctttttgcaatattctcggtaaccgcacaatatttacgtgagttccaatgaacggccaggccattcgtggttaacgaagcaacgtagtacgtacatgaccatttacgcccgcaagggaaaattaaattctgatgtgaaacaatacgttgtgcaaattaaaatgtggttaacaaagcgtcgcacaccgcgtgaattttccgaatcgccgtgattgggttatacttatatcatttacatccatcaacaatagaaccacaaggtttcacaaccgtaagttcccatcgctcgctcagcaaccacttcttcttcttcttcttcttctttttcttcttcttcaaccttgttccatgagccaacacggggctatctccatggctacctccttcaaggacaaggacgaagcggccgagaatgcgcttgcccaggccgcggtcacattgcatgtgggcgagtcgaacgtgacaaacaccaacgtggccacgtctttcacagagacatgtcatgtgctttgttgccatgatatactcgtctaaatcgcgggcctcgttctcgttgcggccaccgtgatggagtccattgccgacctcctcagcctatgcgccatgtatgttatgttgtgtattgtcctgccgtacattgcttttgtactgtggctcgtacgtactctagtatataccgaacataacatttcgtacacacactgctgactcacgtacattttgttaatttgaagctgcaaggcaatgcatctagcggccaaggaggcctgtcgtcgggaagcggatgcattcggataatctggagagcatgaaatggccaggacaaagagagttaccacgccgtcctcaaacaccttgccttcaatggaaacaaggtgtcgtccgagtgaacgcggaaggattcggcatcgattatctctagggaagacgagggatatgagaaagaagacgatgtcattgtcgtgtttgtatcagtgtgtaggtaccgctcaccttgccgccggcaggtcaccttatagccgacctgttggctcactggtggagaaaccctttgtagtcccggttcgtaacccccctttagtcccggtttccaaaccgggagtaccaatccgggactaaagatcgctatctttagtcccgggtgaaataaccgagagtaaaagatcgatctttagtcccggttggtaacaccaaccgggactaaagatcgagctgaccttttttttttgcatgcccctgttgctgcatggtttatatatatataaaccatgcatatatatgtttcaatacatatatatgcatacatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtatggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctattgtcatttctttaccggtcaccaacggctcgatctcctggtttggttgctctccaagctgagggactggtttggactttccagaagatgctttcttcagcgttcgctcatagtccgatagcttgatagcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagttcgaggtcctcgtacgcgccttcgaccaactcaacttcgaccttggagtatcctgctggaatcggcctgcagtggtaagtacctgaagggtctgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggtgagtgtcagctcgtccctatctctgtctggtcggaacgtgccctgacaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaacaatattacatgctaagactaaaatagtcatgtatatgctaagtgtttcttgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttctactcacgcttgacggacgact

SEQ ID NO: 20380 - DNA, 4573 bp, Oryza sativa
gaggcggaggcggcggcgaggacgacgagctcgagacgacggcgagatacggcgtcgtcggcgcggggatttgccctaggcagtggcggcgaaggagagaggccgagagagatcgatcggccgaaaacgtttaagtgttggtgaagaagacgagggcgcaccgggaatatatataccccttgatctttactcccgggtgttctcaacaaccgggactaaagatatctttcggttgttctcaacaaccgggactaaagatatctttactcccggttgttctcaacaaccgggagtaaatatcttatcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattttaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaagatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctatgcaaaatttgatgacctcctctgttccataacccttggcgatgcttgcctctggacgagcacggttacgaacatacttcttcagaacgcccatgtacctctcaaaatgaaacatgttgtgtaggtacataggcccgagaatacggatctctttcacaaggtgacaaagcagatgcatcattatattgaaaaaggaaggtggaaatatcaactcaaaactgacgagacattgcaccacttcattctgaagggtttctaatctatccggatcgatgaccttctgcgaaattgcgttcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccttatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaatgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctaggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccccacacaaataattattcttacaataatgac

SEQ ID NO: 20381 - DNA, 3304 bp, Oryza sativa
  unsure (1)..(3304): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaatacactcaaaggacgcatatttgttaagtttgtttcttaaagtattcaatttattcatataattaagtatataatcagtagcagtaatctgcctaataatccaaatcaaacatagctcaagtccaaactctacagctttgagttttctctaggctggagcaataccaaacatgtcaatagatagataaagatatgttcgattgatgattaacattgccaaacctcatattacataaggtgaagctttaggcaaagtgttgcaaaaaattgtgtctttgaaataggccgatgaaaaatatagctacccataacaatggcatcaactaaacaactgcaaaacaaccacctaaagttgggatttggcaagttgaaggcatcatccaaccataacatagttctccctccgaaaagaaataatactaacatcatactaactccatcccaaaatataataacttttagtacgaatctagacatgcacttgtccaaattcatagctaaaagttattactcccttcatcccaatatatagaaatatagtatcagatttgatattttaaaatactacgaatctaatcatgtttcatatttatattcgtagtactataaaatgtataatgcacttttagtaacttttagctacgaatctatacatgcactttgtctaaattgatagctaaaatttattactccattcattccaatatatagaaactagcatcagacgaatatgatcagaggtttcctgttcatattcatattactataaaatatctaatctggtatatggctttcacatttaggacaaagagagagtactaatctattttaggaaagaaacaatattacagataacccttaggactgaaacgcacaattctcccgtattaaacccgtcaaatatctagactttaattaacataattaattccaatctatccatcccgtcgtcaataattttgtccccctggctcccccccccaccttcctcttcctcccctcaatccccccttttctcacggcgtcgcggcccccccgaaataaagccgtcgtcgacacctcccccgagccgcaagcaaccccgcgattcccccgcatcgccggcgaatcggcggcggcgacgacgaggacgacgaggaggccatagggttgtggaggaggggtgggggacctgtcttcgatgcgcggcgcatggcggcggtgaacagcctctacgtcgccgcggcatccaccgcggccagcgccgcggcgctgcagtggtgggcggggtccctcctcgacgggaatgccgacgcggcgggcgggggaggaggaggaggaggaggggactggctcggcacggtgctgggctcgcacgtgaccgtcgcgctcctggcgaatctggcggcgcacgtgttcctcgtcctcatcctctccctcaaggtgagcaatcggtcgatcgggaatgggatgggggttgggattgttgctgctcagggccacgcggtcattcgcttagattgtgctgtttggggaaaaaaaaacttttgtcggttgaccacttgtcagtaataataatataagcaataataatatatgcaagctgatagttgggaagatggaggtgttttttctgcccaaatttgttgattcaaatttgctgcccaatttgttggtttaatttgcgtgctgaagatatgtttgatgtttaggtagaaataaacttaatttgtttagttagaatggacgtgttttccttcattaaatcagctaatgacattttgtttccatgttgtttttggaatcatcaagtgtgtgagataatggagtgatttagtaggaatattgtgctttagctgattgcgaagaaccacatgttctcaggagttgcatttcagttgagtagatgcttatctaaactatggtagttggaacatatggggaagtagcaatgccaatagcaactatacaacaacatgcttgaatacaggcttgaacaccgcgattctgaagtctgaactggatatttgtacgtagtatttttgttgctcgatgctagaggatttctgttatgtggtatttttgttgctcgatgctagaggatttttgttacgttaagcggttctgaaatctgaactggatatttgtatgtggtacttttgttgttcgatgctagaggatttctgttacgtctctgaatggctgttatatggctttgatagagcaagagctaagctgacagtgtgtgacttggttcgttgcgatttccttctagactcatttttgtgcatgtggtttaatattcatgtaagaacttgtattgatacatccacttcttgattcatgtcgtaaactggctgtacttaattatttttacttccataggaatctttaaaaggagcattagagtttgacccaattttgtagttcaatcaaagcattttgtctgttggaaaagctcgtcctccatgtatgcatacagtttgcattgcaaacatgataactatgttatataaaaacactatttcatagaggaagctaaacttctagtctgctatcctagtttagattcttagtgacttatatatgagagaaaggatggttcatactattacaaagccaggtgtccaggtgacctttttgaaggcacaaggcagggcattgttcttcctccattgttccaatccatgatttagcggaaaccattttacctgagcatccagatttcttttaatgatttttagtaaagaggatgttgcagcttagcttatatttaacgtatgcatatcatattagcaatagtggcgttaatgttgttttttcttttatgcagacactattttttgttcaattaacctcttctgagactagaaaggtgttggaacacatcattaactatgtgctttacaaggtaagcgctctatccatctctctctctgtgtgcgcatgcgctccccttttctcctgactttctgctgataagctcgtagtcttcaacacaagagacttgctctaaaatgatgtttgcaatatatgctttagtgaatttaaagcagcttgatagtgagttcttttaaattagataatatgcagtcttacactttgttcaataactatcagccataatacatgtacaatctaatttagatctaatcctatctccttgagaatcttagcacaagtccaatacgtggat

SEQ ID NO: 20382 - DNA, 886 bp, Oryza sativa
cttcaaccccttgcaaaccgaacaagccctaagggaggatgtatgatcaattgacagttatttatttatgttcttgttgttgcctgccatgtgaagaaatgccaatgatctctctcgtattccagggaacttttctcccactggttgtgcctactaattctcaacaaataatcctttggtcaagttggttgggccttctttgttccctgaaggtaatgttttagaacttcaagtcttcaactagttaagattatacccttacattaactaaaatttctcgtacatccagatgtttcaatcattggctagagaacgccttgaacagctcaatgcttcaccatcagcgactccatcaaaatactttcgtgtatattctgcactattgctggttctatcggctgatgtactatggtaatattccctggttagtctgcattttactgttttttgtttagaaatattatttacacataattttttctttgcttaggtgttgggtacacttaaatttattttgattttgtagatgtcagagatgcatgatgtcacttactcacttccaacatgaaattattgtcccttacaatttcttgcaacttgcaacttctgttataaacttactctgtccggtcaaattatttgtcatttagagatgcacttgatagtgcagtggcaaggggtgtgtggtttcaaccctaagatcccttgttcaatccccaacactctcacaatttcttcttaaaaaaagtttggagggacatctctcactccaaatctcgtttatttggtcctgcaacggcttggctactctagctttccaacccaagatactgctaggtttgccaattggtggtcaagaacagtaaggggttaacctgataatgag

SEQ ID NO: 20383 - DNA, 756 bp, Oryza sativa
gtacgttggtacaaggatctacgtaatacgacatcaagtaggcaaaagacaaagattatactggttcaagccccttgataggtaatagccctaatccagttgatgtggaattatatgatggaaaacacaggttacaaagggaacagtggaacttgacggatccggcgagattgtggtcgagttggttcgactagatccccggcgatttggctccttgcaggctccgacttcgtaggctgtgagggttgtgttggatctgagattcgatgccctaagtcctccctggggggtcccttttatatcacaagtcaggcggtttccaagtagaactcggaaacatcgaaccttacacgatacattgacgacccagtcttgtccgagtaggactccttccatttgtaaactccgtgaggggtttccttaatatatgcggagagtatccgtatacgcgtgggtataccataccgatatgcgacgtatatcaaagggtaaagggtatacctaacccgtaaccctgacaatgaccttgcctaacaacatatgcagaacaattgataaacttgccggtattttatagaaatagacagtgtcgatgacaaattattgaaatgagataaactcagtggcataagctcctattaatattatttgaacttttaaataattttatgaattatattatatgttatctattataatattagttaagcatgcatttgtgctgtaatgttatatgtgttgaactcaatattatgt

SEQ ID NO: 20384 - DNA, 719 bp, Oryza sativa
  unsure (1)..(719): unsure at all n locations
ccgtcaataaactctttggaccgccggtcagcgtacatccattgccgatccatctacggtgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagtaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20385 - DNA, 234 bp, Oryza sativa
cccgatgccgccacaccgccgttaacgaacgagaacgagaacgatcgaacgaacgagagcgagaacgaacacgtcaacgtacgttgccgcgacaacgtgaacgagaacgatcgaacgaacgagagcgagaacgagaacgatcgaacgaagacaagcgagaacgaggaacgaacgtgaacgagctagggaacgtgaacgagcgaacgaacgaggacgaacgtttacgtgaaatgc

SEQ ID NO: 20386 - DNA, 1168 bp, Oryza sativa
cttctttttggagaaagatggttgcaatgagagtgagacgaacctgcgagggggtcggttgaatgaccaccttggaggggaaatcaggtttccccggcacggttccgtctcccccgtcttgcggagccgcttcttcttgcgcaccccctcgggctgcgacgtcggcgcggccccctccgggcgccgactgctggcacgcgccgccctgccccctcggggaggagatgggggaggtgtacctcccagcttcctcttcccctgggcgtcggcagggcggctgctccccgagcccccgacgcggggcccagaagcacgaccccctcctggggcaggttgttccctccggcgtcgctcgcccgcgccgtcgtggcccttaggggctctctcctctgaggccccgacccccaacataatggttagaatggagacgcggtcgggatctatgcagagggggaggatctcctgaggaaggcgagacgcctccgcggagctaagattcagcaccctttggactacgatcttgaagtcctcaggagcccaatcccatctggctccctggtgggtccgcatgtagtcttcaagcccagtgtactcccaggcgctccgggcgcgccgttggagcggcgcaatccgacgacggaggtaatcgccgaacaccatggccccggtgagcccctgggatcgcaagcccgccaggcggtcgaggacggcgtcgtactcctcccccagatctaccggcgcccgccagctggagacctgcgccgggggctggcttggaagtcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgctccgggtagtctggtgccgggcgc

SEQ ID NO: 20387 - DNA, 2540 bp, Oryza sativa
ttcgctccctcgtatctcgctatctcgctccctcgtttcccgtgcccacgcttccactaatcccattcgcccgcttacggcgcatgaagtggatatgcggttgtggcaatcgaaatggattgtatcgtgcgcgcgttaattaccctcgccgtccgaagcggcgttaccgtatctccaggcgagacaaatctgctcacccagattcgcgcgctgctcaagtggtgtggcagtcttgaatagaccgcccattatggacaaccaaagttatcaataccaatgtgcatggattgagaccgttgggcattttgcccaactacggagaccggtcccacctgtcaccaggctttaggggtggcgtcacacttgaccgcttcccttgggaaaggaaattgctctggcataacgccgggggctactgtcggtgatatgggaccgggagtatcatgaccagaggcttgaggcagacgcaatcgcccacgtggcctggcaccttcggggacgttgggcccgagggtgaggtgtccgccctcctcgtgatttcccctgaggggggggtcgggttgcgcttgctccggccccgagggccggggcacccccgaccccttaaagaagtctgcgccacatatatgggataagtgagcacagctgtgctcacctaacagcatttattgcagtctggtcaagcgtgtcacgctgcgtgcaacgcagtacagcacgctcttttatccggtctgtgaccagtcacagaccggtcagatcaagggttaggtggcgactggcggtctgacgcacgcctcgccccatcccgtcaagacgaaagcctcaaggcaactcgtctcaagccggagctagcgtgttatctcttagagatggcacgttagccctggttagatttataccaggcttcatcctaatcattacaggcaaggtgttacacgaagaagggcaaacatgcacgttgttaaactgacgcgtggtggacaagaatgaccggtctgacactggtcgcatcagcaacgggcagccacgatctcacgttgcgcccgtctccgccgggagtggaggtaggtgtgagctgtcccatcgaagtgtcatttggacgacaaccataccaatctccgcccattaaagagaagaagaacagtccagtttggaaagggaagggtgcatgtggtatccccttgaagtataaaaggaggaccttgcccatagagaaagggttggttgattcttgccagatttagagcctagagcgggggagaagtgggctctcactttgtagctcattcatacacaaatccacaaaaacacaggagtagggtattacgcttggcagcggcccgaacctgtatacatcggccgtgtctcgtgtgtcttgccggcgagcatctttccacatacagagagagcttgagatcgcaccctaagcccccggccgaaccggcaaaggggggcctgcgcggtctcccggtgaggagccacgagctccgtcatctggcgcgccaggtaggggtctcagcgtgtgctttctgagctctcagactcttccgtgtgccccaagtttttcttgttcagcctaatggccgagcaaggaaaaacgcacgacatctcgccgagtgtgagcggcgacgacggggagccgaatccacgccgtcgagctcgtactcctccacctcctccgcgccaaagtcctaagcagggggaggcgcttgagagggtcgacaaatccgcggcgtcaccagccgcaggtgatgcaggagaacggcgagatggggagcgtcgcctcctcgtctacggcgacggcagcacgcctcagggcgcgcttcaggctgctggcgcgctcctacgacacccgcctgtcgtccatgacccggagtctccagcccaacgatggctggaagacgtggccaacttggtcatgacggctcagcagcgcttgggtgctggtggacggtccgccaccaccaagacctccggcgccgctaccaccggctccgtgtcatcaaggcggagggcgcggcgagcggcggcggctgcacgtcattcggctgctactccctcgtctacgccttcgactcgggaggatcagcatggggagccggatgcccgcctcaacatcgagcgccggcgtaatagccggcgtaccccccgtgcaacggagggtgcctcctcgtccagagtgtcacctcgacatggacgtgaggaccagccctccgtgcccccggctggtggtgttggctgtagagcctttgtggcgagtcttcggaatgtccgttggcccccaaggttccggcccaccatcaccgagaagtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaag

SEQ ID NO: 20388 - DNA, 4391 bp, Oryza sativa
  unsure (1)..(4391): unsure at all n locations
nnnnnnnnnnnnnnnnnnnnnnnnnnnnnnnnnnnnnnnnnnnnnnnnnnnnnnnnagttgttgacggctgcagctaaccgccgccgccgtctgattcgccgacaagctgtgctgctgggcagcagctagcaaccgggatcagacactccctgaatcggattctccggaccagagtcagactcggattggcttctccggaccagcctcgaatcggacaacctgtagctgaatcgatcgcctacatacgtataccagtactactatatattttggtttacccccgtacgcacgtagagtcaattgatcaatatcgatcggcactatagcgagcgagagatcgatcgatcaagatgagtggatccgtgatgatgatgcagcggttggcgcgtcaagcggcagcacgcgtggtcacccagcatgccaggagcggcagcggcagtggcctcgcgggagcagttcgcggttacaacaacgtctcggcgtcgcacgcagctgctgctggtagtgccagtggttcagccaacaaacaggcggcaagggcgatggcgacgacggcatcgcggcagcggcaagtaacagaaacggtaatggcggcgtcgcagaataatgcagcaaggatacgcaagttagaggaggaggttatgttttacagatccttcgccgctttcctactcggtgcttacgtagcagccaaggtgatggaaaaagcgtaattatgtactactccatttgctattttttcgctcggtttcttcaattcgatttgctatcttaactgtacaagtgttaagatagggggtcaagggaccgactttaatttgtatagctacgctacagtacttgtggtaattagataatacgaaataatattaccccgtccattgtataaatccgtaatactaagacgacaggtaatctagcataagcatccataggctcgaaccgctccatccatttaattttcttgtagttgattgaagtggcattgctatgactgcatcaaatttgctccaccgttaaactataaaagatagctcatgaaactattgcatgagagccccctccttccatggccaaccccaccggccaagggggtatatctaccagggggacagcaagggttcaagccttctactaaagcaagaactatagaaacccccacaaagctcccactaatttattttgtcatacataaataagaagggaaagttgtagctctgtctagttcattcagatcccttgctatttattcctggatccattggctggccacacttcatgacagctgccactccagccccgtcatccacctctagcatcaactattgcttcagcctcgtcacccaatgtcacttgctccttacggcgccattaggctgtgttttgaggcgaaggttacgaactccaccaccccgcacatagaatagagcgatccattcgtatataattaattaaacattagcaaaaaaataatttgaaaatggattagatttcttttaaaaaatattgtttagaaatttagaaagcgtgcacacaggaaaaaagaggaagtataagttgaaaaaggtgagtgcccaattcagccttagtctaatttccatctagcgttcagccatggattccctttacctatgcgaggtggcaagagtctcccaactctggagcttccaaccagacctgttgaccaatctcatatgtccagtagtggttttgggttttgggttctttagacctatatcatctcgtcttgattcctagtaccgtctcgtaaagaagtcgaaggttctctatcatcctacctagcccaccatccatctctccccctccttaatcaagtgccactgcaacctatgttagtcatgtgctccgatccagctccaacatcgccgcctcctactgagcgcgcctcctttagtcactgcctctggcccctatctcactgcttggccatctcatccccacaccaacaacccatccctccatcggatctagaaactgtcatgacaaccaatccctcctgtcgagcacccgtgtgtgttgaccctcgccggtcctcggagtatgcatcctaaccacatccacttctaccagacagatttgtaatatttcgacgctttagaaattagaaattaggccttgattatttgaatcctaggcaaatcaatccacagcacaaggcataactctccatatagctccgcctacaaatcacctctaaataaagtaaaagaaaaggagtacatactctatggacttcactggagataactcatatgatacgtacctgttatctatatttttaaaagaagacgtcacaaggatcaatcgaggtcagggagcgtcttttttccttgttaatctgtggattcttgcacacgtacccttcatccttcgagttttggctatctcaagaagccgtagtgtactgcacgactcatctagtcatcttgtgtccgatattagttagcagaacacgagtgcacaacatcttaactaccacgcatccaaatttaaggagaaaaggtcgagtactcaggttaccatttatagggatgaaaacggtcggaaacgatcggaaaacagcctcaaccatttccgtaaccatatttttctcggaaatgaaatcggaaatggtaaattcggaaacgaaaacgatatcggaaatatcggaaaaccgaaaacggaacaatacggacggaaacatgtcggtacagatcggaaacaggtaacaaatacggatacattaactataaaaacatatatttaactttacataagtatgttatatgtatacataaattcaagcttatactatataaattataaattaacttcattttagccatgtacaaaagttagagatttgattgaagagtcagtcaatatgtaagctgcgggtcaagtatagacatgctctataaatatcgacatatttagaatatggtaattaccatattataagaaacggtaatttccacaagaatacggtaaatacggaaacgatcggtataacagcaaaaccatttctgttttcatttccatattttttaccattttcatttttgtttcggtcgattaccatttccatatggctcggccggtagaaagtcgaaaacgaacgcccacccctaaccatttatgaggtatacgaatcactgaatagaacaggtcttgcgtgatcctacgaggtgtccacatccaagcaaaaaggttctaaaatagggttattaccaaaataagtgttactgaaatttaatttggcattgccaacagaatttgccgaccatttcgtttcgctaccaagatttggtaatgcttgtggtcaagccttcttggtatatatggcttacgtatatatggctgcttcttcgttaattattatctccattaatcttagaatattatgaccagatattgttcaaatttaaaatttggcatgttcttttagcaataaatttataaatgcttaactgttcggctggatgaggctgataagccatagaaaaataaataaagtaattaaaaataatttgtaggtaaatttttatatttatattattatagcgatttaaaagctggacttggaaaatagactacaataatagaatcccaaaatcaattctaagattaatttttgaaaatttaaattttgatcatgacggataaactacgtacccaccggacaatgagtgtacagtttgtttcatcatacacaaatacaaccaagaaacttccgtctcataatctaaccatttaaaagttatttcttttcgaagttaaaacatcaaagtcaatgtggagaaatgtttggaaacaaatgaagtaacccaagtaatagtagcctacgcaaccttggcgactattgagcacttttctggtactagcagagtaagcacggttattttgccacaatatatattagataaatgtaaaaagcataatgttattaatatttgggtatggctcgtattgacaaacagaatagaataacccaatattaattagattgttacgaggcagcagtttttgtgcttctaaaattttaattattacattcatacgaaaatgcgaatatcaagcgaactttatgcgtcactaacccacgtccttctgattttacgtgagaggaccagtttctacccagtactactatctttatattttaatatatggtattattgactttttagatatcgataattcgttttgtttttaaaaatatttaattggtatttattttgttgtgactttgatatatcaccgagactccgtgcaccgctatatatatggggcttcgtcgtccgcgcgctccgtgtccgcgcgttggtacaccgcagtacgtctcgtgggcacgcagcggcgtgtaccacccctgcaagtgcgcggcggc

SEQ ID NO: 20389 - DNA, 1017 bp, Oryza sativa
tgctagctgccggccggtgcgcgctcgggccggcttgttgaatcatgcaagagtggtggcgcctgctcgatctgctgctgcttgattggctcggttagtttctgctgtatggatcgggcgatcgatacagcagaaaaccatctacaaatagctaggaagaaactccttttgacgcattatcctctcacatgagttactgatatgttggccaccagtagtgggttcacatatcagtaactcaaaatcagataatagtaagttagaggatttgtttctcttacccttcctctattttattgttgctgctatttccatcaagtcaattggggctattagaccactgcaaactgatatgagaatatcttcctctgtatctcgtctcctactctcggttcgcagtccgttagagctcgtagtttgatctaatcgcaagccacaattactagtacatctttttttttcaagtttagaaaaaagaacaagtttaaattgaagttcgtcaagtgaatttaaatttcaaatttaatttatgaatcctatgataagaatctgaggttttaatgcctgaatcattaaaattcttagaattaaattgattttttaatcatgaaacccaaaattgaaacataaatcccgaagttcagatttttaaaatctagctgatagtcaaggacctcatcatatttcatatatatctacctgataataataatctaattaggagaacaaataaatgcccaaacatgaataaccataatggaaaaacagacagttaaaacagagggacgacgacgacgacgacgcgagcaacgacgtgacgccaacccaaactcagctcggtaatcaaccacgatcgagtagcttgcattcgcctcgccggcggcgacgtcgccgccggctagacaccgccgcagcggtaggtgatcttgcacgtccttccgaccctcaccacgtacgtgtgctgcggcttcaccaggaatggcggcagccgcatcagcgcgtcgcacacgcagtcct

SEQ ID NO: 20390 - DNA, 5345 bp, Oryza sativa
  unsure (1)..(5345): unsure at all n locations
nnnnnnnnnnnnnnnnnnnnnnnnnnnnnnnnnnnnnnnnnnnnnnnnnnnnnnnnnnnnnnntctaatgccacttaagcatcacgtcaacgccacgtgtaaagaagacccggtcaataccgccacgtaagtgccacatcagcaaaaccgccctccaaaaccgcctagagagttaaattgcaccggtttcaatagttcggggtcgagttatccggttttgcggtttagggttatggattagattcgggtcacttttaaagggtcaaagtgaacttattccgttttccaccatgtaattgatattggaaaaagtccatttagactcccttaattgttcaccgaatttaattcgtgacccttaactggaaaaccagataggatgactcctcgaattattggaaccagtgcaatttgactccttcagtggttttgaagggcggttttgcggacgtggcgctgacgtggcgataccaacccggtcttcattctacgtggcgctgacgtggcgatactaacccggtcttcattccgcgtggcgcctacatggcactagaattaaaatatatccgtggaacccatctatcattcacacataaaatatatcatgggacccaccgacatatggggccacatatcatcctttctccttcccttcttcctcctcgctccctccttctctctcttttctctccccttttctcttccccctcttcccccttgggacgcatcggcggcagcggcggccgggtggagtggcgatggatctgggcagcatggccgcggcccctcttctgggcgtcgatttcctcgccttgagtgataattaatactcccactagctgctactactacatcgctagcttagctaatgacgtcaccgagcaaccaagaacactaaattaaccaactaaacacaagctaattaagctagtgtcgtcgtcatgttgcctagctagctagctagctagctaattactacttcggtgagtggatggcgccatgccgccatggcggcgtggcagcagcacgtgtccatgtcagcgtcgtcgtcgctggtgacgagcgtgagcaactcgcgcaggggagtcccgaccgtggtggtggccttccagagggtgtcggcgacggcgatgtcggcggcggagtgcaccggggcgatggcggcgccgtcgttgctggaagggagattcgggctgggcgggagctcgcgccggcggtcgagcctgaacgcgtttgacatcatctccttttctccggcaactccaacgcggcggccgaaggtggagctttaccgccgggcaagccgcacccgacacccgaacttcccaccgccgcggtctcctcgctacagaatacgcgacagcagcgaccgcggcgactgcaagctctcgatgccgccgcagcgctgctccgccctaccttcatgccggccttctccacccaccgccgcccacggcttcgcacactcccttgccactctccgctccgccatccgttgcctcggcaagctctccgcgctgctcgccgacgggaagagaaagagagagataagggagagagagggggaggaagaaaggttgggaagagaatgacatgtggactccacatattagtggatcctattataatttttgtgaataataaatgggtcccacatatatatttttaattataatcttacatcagcgtcacgtgggacgaagaccaagttaacactgccacatcagcgccacgtcagcaaaaccgcccttcaaaaccattgagggagtgaatttgtaccggttttagtaattgggggagtcgttctaaccggttttctggttgaggggtacgaattagattcgttgtacatttaagggagtcaaagtggactttttccattgatattcatagctcaagctataatgggctggcccaggtcgtggcccaattttgggtccgcccttgatgaatgatgatcaaggccggctccaattatggatccgccccctatgaaaactagaatagagaactttgtaaaataaatctatatttgttattctaatggctttaaactaaatatttttaaagttattgatagttgaagttataaaagtttgacaacaataatatccaaaacaccaagaattatgaaaccagggcggaggtagtaatcagcaacagcatcataatcacctaaataccgagctcatgtgcaactacttaacacggtggcacgatagtatcaagggagtatattttgccacaatataattgataaagtgtggcatgccacatattgtatggttatgaatgtgttagccacaattgtggtaaaaaaaatcattcaatgacaagaggactagtcttagttgatcaaacttttttgccacaagtttggctaaggttgacactaaaccaaacaggccaattcagtcattcagtgcacatctatgttggaaacactgtaaattcatcagccaagcttttgcattcataatgtccaaaactggttataaaccgtaactgttttattagcaattagaaaataatttatctaaaacttctatatgtgttcttaacaacttagaaatcaatgtaaaatgctatgttaaaaatatcttaaaaatcaacttcaaaattaggttttaaattttaaaatttggctttgctttagctttttagtgtaaccaatggggctggcgactcatttcaaactaaattcgcaacaaataatccatggctgatgtgagacaatatgtgaatagcctaacctttttgacaaagtacattacagcacaatttctagtgcaaatatggtaaaatttatctcgcaaaccattagcttctaaatatttacacaaacgcaggcgctgaaaaaagctaatgatgtgctccaggaacacaagcatgccttgttctgcagctatgccaggtgatatttacacaacaaaagaactgcggcaaaatgatttgtatttatttgtttatgtacgatgagaccaaacagtttcagtaaatcatttggggtagttgttgtcagaggggtaggagggtttcatgaatggacatgaacaatgagattctccgaagagaaatacaacattgttaggctaacaatacaacctatggctaaagattgatgcattgacagcctctattcctacaatacattgatctgccttccgcttctgcaatcctactatgctaagatacatatttacaaggaggaaggcaggtacttatctccctcctttttggtgggtcttcatgtgaaggaaccaaaccgatgaatcagaaagcatcaacgaaagcatctcgaagtgcccagctgacaaaagcatcgaccctgaaaagcagcatgtcagatgaatcagagaagaagataattgtggcatatggtggtaacaagaggaacggaacaaatggcgtaccattcacggatagcaaaaatgttatcttggtctccagctaccatgtgctgcgataaaagatgatgaattagtatcctgtaatctgatgcgacctgaagttactttctttggaacagcttgtgttattcttacacgtattatgccaagcatttcgtacagtacaaccaaaatatgtcatgaacttggacgaaatattgattaggactagtgtaggtaatattagaaaggaaacaaaatggtcccaagactttggtcacaacattaacaatgttattcctctctttcaagcttcccctcatgactttacagtttacactctagttctacagttaaggttgaaaagtttctaccatataaatgctccttacaggacaaatgcttatgaaactggattctttggacaaaccaatatctagtggtaagaggcaaatcaatgcaagttacattatgaagcaggacgaaagagcatgtaacatacctcctacatgtggaactggaggctccatagaatgtctggagggagaataattcgatgaccgaggaggcatagaccacccagagcaaggacctggtggaggatctgatggtcgtccgtagtgcactggtgctgctgacgatgcttcaaaatggtctggaccaggaggccctggacaataatcaagaacaaagaacatttagtctgctgtttttgagggtcctacagcatgggatagattaacttaattgggtaatcatatatctataaagttcatccccactaagtgtaattaatgctaattctctcttctctcatgaagccacatcacctcaattgtttttagcttttggatgattcatcaagggtttaaattgcatctcttccccccaaaaggcacactatacaacccaatcatttataacctatggataattgataaaggtaaaaaatacataaacatataaaaaaaatcgtatagtaggtactccctctgtccaaaaaaagacaaacctagggtttccgtgtccaacgtttgactgtccgtcttatatgaattttttttataattagtcttttcgttgttgttagatgataaaacatgattaatactttatgcgtgacttgtctttttaatttttttcatatttttttcaaataagacagacggtcaaacgttggatacagaaacccaggggttgtctttttttgggacggagggaggtagaatgaaaattttagaactcatatctactatattatcacacaattctcccgcagcaacgcgtgagtacccatctagttgtcaataacaattcatggttggtgttttagggtgacctacaggatgaaaactgtgccaggaaaaaagcgacaatgattcacgaaaaaagtacctggaggaaaaggaaatctgcccctgtcagcaacttcgtggtgcattggtcccctaatagctctctcatcaaaggaacgtcctctgtcatcaaaatggtgtcctctatcatcaaaataatgtcctctatcatcatagtgatatcctctatcatcatagtggtatcctctatcatcaaagtgatgtcgtctatcatgcccatgatgtcttctatcatgcctgtgatgatctcgatcatgtccatcataccgatatctctcaggataggatgaactattattactccaaggccgtggtctttgctgaggttctggtggtcgataggggcattggtttataggaggtggagggggtggtggttgcatatgatatccttcgttaggtaccgatgccattgggggttgatgatagttattcccatgatatggtgcaggaggtgcaggaaaattgccatggggtccaggcggattaagtggtgcaattgggggcggcggtggcatctgatttggatgccccccatatnnnnnnnnnnnnnnnnnnnnnnnnnnnnnnnnnnnnnnnn

SEQ ID NO: 20391 - DNA, 7502 bp, Oryza sativa
  unsure (1)..(7502): unsure at all n locations
tcccatgatatggtgcaggaggtgcaggaaaattgccatggggtccaggcggattaagtggtgcaattgggggcggcggtggcatctgatttggatgccccccatatcctgaattacagaatggtggaggctgcaattgcgctacagaaggattcatactgcctgggcgttccacaacagaatttggctgttgcgtctgaatattctgcaaagaaaatgaatcattagtttctaaaataaaaatgcataaattccttcttgcacagaaagcaaatatgagcatacattggtagctctgtaggatgcggaccaactggatcagatgccattggtaatgttcgctgcaactgtccagtctgagtaattggagcaggtggtggtggcggaacaggtggaggagatgatggcaatggcgggggcgatggaggcctatcatcagggaggggaggacctaaagtatgtcgatcagatgttctgcatttggtatcaatttgttctggccgacatctggtgctagcttcaacttcagatggtggagctacatcctccatctcaagctcgccatcaacttcttcaaggatgcgatgatgcttttctgcgggcatttgtgattcttccttctcatcagtgcaaggagcatcatgttcaggtgtaacagcttcaaaacttctatcttcagaggagcttccgtcctcatcttcaagtacttttgtggaaattaagtttggtagttgaaaaccagcattgctgcggaaaacaatggaacatacaaacatagggaaagaactggatgagatacatctatataattgaatatgtagaacatggagctatgaagtaatgaggacatattcatgcactgcatgcattaatgcatatcttgttttatttaaaatagctttgtctcacagataatatgaaaaaggacgcccactaaaattcacccccaatatttcaggaatgactcctttttctagttatttattcatggtgagttttatccaatattagctaattggatgttagcatcattcatatatcatagaacactgcttaactgaccaacaagactacctgaagaatacccatgctctaagaaaattactcaaaattgcagtgttccatcaaatctaccgtggctttgcctgcttctctacacttcgacacgtgatcccattttgtctgcacaattcatctagctatcgtttatgaacattacaatattatatgcatgccacactacttttcatacatcagtttgacaagcatacctgccatactcatcaacaagcattccttcgttgtcacgcaacgggtcatttaaagctctttctgtccttgaaggacggcgagaacttccaaaagatgcctcattgataacctcaagttctctaatatggtggcgaatgatgtactctgggagtgttttcctctcaaaccaaagcttcaaaacctgaagataaaatcacaaagtttttaagaggagaaaaggagaattgcacatgacaccagttctatcaaactgctgaaggtgcctgcctttagacattgccttcgattctcccatgccgaatttccaggaggtgcagcagcataaagtaatcgaggtagaactgcctggataagagacgggtaaacatctccagctccacctgcaaatttcttacagaatttaaaaaaatagagtgcaagcgaaatagacagaaaaagatcatgaaagctatatgttacctttctggttacgagagtattgagttattgaatccacaagaaagaaaaggtccactctcttatataaattcgactccttctccaagcgttcaacgataatatcaatcgcctaaataagaaaaaaaaatcaggaaaattgatatttggcaattggttgcatagaaaggtatgtaccctctttttattggtaatctaaaagcaccatgcatgtgtctgtagatgagatttcataatctaaaagaacatagaagtggtaaacaaagcaacatctaccagaattatcacaggttatttcgaagtccataagttgctgagatatgttgtcatatcacatcaaaagcatgtagcaactacgtattataagagatggtacacttcaatggtaaataagattgatccttgagaagcaacaataagttccagatgcctgatgatccatcacaaaaaagatggtagttggcacttggcacagagaacatagcactgtaattactaattagcctaggcaaatcaagaatctaacttccccgtccaccaacaaaacaaagaaagcaacaatgtttgctacatctataagcaagtaaatgatgatactacttaagaaagacacagtaaatgcatgataaatgaggatcacgtgccaaatagaaaactaggagtgacatgcatggacgcatggtctaacctctccagcaacgccatgtttggcacactcaattgcaagacgtgttgcacgcgctatattttcttttgttcttgtcagtgtaccaagaaaagatccaaaagcctttcgtgctgcattagcctcatcatgtcctgttaatttgctcaagttcttctgttgctgactatcaaaaggactcctagaatgaatattatcatttgtagatgtggatctgattatccggttcaaaggtgacaattgcttctgtgatccttccttgaaagcaggtgtatcaactacagtttcaggaatatacttggcattcagaaagttatctggaaaagaagttgatcgagagaaccttctagcttgtgcaacagcaataagttctttcataggcattgaatctggagaagtgctcttatcctttaggtttctatggttcagttcttttaatgccaagctgagaaggtgtgcctgcaatacaacaataagtattgtcatgccttttcagaagaccatcttaaatcaactaatcaagtatcaaatttataaagtactaatccagagttgttataggagtaatccaaaggtacaatataaaccaaaaaagttgctattccaggcattctacatgaataggtcataagttcatcagactgtacgttgcaaaataagcattcctgctaagaaggttcaaaaggtgtagagctcaatgtatagatttcagacatgaaccataagaatgatgtttccattgggacctaaatattgctctccagtctccactggctagtaatgtcaggctccaaaaataggctctatagttaaagccaaaatagagcagacaaataaattagggacgtatggaggtagaaaacagtcccgattaattctccttaataaaggattgtgaaggaactgaaatatcccacaaaacatatattaggatccacaagcccataacatggaaagatttagaatctatatgatataactaaagacgttataatcagaatatttgaaaacccaagtatccagctcataaagcaacaaatctacacaagacaggagcattagaataataagatccttgttgatgagtaaaacaagataaccattcatgccatttatccagattccagagtgaatcaatttgcccaccttttttgttcagtcaactagattatgaagtgttacctatgtttaagacatacattgacccattattgagtctccaaagaaatgcattttgatggatgaaaacatcaggttgacattacaaggaaaagaatttcgtaggaaaagaaaaatcaaattgcatggatgcttcttcttcacaactttctgaagtttcaatcagaaaatgccagcataaatttggaaaagaagcatgcatgtcctaaatttgtcacaaaaaggttatgaacaagaagatatggagcatataatgataaacaaatatctcatgcagacataatggaagatacaatttggcatgaaagcttacacttcaaatgtccgggtgtctgcatcagattgtatactggaagatttagtggccagcgaagaggtgcttgctgtatcagccacattgactactgtttcagctacaacagtttcattatgcagtacagaatcactgatcgcattattgttagaagaaagcaactttggtcggtaaattggctcatcacatctttgaacacttctgtcagtatcatatgcaggacggtcaactggttttgggccttcattgaagttgattggtttggcaacctcgctaacactagctgtccccaaagatgaagataaacgatcaggtacagctacagtctgtgtaccaccaagagcagactcattcagcttcattgaaagagccaagcctttcccgcagtcgtcattgccaacttcactagagaccaacaagcaatcagtagttttgctatcaacgtgagtttcttcacaaatattgccttctgtaacatgactgtcatcttttgcttctgaaggaactgaagcagaagcaggaacactgttattttgcagaattgattctgaggagtgtgttttgcactttgggctatgcatggattctgtgcacaaagatggcctagggctttctgctattgcagatccgttagtggctgtgactactgcatctgcagatttattagagtggctgttttctgaagccacaaaaccatttggaatcaattgctttgaccctgtcacttcaggcagattattagtttcagcaacattagcggacatagcttctaaggcacgatgaagacgttttgatggaggcaaagcagcttcaacatccaatgttaaaacctttggttgatattctttgttcttccaagcagactgaccttcacctgaggggccaggcatgtataacttggatgattgatttgaaacagtatttgcaactcttcctgtcaaggaaacactatttaccactgctgactgatcgactgaacaatcatcaccaggtagtgcaactgtgttatgcatattacataggtctgcaagcatagcaagctctggtctgttattagtaacatcaatcccatcaactggtgagtcttccaactgaggccttcccattcgaacccttgcccttttgaccaatggcaagtgctcatctccatctgacttatttacttcagtctttggatttggagaatctgccgttttttcacttaactcagcctgaaattcatcatccttatccgtagaatgagaaaaaatatttctacttggctttctctttctcttgaaaataactgattttttcatgggaatgcttgatgcatcatgcgatttaaattgtgtctctaaagccccattttgagatgtttcactgtcgcaggtactatctaccttagtggtataattcagctttttattgttgttactggtgccaggtgtgccaggttgattgtcgatgcccgcacttgaatgcaaccaaacatcatcctgtgttgaaggggaacctgagttaccttttacatcctcaacatacacatgatgactggaaccttccttagtaccatcagcagccaaatcaactgaagccaaacaggttccacctgaaagcttgccagaatcctgagcttttcttgtgtcagtgttcagtgaacttcttgacctccgcagtgatgaaaccctactccgtgtgtagcaattttgaggctgtgcatcccttagcttctttgaaattgaactcgtagacaaagggatgtttctcatttcatcaaggatagacacattttcagtagggtcatcaggagcagaatttacaacacatcgctcacttccaactgcggtaacagaaggctcatcagaatcggccgtattatgaccacttgcaactatggaatggtcttcttgctttttatcactacccatattagagctactcactagaccctccgtatccaagctgctgttattattagcaagtttttctacacctggtttcacttcattggcaaccaaaccgagcttattattaccttccttcaaagaatcataaacatcgattatctcatcaactgccctcaaaaaatcagatccttttccctgtcgcttagcaagtagagacctccgtttctcttcagtgaatgcttcaagatctgcatagttgcagaaagcactacaataaaaagaacaggaagtcagatgtaagtgcgtagggttataggtaagaaaatcagtataacacattgaaattcatgcacagctaatggtggaccagggaaaaaacacagatgcttccatgtcttctctagaagttcctaattgtagcttttaactattagaccataaacaaattaaaaataaaaactgaaatttcacactttttattggaacaacacacaggccaccaatagtgattagtgagttttagttagtccatagcccatacattgagaaatacatcgcgcaaacccaaaaggaacacaaccacaatgggtcatcgaggatcaaagcgagatagtgatacattcacagatcaagtgtcaaaaagcaaatctttacatgtctaagatgttttcatttcctagtcctaaacagcaccacgatatcatggttcattccttcaaaactcattataaacaaagtagcagatttcatagattatttcatagttcatcgaccctgaggagcatttatgcccttggcatatacataatacattgacaacagtgtactactagtccaaatgacagctttaaccaaacctatcgatggttcaactttcttaactatcagagaaatatttaaagccaactaatcaaaattttctcaacgcttgatagtacaactaatttggggggaaatggttatatgtccccacaaatgatatgtgcaatctttgcgggatgtcagaatttcaatggttactctcattgagaagaggatggcacaaaggatggggcaattttccggttttcttcattcacaaactcaaagccatacctatccgagggaggttggatacatatatatagccatagctggctgcaagcctattgctgcaccctcctagtctaaaattcgaaatttgaatgggatgatgtcctagagggcatccaaactgaataaagcataaaggaggcataaagaagatgctaactgctgctgtcctgctaaccgcagctgtcctagcaactgaaaatatgctaaaggagcagatgctgtcctgaaaaggtgaacttacctaaaagaaaaggaagaccacgaccaaggaccacaaagacttatccatcattttcccctaagtcttgtgcgtcgttctgttggggaagttggccaatcccgatcttgagcaagagttgaaggaatttgatcttcccaaaaggtttggtaagcaggtcggcaagttggtcttgggggttaaggtagttgggtgaaggttcctttcttccaagtagcctcggatgaaggggtccttcaccggaaggggctggctcggttggtgaaaaccagggttttttgcaatggcaagggggcccttcctatccaacctgagctnnnnnnnnnnnnnnnnnnnnnnnnnnnnnnnnnnnnnnnnnnnnnnnnnnnnnnnnnn

SEQ ID NO: 20392 - DNA, 4122 bp, Oryza sativa
  unsure (1)..(4122): unsure at all n locations
ggaggccgccatgtactcggcttcgcagctggacagggccaccacctgctgcttgaccgactgccagctaacgaggcactcgccgaggaagaagataatcccgctcgtggagaaccacgaccaaggaccacaaagacttatccatcaccgagggcgtggaatgccaagttggattccacgctcaagtggatgggcttcgagcaaagcccgcacgaggcggccatctaccggcggggcaatggagaaaatgccttgctggtaggtgtctacgtcgacgactttgtgatcaccggcaccaaggatgcggaggtcgcggcgttcaaggaggagatgaaggccaccttccagatgagtgatctatggcctctctttctacctggggattgtggtgcaccaggacgactccgggatcacgcttcgacagaccgcctacgccaagcgcgtcgttgagctggctgggctcaccgattgcaacccagctctcactccgatggaggagagactgaagctgagccgcgatagcacgacggaggaagtggatgctacacaatactggcgtcttgtggggagcctgctacctcacccacacacggctggacttggccttctccgtcggctacgtcaatcggttcatgcagcgaccgacgacggagcaccagcaggctgtgaacaggatcattcgctatgttgcggggactctcgaccacggtctctactacccgaggtgtcctagcaaggcacacttcgtgggtacagcgaccacgctggcgacatcgacaccagcaagagcacaagcgggattctcttcttccacggcgagtgcctcgttagctggcagtcggtcaagcagcaggtggtggccctatccagccgcgaggccgagtacatggcggcctccgccgctttgacccaggcgctctggcttgctcgactgcttagtgatctcctcggcagagacactggagcggtggagctcagggtggatagcaagtcccccctggccatggcaaaaaaccctgtttttcacgaacggagcaaccacatccgggtgaggtaccccacttcatccgagggcttacttggaagggagcatcaaggcgagctacataacaccaaggaccagcttgcggacttgctcaccaagcctcttgggaggatcaagttcctcgagctctactccaggatcgggatggcccaacttccccacaagacgacgccaagacttagggggagaatgatggataagtctttgtggtccttggtcgtggttcttccttttcttttgagtagtttcaccttttcaggacagcatctacttctttagcatattttcagttgctaggacagctgcggttagtaggacagcagcagttagcatcttctntatacctcctttatgctttattcaatttggatgccctctaggacagcatcccattcaaatttcgaattttagactaggagagtgcagcgataggcttgcagccagctatggctatatatatatgtatccaacctctctcgggtaggtatggctttgagtttgtgaatgaagaaaactggaaaattgccccatcctgagtgccatcctcttctcaatgagagtaaccattgaaattctaacactcggtgcctgccgcaagctgtagagagccttgtgcaagcgtagcaccttgcattccttgccggggatcacaaatcccggcggctggtgcacgtagacctcctcaagtcgccgttcagaaacaccgacttgacgtccatgtgatggacgccccagccttcctgagcagccagcgcaaggagtcgcacggactccatccgtgccacgggagcgaaggcatcgtcatagtcgatcccctcctgctgcacgaaaccgcgtgccaccaagcgagccttttgcttgacgatggctccggcttcatcctcttcagcttgaacacccacttaagggtgatcgcacggtgaccacgagggaggtcagcaagctcccaggtgcggttctcctgaaccgcgtccatctccgacggcatcgcggcacgccatgccgcgtgtttctcggcctctgcgaaagaccgaggctcaccgtcgtcgcacgcaaggtgcaactgcgcctccaggtcgcgaggcaccagtcccggcaccggctggtcgccgagaagatcctccatcgtacggcaccgtagctgctcgccgtcgtggtacgcatcgatgcactccccgtcgtgggagagcggagtagcgaactccaccgggctgcactcaacacgagctggcgtcggagtagacgtgcccggaggagtggctgttggtgctggagcgcgtggtgtcgccggctgtggtggtgtcggcgaagagctcgtcgtagtcgaagtcgtggcccgagggtgtgttagtgtcggagttcggtggaggctcgggaactggggtagacacgctcggtgaagaagagctgcctgctcccctagctccctcgaagtggacgtactcgacggtgaagtcgtcgtacgtcggagtcgaaccatcgtccactgccttgtcccatacccaccctcgcccttcgtagaacactacgtcgcgcgctgtgcgcacacgctatctccgggtcgaggatgcggtaggccttcgagccctccgcgtagccgatgaacacccctggggtgctcctgtcgtcgagcttgccgatgtggccaagctccttgacgaacacgaggcagccgaagatccgtaggtgggagactgccagcttgcgcccatgccaagcctcgtatagtgtcctgccatcaagggccttagtaggcaagcggttgaggatgtagacggccgtcaccaccgcctctccccagaagatggccggcatccctctctgcttgagagcccgagccatccccacaaccatctggttgcgccactcgacgacgccgttctgctgcgggctgtacagcacagtgtagtggcgctgaatgccctcatcagcgcagtacaacgcgaattcagcggcgggaattccccgccgacgtcgggcgtagcacgcgcagcttgcagccgcactccacctctgcagcagcctgtgcgcgcctgatggcgtctgcagcctctcccttgctgccgaggaccatcacccacatgtagcgggagaggtcgtcgacaagcagcaggaagtaacgtcgtcctcctggtgtggccggtgtcactgggccacacaagtccccgtgcacgagctcgagccgctccttggctcggaaactcgtctgctggggaaaggggagccgcctctgcttcgttaggacgcagacgtcgcagagctgctccacgtggtcaaggcacggcaggcctcgcaccatctccttggcgctgagccgcttcagggcctcaaagtggaggtgcccgaaacgctcgtgcctctgccacgcctcgtcccgacgagcggcgaggcaaactggttgtgcgacctgcgcactgaggatgtagagtcgattagtgcctctggttaccaagaaggtgacggcggcgatcccaaatcctcatgactccgtgctcgaccaacacgcgtgagccgttctcatccagctgccccacgctgatgatagagttcctcaacacggggatgtagtagactccggtgagcagcctgtgctcaccggacttggcggtgaaggtgacggagccgacgcccttgatctccacgcgggaggcgtccctaaacttgacggagcctcggacgctagggtcaagctcggtgaagaactcccgtcggccggtcatgtgatgggtggagccggtgtcgaggtaccacccatcacccttgtcgttgctggagccgttgcagagggagacgagtaccttcggctcatcaaggtggaggaaagcctctgcggccggtgccgctggaggtagctcgatgcttgcgtgtgccaggagcagagccggctcttcctccacctgtgcgacgtggacctggccacgtcgtggctgtcaagagtctttggcccaatggccaagcttgccacagttgcggcaggtgtcgtctcgtgtcggcttgtggttgccggcggcggcgccctgggcacctctgcgagcaccaccctcggcgcgtcttcgcgggcaccgcagctggacacc

SEQ ID NO: 20393 - DNA, 10546 bp, Oryza sativa
  unsure (1)..(10546): unsure at all n locations
actgcaccatcttctgcaaaagagtgttgagacggagggcaaagtcatcaacatcctcacctggcttgaagaccaggttctcccactccttgcggagtgcctgcagtgtggacttgcgggcgcgggcgctgccgatgcgtgccgcatcgatggcgtcctaggcctccttggcagtccgcttctaggaaagcgagaaccgcatctcgggagggactgcggtgatgagggcatccagtgcccgccgatcttcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtttggacaccgtggtagccatagcgcccgtcaagggagggagagtcgcactgactgcgatggccgcgctcttcgttgaaccagccaccttcaccgggagcgccggcgacacgcgcgcgctccgggctgtcgacggcactcccgcgcccatctgggttcccgtcgacaggcgcgcagtcccttgggccaacggcgccgacgtgggggtggtctggtggccaacgatctggccgctcacgagcccttgctcttgccagatgctcaagctccctgtcggaggtgatgtcgctggcaatggagccgttgatgctgctgcgcaaagtctcaacctntaccttcgtcagacgtgccacatattacagcgactctgagttcgactccaccctggatgttggcaacttctgtaccggcagtgtggaacgcccttctgctgatgctacggtctgagccgttgctcgcctgcgcttttctgttgcggcgagctcggtgtcttgctgacgccgagtgctcgatgcgaccgaacgcacgagaccgaacgtccgacatggcgcgcctccggggggctgctgcgttgagaggggaaagggaaaggggaaggagtagccggtgctgctcctgctggctgagagctcaaccgagcttggggaggggtggaacaagagatgtttagcctacaggaaagtgtggctctgataccagatgttagaatttcaatgattactctcattgagaagaggatggcactcaggatgggggcaattttccggttttcttcattcacaaactcaaagccatacctacccgagggaggttggatacatatatatagccatagctggctgcaagcctattgttgcaccctcctcgtctaaaattcgaaatttgaatgggatgttgtcctagagggcatccaaactgaataaagcataaaggaggcataaaggagatgctaactgctgttgtcctactaaccgcagctgtcctagcaactgaaaatatgctaaaggagtagatgctgtcctgaaaaggtgaaactacccaaaagaaaaggaagaaccacgaccaaggaccacaaagacttatccatcacgggaagcatatagctgaatccccatttttaagagataaacagcaattttcagaactcaatcagttcaactagattaacagttttacatgtaagaattcagcattcacaaagttttgctagcccatgattattgtttttcagataataaaatacatgcataagaatttctgacacaaaatgctatggatttgacataggatagggaagactgggggatagggcaccccgctctctacgagggccagaagagcttctccccatcatgatagaggctatgaggaatactgaattaaactttgtagattcattgcttatttcataatggattgcatgggcccttttatagggaggatgtcagtgctacataaaccataaattgtcactcgggaatgcttcctagtaaaccatatatttaacttccctaactaacagtgaggatatgtcataggtaggggccgaggggtcgaggcccatgggcccaacccctggcgagtgaacagtacccgcggtactgtagcagtaggttgggtgataggataggattaagaaatagataaatctagattagatcaagttagttacctaggggttaagtttctccatctatataaggatgggactatatcgttattctaattaagcaatgaatcaagattagtctcccctaacctaagtccccctctcatccctagcagccgtcaccgcccggctatcctcccagtggtgtttatcacctatgaaccataacccataataggataacaataaactaattcatatgcactaatcccaatgtaacacaaactaacaagattgatggccttaaagtaacgaagtatttaagcaagttacagtactgaaataaaaagcaataagcaatgctactaggtggacataactatcatcctgtatatatgtgagcaagtgtccaacctaaggaatattccaattagactacaaagatttgagtcagtgatatcaaacttcaaacctcccttaattattacatttctcatgttcctagaatgcaaatgagagaaccaaaaaaaagcttgcatgcaaattacagcaaagagagagatagagagagagacagacacacacacacacacatagagacagagagagagagagagagagagtcaggtgttaatccatgccaactgttccaaacgaaaagagtcagcagcagaggctcaaagggcggtggtggctggcactatggtttgagagataagcgtgcagtgatgtgcagtagccctggcggtgggaagtggtggacagctggatattgggctgcctcttttcctttatttttttctctcttgcatttataaatagcaccataatttattcaacgaccaaggctcattggcacggatttatttgggttgcctccggtatcccaggctatcatcacaaagaatactactctagtttgacccaaagttttagccacccataacccaaatccctcaaacccattcctcaacccaggttcctggtgctggtggctttgatctatctgctctgcgaactgtagttgcgcaataatctatttaactcacgagatatgcaaagagaagtgcaatattgatagtcccccaaaaacacgaaagttacaaatacaaacatcatgtctagtcccatttcacaatcatgcatataaaatgtaaataacccgataaaacaggaactttcttataaaaagaagtatactgacctactaataataacaaagtaggatatctctacacagatgtagggtagatagcacatataaagtcacatggttctatcaaattagaacttacatctgtttagttccatagaagtacaccagtatcttctttttaacagacgtctggccccactgctctggctcacttatctgcaacattatacaaattcatgggatattaagatgatttcttagtatgtaatctccatgttcattcaaactgatgtgcaagacttaaaataggcactaacaagcctataatagagcagttccacacttccacaggagttatcctttaaccaaaagtaaaccattgtgtggtgacacagcaaaagatcagatcaatacaataaatactatatgcaaagacttgcacggatgttgatgtgattgtcctaagttacatctaattcagaacttagcagcaaagaatgccagatatgatgtgaaacgcaatgttccttgctaatccttgtcctttttttaaaaatgaatccttgttcttttgttgtaatgaaaggacaaatacatcactaaacactgcactgctattcaatacatgtatgtagcctagcccttcataggcctaaacctaataacaaatttagaatttgcaccatgtatatatcgcgcttaaccctaccaatcctggaagaattaattaagcaaaacctacaacaaaagaatcttttaaaaaatagccaaatgttgaaaaggatcgtggctcaaaataaaatcaatcagtgatagatcaaacgaggagaataggagagtaaaggtctactaaatcaaatgctatctgcacatttacgcatcttacaaagtgtatagaatattgctcccattttgcatattagaaaggtcagccttaagtcctcaagcatactaaaccacctcccaatatgagaaaagggtagtctgttcatgccagcctacctgtgtatggtccaaactaaaatcaaattcaacatgcaaggaaatatgtagtgttgtttccctttgctgatgtgcacacaaactaagaaaagcaaacagatagcctatcattttggtttctggtgttcaggcactatgtaagaaaagttagataacaattttaagagaagaaagagtacgattatgattaagtagtgcttttcctaaatagtaaaaggaaacatctcttcattcccaatgaaataatcagaaaatcctcattgaaacttaccgaaggtaactaactattaactcgatgacaaataattaagaataaaagatagaatcacatctgtaaccaacgaatagagtgcaggtaacatgatatcaccctgttcatcctaatcccaagaccatccatgccctaaatcgccggcaacgtcaaatctcagcaataaagcagcagctaaacctagaaattaacaggaaccggggcgaactagatcatatttacagtacaaattatcagttaatctgaagagctcagcaggaagtggcacgaagaaggcttgtttcggtcgaagatccaatctttcttaagtacatgtacctgaaacccccacatacaccaaatcgcagtgacaagcatccgcaaaaccacgaagctagcacggattaacagctaaaatagccgaatcggggtagggagaccatccaagaacctaagatttatcaagaatggacatgccgcgtcccaaaacctggcctcgcacgcccccaaacgaaaccctaacctgctactccccagaatcccctaaccccaaggcaccccccctaagcaaagtatacggccatagatcagagagaagaagagcaagcagccgcgaagcatgctagcctaagaactcaccatggccggccacgccgggaagcccttcatcttagcgagcacgaggtcccccaccttccactgcgccgcggccgcgccgccgccgccgccgccgccgcagcagcagcagcagcagccgcgcgcttcttcctcgccggcgccatatccgccaccacccaaccgtctccaccacaccccccgccgcccaaaccaccggcgatcagcaacccacggggggaggaggaggcgcgcccccaccaccaacgacgacggctaagctaccgccctacgccgccccgcgaggcggccgcgccacaagaggcagcggcgggggcacccggntgncgnncctcctctnctnctnctttnctngggcttcgcggcggccattgcggccgccgcatgggagggggagggctgtggcttcgacttggggatttttttttccacttttgtttttctttttttcctccgagttttattcgtgggctttttttttctttctcttggctgctctctctctgcgaagaagagaagagaagggaggagaagagggagggtggggtggcgcagcgtgtgaggtgggtgggtgggtagttcggcggaagaggaagagggagagcgtgggaagggtgaagtgggggtgggggagtggcggtgcgcgtgacgaagaggaagaaagggggttatgtggatggagtggcttgccgccgcttgccatctgcctctgcctgccatttcccattatttcctttttttctcataaaaaattgctgttcttgttaggaggataatagtatctatttgttttgttgcatgtaagtaaattttgcttaaaattcacttaaatttttatacatgcagtatttgtttactatataaattttgttcgtgtagctatttgaaatatcaatatgcgtgctgtccaaatgcactacttggcttatgagcctagttcctcgaggaaatatgggttgttgggttatgtgggatctagagcatatggcacgagtagaaaatgtggagagagattatcatgctcgttagatgtaaacttttgcaggcggtaatttgtatagggaatttgattttctagatgtattttgtgtgcatattatgcacccaaaattgccaatttgttccctttcggataagaattgagatatctcatattctaataaactgattcatattcacaagtgttcaattaatatatcttttatccctatatataatgtgagaaatcaactgctatattaaatttactgctccgtttcctttcaaaaaaaaattactgctccatttggcaaaacaattgtatgatatttgaattattttaagtttatgaagtgtgtatttgatcataattttatattagggagaatagccattatggtccctgaagtttcgctatgagatcattttagtccctgaccattgtccaagcaaacccttaaactttatcatatggacatatatagtcattggcccatcaaaaattgccatgtgggcatgccatgtcatctttcgatacaaatatatgataaaatgcccaatttgcccttacacatatcatagggaaaaaggagagaaagatgaggtaggtgatatttgattgtctctgattatactatattttaagtatttgtggtccaccgaaaatgagacaatcaaatacagtcaagcagtttcagttccactaaaaatgggagcggagctgggtgaagctctctcacaaaataaactagagatgtgtagctggatttagacaactctacaactccactccaaacacaactcctggagctaaatttaggagttagaggggtaccaaatatgcccttaacattgaaatgcaattacgtacatagaaattatttggcatggtaattatatatttagtggctgtagctaatttaactttgtattagcataatccagtgaaaaaagtttgtcatatatcaaagtccacattggacaaagttcgtaaatcattttcattatttttgtatggtatatggaagtgtaaattggacatttcgcgacatattttgcatgagaggataacatgacatgttcacgtggcgatttaagtgagcccaaggactatattagcctacatgacaaattataaggactcgtttagacaatatgaatggtcagggaccaaattgatcctggagcaaaacttcaaggatcatgttggctattctccttttatattacatgaagtttacagtaatacatttataagaatatgaaatgatttttgtgccaaatatgttacagtaatgtatctttgtttagttttttggtcattgggatattggaacttatttgccaaaattatacaatatcttttagtatttgattgtctcatttgcattctacgggaggtagtttacggaggaaaacttgagactttctggatattttatttgcaaattccacaccaaaaattgacatgatgtttccttttggacaagaaatgagacatcctatattttaataaattgctaatgtgcaaatattcactttaatttatcttcgtgcatctacataatgtgggcttagccatgagattaaattcactacttcctttgggggagaaaacaatgtttgaattatattaagtcttcatgaatttgaccataatattttttttatattacagtaagtttataataataaagttataagaatatgaacctattttttgggctcaatgagtacctagtactaatggtaacgaaatggattaatggaatggttaagttgatgataagaagtgggagggaagccctaagaggagaggccaaaagcgagtgtttttctctttgtttttatcatatattgatagcaatagttataatctatctattatattataaagatagctcgaaaagaagacactatatttctaaattttatctaggaaaagataataaaatatatgtcgttatatcatggtgagaccaaataaataacactgtatactgatagcaatagttatataaaaagtacaattgcatatgtaggaatagagaataagagttgtatattaaaatataattctatatatgaaaatataagctaagaattgtgtaccgaatccaattgaactagtctgcacaaaagaagtgttgggaatcctctaattatgacaataaagattccacgcatcctatcttactataaagttatcttccattgactccttaagcctaacatgcaaagatgccacatcatcatccactaacaagatgccacatcatccattaacaaaatgccacatcatcatccactaacaatcatcacatttaaacattatgcaaacatgctatatctttatagtttttataatttaagagcttttcaaatacaaacatgttaagttatcatccaacataattcacataatgtttcaatgtatatctttattatgttttatgatatcctatatacttatatagattatcctcacttagttagtgctcctatcttactataaagttatccctcactaactccttaagcttaacatgcaaatatgccacatcatcatccactaataagatgctacatcatcattcactaattaacaagatgtcacatcatcatccactaacaataatcacatttaaacatcatgcaaacatgctatatctttatagtttttataatttaagagctttttaaatacaaacatgttaaattatcattcaacataattcacataatatttcaatgtatatctttattatgttttatgatatcccatatacttatatagtttatcctcacttagttagtgcttatatgattaatctatggtccaaatagaattatctttctccttttttcctcaaattaagtcatatcacatcaattgtttttagccttttagatgattaatctatagtccaaactatctccctacttttcttcttctataaagtcataccaccttactttttacgtttgattcactattctacatactatttaaatttaaattattataaaccacattaatttacttaatatgatattatctagctatcttacatgttattttttttattgttatcatactaaattcccgcagcaatgcgcggggtttcacctagtaacaagaatgcttgttcacaaagaataacattatccctaactggttgataaagattttagtagtataatatgtgaaggaaaaatcaatagattgatattacctctttaaaatattcattccttagtgaattaagtctttgtcatgatcagggtccctcttaccgttttcggcgcggttaccggaccacgcgtgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtcgggttgcgtttgctccggccccgagggccggggcacccccgaccccttaaagaagtctgcgccacgtatatgggataagtgagcacagctgtgctcacctaacagcatttattgcagtctggtcaagcgtgtcacgctgcatgcaacgcagtacagcacgctcttttatccggtctgtgaccggtcacagaccggtcagatcaagggtcaggtggcgactggcggtctgacgcacgccttgccccatcccgtcaagacgaaagcctctaggcactcgtctcaagccggagctagcgtgttatttcttagagatggcacgttagccctggttaaatgaataccaggcttcatcctaaccattacaggcaaggcgttacacgaagaagggcaaacatgcacgttgttaaaccgacgcgtggtggacaagaatgaccggtctgacactggtcgcatcagcaacgggcagccacgatcccacgttgcacctgtctccgtcgggagtggaggcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatttagaaaggggttggttggttggttgattttttcccggattgagagctgagaacgggggagaagtcagctgacactttgtgactcgttcatacacagatccaccaaaacacaggagtagggtattacgcttcgcagcggcccgaacctgtatacatcgccgtgtctcgtgtttcttccgggcagacgatctttacacatacagagagagagagagcttgagatctcaccctaagcccccggccgaatcagcaaaggggggcctgcgcggtctcccggtgaggggccacgagctccgtcatctggcgcgccaggtagggggctcagcgtgtgttttctgagctctcagactcttccgtgggagccaagtttttcttgttcagcctaatggccgagcaaggagaagcg

SEQ ID NO: 20394 - DNA, 3699 bp, Oryza sativa
  unsure (1)..(3699): unsure at all n locations
nnnnnnnnnnnnnnnnnnnnnnnnnnnnnnnnnnnnnnttgagatctcaccctaagcccccggccgaatcagcaaaggggggcctgcgcggtctcccggtgaggggccacgagctccgtcatctggcgcgccaggtagggggctcagcgtgtgttttctgagctctcagactcttccgtgggagccaagtttttcttgttcagcctaatggccgagcaaggagaagcgcacgacctctctccgagtgtgagcggcgacgacggggagccgaatccacgccgtcgagctcgtactcccccacctcctccgcgccaaagccctaagcagggggaggcgcttgagaaggtcgacaagtccatggcatcaccagttgcgggtggtgcaggaggacggcaagatggggagcgccgcctcctcgtctacggcgacggcagcacgcctcagggtgcgcttcaggctgctggcgcgctcttacgacacccacctgtcgtccatgacccggagtctccagcccaacgatggttggaagatgtggccaacttggtcatgacggctcagcagcgcctgggtgctggtggacggtccgccaccaccaagacctccggcgccgccaccaccggttccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgtgcaacggagggcgcctcctcgtccagagtgtcacctcgacacggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatttacgcgttcagggggggtgtgcggcacaaccgcatgctcgaaaagattgcctccaaagagccccagactaccgcggaactttttcagctcgcggaccgagtggctcgtaaggaggaagcgtggacatggaactcctccggttccggagtggcagcttcagccgcccccggatccaccgctcagacagggcggcgtgacatgatgaggaagaagaggtcggaccgttccggcgacgagggtcatgttctcaccgtcgagggcactccgcgggccacccgaaaggggaggcctgcgagcgacaaaaagaaagatgctggtactcccatcaaggaacgtcccgccggcaggtggtgctccgtccacaacacctccctccacgatctcgcggactgtcgtgcagtcaaaaacctggctgagcgaacgaggaagtgggaggaggataggaggcaggaacgccgtgagggcaagtccccggcggttctttccggcaaacggcgaagtgaggccaagcagaaggcccccgctgttgacatcgatgatggtgatgatgacctaggtttccaagaacctggggccaccattgccaccgtcgatgggggagcgtgcgctcacgtctctcgccggagcttcaaggctatgaagcgagagcttctggccatggcccctactcatgaggcgatgcgtcgggcgcggtggtcggaggtggccctcacctttgatcagaccgaccacccaccgtgcgttgcccggggagggcagattgcgatggtggtttcccccactatctgcaatgtgaagttggggcgtgtcctcatagatggaggagcggctctcaacatcctttcccccgcggcctttgatgctatcaaggccccggggatggtgctccgaccgtcccaaccgatcatcggtgtgacgccggggcacacgtggccattaggtcacatcgacctaccggtcacctttggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccatggcgaccttaaagtcgcgctcgcttgcatggagcagcgcgccgaccgcctcgctgctgcgtccaagcccgagggtggtgacgagaggcttggcccctctgcccccaccgccccgaggcagcggatggccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagccccgtctcgccgtgcggccgggcgcaagccggtccggcagaaagtgcggcggcaggccccggaacgtcaagctttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgtctcgcatagatcagatcgtcgactccactgcggggtgcgaccttttgtgttttctagatgcatactctggttatcatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagccaaataggacgtaatgttgaggcgtatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccctagcaaacttagggatgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagnnnnnnnnnnnnnnnnnnnnnnnnnnnnnnnnnnnnnnnnnnnnnnnnnnnnnnn

SEQ ID NO: 20395 - DNA, 1468 bp, Oryza sativa
ccacgccaaccaaattcttcagccggcccaggccctgcagatcataccactgtcatggccatttgctgtctgggggcttgatatcctgggaccgttcaaacgggccccgggcgggtttgagtatatgtatgttgcaatcgacaagttcactaagtggcccgaggctaatccggttgtcaagatcgataagccctctgctcttaaatttattaagggcatcacggcccgttttggagtgcctaaccgtattataccggataatggcacccatttcactagtgaactcttcggcgactactgcgaaaacatgggcatcaagctttgcttcgcctcacctgcccaccccagaagcaatggccaagtggagcgcgccaatgcagaaatccttaaaggcctcaaagccaagaccttcaacattctcaagaagcacggcgattcatggatcgaggagttgccagcggtgctctgggcgaaccgaaccacaccaagccgagcgaccggggaaacgcctttcttcctcgtctacggcgcagaacggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcttgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccgtggaacattgaacaccttcgtcgcttctacccctgaaggggggggtcgggtgtcaggttttggctcgggctaaccccacacccccctcgggtgtgccgggttagccgggggctaccacacatgcacatatattcctttttcctttatttcagcatttcaatagaagcagtttcaattttctaaaggttgtgtctgagccgttttttccttttgaggaatcttgacttgaaataatgtcattcgtgctcaaccccaccctcgggggctcggttcggtcagctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgtggatctccccaggcactggccccgacccgagccattcgaggactgggacttgggcacgagcccttatttcaagctaaggcgcaaaaggaccatggcacagatcatcctcatcgcaaaaggataaccaaataaaactaacccaaaaattttttcatcatttcggttctgat

SEQ ID NO: 20396 - DNA, 588 bp, Oryza sativa
agctccgctcgttctgcgcgcagggcctccacttgggtgttgaacccatccagcactgcggtgtttgcggcggccagggcctgcagaaggggctcggcgctcagcggggcgacagaagatgaggagaagagccgccttggagaaaaggcgacgcggcttggccccccggaggatgcgctgggctcggggatgtcccccgggcccgtttgatcctgggcgtcgcccggtgaggtaggcccaggcgatgcgcccgcggcctcgtcgcgagccgcctcggaggatgtcgcctgagggccgcccgagggagtgggcccaagtgacgcgccagcagcggctgacgcctcagcctggcgagcccgggcggcctcctcccgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcggactggccggacttggggtggcgggaggaatgcgacggg

SEQ ID NO: 20397 - DNA, 1258 bp, Oryza sativa
ttatgagtaacatttttctatgagtgtcatcaaacttgagtcccactggttgttttgtcctgcaatctggaaattcaatgtttacatggattggcaatgccagttcgtatgaacagcaacaatgggctgcaaaagttgctgaattcttgaaggtatgaaatgaggaaaccccatttaatattccacttcatgtggttattgtcgggaaaaaaatgctgtggacattattggaaagaatttctttatgcgggcacttgaatattatattgcaggtcaaaaatatattttcaaattttgttcctgttatttttcttttcttcttcttcttttttttattttgctaattatgatcatatccaaattccaaaatgtccactagaaagtagaaagtttaagggcttgaaaacaacaatgtcttctgttcttgggaacttttatagaaattcaaaatgaacctttaggaaggaaaatatggtggttgtgtcttgatttggaagaaagcttccaacagcatggttattaagactgaagttgatcatgtaggcaataagtaccagtcctattgtcacaaccagttgatctactgttagtccagattagcaatgttacaacattctgactatattatccaaatgtgtttttgaaactatatatgtaaggcatacctttttcagaggggcacacatttgttgattggattctaaagtacagttatcattttatgtgattgaccaatatgaatgaaagggactagcacaaatataccatccctgtgaggttactaactactggaaatctgtttccgctgtgatagaactaacttggttgttgctccagaatgttttgttctgaataaaccgaaagcatttgatattttcttgaattcctagctatttctcactcaatacgattatctgatgtttccaaacttgcagcctggtgttgctgtcaaacattgcaaggagggaactgagagctctgccttttggtttgctcttggtggaaagcagaattacacaagcagaaatgccacacatgatgttgttagagagcctcacttgtatacattctcattgaggaatggttagttccagccaaaacttgattctgaatttgtcctgttgttgtttcaatgtgtttcttatattctatcagagccctaatgtttctctctctcttttttttttttggtttcgtttgcactgacatgatcaccatttaccagggaaactggaggtatgttgtcttactcttattg

SEQ ID NO: 20398 - DNA, 646 bp, Oryza sativa
agggcgaattcgagctcggtacccaagtttatgttagtgatcatacattagaattgtgcttcataagcgctctttgctgagtattctccattgggagtcgatttccaacgaatgtcatcgggggtgtttttaaggagcatgacttcttacaatcggctacccagccggaccagttcatcaatttcacttatcgtggtaatggggtttaggatcgccagccagtggttgttttgaaggctgaggtgcacattgtttcattttctcctggacaggttgaagatccctagagctaaatctttaggtaagcaaccctgaagccagttatcagaacaaaaggagcatttctttccatttcccagggtaatgactgttccagctcaaaaaagcactctgtccaattcatcacatggcacttcaatgttatgccaaggtctattatcttccttccagccaaaccagagccagtgcagccttaaagctcgcgagaatttttccaaattgagaataccgaggccccccaaattcctaggtttgcaaatgttctgccaattaatgagactactacccaaactgacattatctggatcatctcccttccatagaaaagcacgccgaaatcaatcaatccttttatatagccccttat

SEQ ID NO: 20399 - DNA, 361 bp, Oryza sativa
ccgccggcgttggagttgccgagaaaaggagatgatgtcaaacgcgttcaggctcgaccgccgccgcgagctcccgcccagcccgaatctcccttccagcaacgacggcgccgccatcgccccggtgcactccgccgccgacatcgccgtcgccgacaccctctggaaggccaccaccacggtcgggactccccttgcgcgagttgctcacgctcgtcaccagcgacgacgacgctgacatggacacgtgctgctgccacgccgccatggcggcatggcgccatccactcaccgaagtagtaattagctagctagctagctagctaggcaacatgacgacgacactagcttaattagcttg

SEQ ID NO: 20400 - DNA, 1368 bp, Oryza sativa
acccccccctcaggggaaatcacgaggagggcggacacctcaccctcgggcccaacgtccccgaaggtgccaggccacgtgggcgattgcgtctgcctcaagcctctggtcatgatactcccggtcccatatcaccgacacatatgttgcatattggactagctagtagcaagttttttcactttagaccatgttttattacctaatattgcgttttggactattttagtgagcatgtcagtcaccaaaagcatcttcttccacctttcatccctaaagacaattccagagcatatgctgctaaatttggtgaggagaagtgaatgtttttttttttgaggtgaacgacggcaggagctctgccggaatttcattagaggagagaaaaatagttcagagaatacaggggaagacatcgaaggagaagaagggagaaacctgaaaatacaaagggaatccgaaaaagaaaagacaattaggggggttggaaagcagtgtgtctgagatcaagttcttcctttactattctcgcaacgcgatcctctgtgtaagagatgttttgaaaaattcttctgtttctttccaaccaaatgttccaccaagtggcgagaagagatcctttaaccctgaatttgaaaggtttggggtgtagttgattgagatcagcccaccaagctgtgttgtcatctgcaggctatgcccccgggatgttttgctattggcacaccataagccaaacttttctgaagaaggggcagacattaaagagatggttagtgtcttcaaacgcctctccacacaggctacaaatccaattgcaaggccagtgccggtgcaaaagattttgggccgtgagagttttttagtgaaggattagccatccaaagaagcgcatctttggttcagctgggcacctccaaatggaatgaaaatcaatcggagagaaggacccttggaactgaaataaataagcactgtttgcaaaagtaggatcccgattcattcaggttccaagtgatgtcgtcattggtttgcggtagaagctgacattttgcagcattcccccaagctggacaagatcgctaatttcttcaattgtagttatttgccgaaaggaaaggagccaagaattgtttgtcaattccgttttaaccgatctctgtttgcgcttagctaggttgaaacacaagggtgcaatgtcttttggacatgtattttgcagccatttatcatgccaaaatttgttttttctccattacccacagttatcgtagtggcagcctaaaagagtcttttgtcgcagtcatcacaaggtaaatccattccaacccaaggcttgttgtcctctttccatttgaaccagagcca

SEQ ID NO: 20401 - DNA, 13760 bp, Oryza sativa
  unsure (1)..(13760): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccatgcaggttacccattctagcccaagcaaggaaagctggtccaccaaaaaaatcatctaggtctctgtctgtaacattaaaactctgaaatagaactcagtcatcagcaagggattgaacacagcaaaaattgcattatgattccacagtggcatatatggaaaacaaaaacagtggcaatataaatgtcaaactgaagataacttctggatctgtaatgtttaaagatgccagattgatcacaaaacagcaatggtacagattagtatgcagttaatgcaaattttttatcgactatcgtttgggaaaatggtcgataaaattatagaaggcagcacaaaagactggcactcagcaaagataatattccaaatagtgacagacacggagataaattagagtatttgattcgagctttctagaatgtaaagttcccttagataagcgagagagagagagagagaagatcacgcatcctattggactgagccagcccaagtaacctattgggtaaggaaacagacgcagcttctgctaatttatatgcatggcccatcataagcaacatcactggttgctgtatgttaacaatttagactccaaaaagaatttgaaaatgtgcttcagagtttaaattgtgtctgtcatactaccttaaaaaccttttgccagatagcttcctgcccggtaaatgctaaaggcaaattaattccttgaagtgccatccagtcaatttctttctcccatcttttccaatcccaccagacaaatgagtctatagagatgctacatgaactttgtcagagataaacagttggaaaccaagtaaagaagagtaaaagtagccagattgggagatatttcttacaaactaaaaatgtgtggtttgatcttgaaaagaacaaaaggtagatctttgaaacaggtagaatacagaaattaaaaaaaaaacttttggcagaattgcaggactgaaatgcttagaccaaataaaagaacttcaatttgacacgcacagtggcaataatagatttatattgcatcagtacaaacatataatcatgatggcgttttagaaatccaacaagcatttgttttgcaacagacctagatgaccaattccataactcgataaaaaggaaaagagatcattttttcagagtgcaatataatattatcaccaatttgacaaaagtggtttgggtataataaaggatttggagctggaggttgaagactgagcagatatggtctatggagcagaacaaacattatgaaaaaaggaaaattgtgaaactcacagctagaggtgacaacattctgatagtaattccacggaacaggtcgctcaatcttcactcctgtcccttttacttgcggtagagacccgggcaaaggaaccgaggccagctgtgcgccaccagtcttgtcccaagaaatgtgtgcaccacaccagtacttgagataccagtggagaccagaggcgagctcgaccgctgtggtaccctggatcctgaacacaatgataagtaattgcattcacttttgcaatgtaaccatagcaaattttcagttttggtagccgtatatcaacaaattgttctccattcattcccctatctatgctcagctgaaggcaatgttttgagttttgaaaaacaaaatgcaaaagttactaaaagagacagccgggatgagaaggaacagttgccaaaatagatacttcgcactggcgttttttcattatgtcaacccattagtatattttacagttttaatagcatcagatagataagtgctactgtgctatagcatcagacttagttgaaggtcctacaaaaccactcctatttaaacaaagccaattttgagaccataactccataattttaactattctaaatttaaaccgtggaagcagggaatagaattctgttccaaataaaaaaactgggaagtaaacacacacacacacacacagaggagagcggtagaagcgtacagaatttctgctccatttctgcgcgagccatccgcattactaatcctgaagcagcttgacccgccgcagacgccaccctggatgagagaatcaaagtcaaacccgtcagcgacgacgccatcctgatccaatcgagcagcgaccgtaattttcgccgcgaccgtttcgcctcccccgagtcagaaatcgtcgcgcgcaccgaccttggagacgatctggaagcggaagctgcgggcgtgggaggggaggagcctgcggagcaacccggcggcggccgcgtcttgctctcccggcgacgcgaccctgcggcggcctccccccgccgccgccgcgccgatcgcctcccacccgtcggcgccgcccgcggccgccgcagacggcgacgggaggaggagcaccaggaggaggaggaggagcagcaggaaggggagaggcgtcggcggcctcatcgccgcgacccgggtcgactccggccggcggcgagactgccgcttccgccgccgcaggtggtcacgtctaatgcaactgcccgagtggctctctagtctactattctatctctctctctccctcgaattctccaaatgatgagatgataggcaacgatgattgcttcagatggtggacgattgtgtggagattttggataatgcggtcgagttggacgatttggactgtttgccgaatgccgttggactatttttccactgtcagtaacccaagaaaaaaatcacaaaagacgtacacgtacgaggcacacagagcacggggtatgccgccacctaacacaataatcaagtactattataaattgtttaactttttctatcaaagttttttttttaagatatgatcaaatttataaaaaaaatagcagcatctataatactattttattaaatttaaattgaatatattttttataataggtttgttttgtattgaaaataatattatatttgtctgtaaacttagtcaaatttaaaaaagttttactaagaaaaaatcaacaacttataatatgaaacgggggagtagaaaaaaggcatggaatgaaaacaaatttttattcattattaagtcactgcatccattaagggtgtgttcggaaccaccggttcctaacactaagtgcccgcacggaaaacggagcagcgattagcaggtgattaattaagtatttgctaattttttttcaaaaatagattaatttgatttttttaagcaactttcgtatagaaactttttgcaacaaaaaaaacaccgtttagcagtttgaaaagcgtgcatgcggaaaatgaggaagatgggttgggaagaggggctgccgaacacagcctaagtcattatagttgagtatatccgcggcaaaaatccgttgagtaatctaaatcaaactaggccttccctcctccagcataggaataagtttacctggcgtcccttaattgtacactgagtttgtttaaggtcacctaaccacaataccagaaatgtgtacccctaaattatttaaaaccgtaaaaaaaaaaggtcccaaggcagtatagttgcccagttttactgatgctgtatcctagtcagaaaaaatttaaaaaatattatgtggggcccacatcctagtcaacatctctttttttttctcctctttcttttcttttcttttttttttgtcttttcttctcttcttcacccgctggtagtagagggtgagaggcggcggctatggcggcgacagcagctggtgatggccggagagaagggagatgaggccagacagtgaggggagagaggaagtcggccaaagaagggggagatgaggccgacgggatagggcaaaaagaggtggctccgctctcgcccggcttcttcgtctccacctccactgctcccgaggacatggggacggcagtgacgacggcactcgtgcagaggtcgatgttggctccactgccagcggcaggtttgtcgacgtgttccacggggcggttctggtacgccattttggggttctcgagggtgaagatggcgcttaacatggggtccgagcgggggccttgcgagtccatcgccatcgtccacgactttgccgaccgcatcatccacgtcgtcgtcgtcctcaaatcccatcccccgcaacgccgcacaccacccatggcacaacgagctaggcttggcgctctcctcgccgccatctccctctcatccatgcctgggttgggtggttcggagcactgaggccaagcagtgcattgggctcaggggagccggggttggtcgccgccgccatcgacaaggtcgagcggcgcggggtcatcggcggccgtctctccccatctaccgtcaacgtcagaagagaagagaagaaaagagaaaggaagaagataatgctgacacgtggaccccatatttttcctttcacttacatgtgggccccatatatttttattttttattttttgctgactaggatatcacgtcagcgaaaccaggcatctatactaccttgggaccttttttagacagttttgcatagtttaggggtatacatttctggtattgaggttaggggaccttaaacagactctgcgtacaattgagggatgtcagatgaacttattcctccaacatattgctcatgcccttgaggccttgtttggaaggccgtgagcccatgaaattgaccgggattttgaactaaattcactggggcggattgtatatgttatccaaacaaggccataatgaagctgcatgcgcttgaccgttggctaccttgttggaaattattgcatgcgatgaaaatggaactcggtttattgatgacagatacactcatataccgccgtccgccggatcgaagagatcaacagatcatccatatgatcagcttaagcaatctagcgtagttacccagatttggcgcagccattctagaagcattgcaggacaatactgcaagaacacgtacgtaagacacgtatttcaaggccaaggccgatgtgccagtaagagcaggtactatagcagactattaactagctgtaaacatattttaatgagataaaagatgagagcaagtacaatagcaagctattaactagttgtaaacatattttaatgagataaaggatgagagagaagagcagcgggctacatatctgtagctagctgcagcgcggactccaatacaagatgtgtgtatgacaggtgggaccatatattaatactatagtaagtaactattgtatgaattggctattagattgggtatagataaattgaagctagtagtgggctatactattaaacttgctatgagagagaagaacagcgggctacagatctgtagccagctgcagcgcggactccaatatgtaatgtgtgtatgacatgtgggaccatatattaatagtatagtaagcaattattatatgaattggctattagattgactataaatgaattggagctagtagcgagttatactattagccttgcgctaagctagcttatgtgatgttcaatttttaaccattcaaggttagtgctccctgagtatatcaaacaactgaagctccctgagtgagtgagtatattatgtatcttcactcacgcgctactgcgctagcatgcttgaatatatagatttgtccacatgatagtacgaatgcgccgatcgactatggtttaatcaactggccagttccctttataccaatctagtgatattaattagttaattaatcaacccttcctgcatgcatgcatgattatgcatctggcatataatacactgcgcagcttgccagcatgtttgctgtaaagcgactagcgagcagcagcacacagccacacacacactcgctgatcagccacaatgtgtaaactgacggatcgatcgacatgtgtgtagctagcgagagtacatgcatgattaatcaatgcagcttacccgagcacacatggaccttggcaggggcccacccctcgacagcggtgcgtgcaatatatgcgagctggggagatgggaggtgcccgccccgcaaaaggatcctcgcgttaaaagctaagcatgtgcgaacgcatcgtcttcgccacgatccccctgggagctaggtagggggctcgccagcgtgcagtgctactgtttgtgtgggtagctagctcagctgctacagtatttcatacgtagccgttgactttttatccaaacatttgatcattcaccttatttaaaaaaattatacaattatcatttattttattgtgactcgattcatcattaaatgttctttaagcataatataaatacttttatatttgtacgaaaattttaaataaaacgaatggtcaaacattggttaaaaagtcaacggcgtcatacattaaaatacgaagggagtatttggcatgaacatatcagtgtggaagctcaccgtggtgcgggtcatcgacgtcgtaggttcttttgcagagtaatgtggttcacgtttacatgtgttttgtagatgaattcattatcgaatgggatggatctagcgtggggttagggagacttgatcaagtccccctatctcactgcatcactattgatagagggaagggagaggaggaagacttgatcaagtccccctatctcactgcatcactattgatagaaagagggaagggagaggaggaagagagggggtgcgacgaggaaaaaagagatgggttcccctttaactttattttagatccgtatgcgattatagatataagaatctaagatgggttcctcctaggtttttcacattgccggtaattttgcgggtaacgtgtttatcctgaaagtatgctaaaagtatggcaagggttattgatgatagagtttggttaaatttgttcgaattcagtttttctttaaaaaaaatccctacaaataatacatgattagtagtaatatatatctagtatattcgacattagtcaaatgtgatgttgtagtatcctttttccatatgatctctttcaagtcaaagaacacggttatagcatcttattgtgttgttatcgtaaaccttactacaatttttgaaattttgaattcaacattttgagatgaaattcacgtggtttttagcagttaacatatgttattgtggtaagtgccttactgtaacaatattggataaccgtggtccaccgaataatcattcttagatgcctgtaaaatacaagaactgaacttagattttatacacatggtatgctactgcacgttattatgccattattgatccgaaatatatatgcacatacctgtacattacgtatgcgtatgtggtccaaatttaagaacatgtttagtacctctctaactcttaaatctaacttagaaatggagactgtagtggagctgaaataatctgaatccctgtccagccatttggttattcttttctattgctttcgtctgttctgctaagggtctattcgacagccgtggttgtagttgtggtgcagccaacgacaacagtgccacaagcataagagtaacatgcggttgttgctgctgttgccattgccgcaggcggccttccaaacacgatgtgctcgccttgcacagacgcttcacctccaccgatccaacgatcgatcaacggaagtgcacgccgttgcttcatgcgttccttcttttgttcatccattgatcaactgaagtacgcgtcgtactcgccttgcacaaatgcttcgcctccacgaatccaacgacacgacgcgcgcttgtgctacagagagagatcacctatctctgatccaacgccgcgcggaggtgtccactcaacgactgtgttcggtagcctcgtatagaaaatagtgttacccattaacgtataatttatttttgcaaaaattacataccatttagtaattttaaaaaaatatgtgcatggcaaatgggagaaataagttagcaaagtgaaaaaaacaactcagcccaaaccactttccgatcacgaaagcctgaccattactctgatcgagtcaactacagcacactagtacagtacgtacgtatcggcaccatcttgctatcgatgtcgtggcttaactcgtgtccactctacaaaaagaggaggaaaaagacggtggagttggaggggagggacggatcacacagggggcgtgtgcgtcatcttcgggaggaggatgccaaatgcattgtcttggcacgctggctggcatgtggggcccacgtgtgcctctaagaaattgaagctgctgtggtctgccgtgccgggccggaggggccacacgcgctggcgtggttaaggctgggcgtgggcccggcccacctgcgatcacaagtctgatcgatcgtctctctgcctgccttgcctgagatgtttctaaaaaagcagctgcgtttgtcttctaaagaaacagagatgattaagcttgcccgcgctcgtgtacactgaatcaccgatatatatatacagagataagctcgatttcttgagctgttcagcgtgttgtttctcaaacgctcgatcggtcgggaaaaaaaaacagctattgatggcacaatgtggtaaagacttttgctgtcacttagattgccactagggtctgtcaggggtcaagcagtcgagaaaagtatgcactgacatatttcttatttaccagtatatgggtaccgataattttgttgttctcctgatagatattgtatttctgacagactagttgtttccaacatactcccatcgtctcattttaagtgcaaccatgattttctgtgcaaaactttgactgtccatcttatttagaatttttttgaaaaaatttaaaaacataaagtactattcatgttttatcatctcataataataaaaatactagttataaaaaaatttaagtaaatttcactttggtcaacctttatttaccaaattttcacattggactagagttagacttatattttcacttaacaccatatatagttatcataatttatactttggaccgggtttcacaaattacacatagtataatgattgtagatctgatcttatttcttttttttttagaaaacttagaattcaataatttgaactaacactacagttgggtattgtaaaacgtgtacttttctagaaaaatagttcttaaactcaatatttctccaattttgtctctagtataagggttgtgaatgttcatatgtagtagtaatgaagtcccattaatctgataggatatcctataacatgttacaatcattgttcttgcgctaatcatatttgcatggcaaaaatttccatatcattgtttcttgtaaaatgctaagcacctagacaacaactcgtgtgatggtaactgtaaaatcaggtccaaagtacaaacaatggtaattatacatggtgttaagtgaaaacataagcctagccctagcccaatgtgaaattttggtcaacaaatatggtccaaagtgaaatttactcaaaaaattttaaataaaacggacgatcgaagttgggtgcgaaaacttatggctgcacttaaaatgaggcggatggagtatattgcaaggtagcaaagccacggaggagttgcagcgagcggtgacagcaatagaagggagaagcggcagcttgccgtgatgtagacgagggcgcaaggaaggagtggcagcgagaaactacggcaagcgacggtgcaggcaacatcatggcacggaatttgacaaggcatggcgggccactacaccctttaacaccttctccagaagctctatcatcacctgacctagctagctagtcatcaacatggcttcccgtactagtttggaaggagagaaagagatgatgaggaggaggtaaccgagagggcttgaagcttcggtgggcgagctcatatggaaggtagagatcgacgttgggtgagcttgagaaaaaggtatagcttggacgaggtaaatcgacaacggtttggcgcgaggagcccatacgtgtcacacatattccggtgtcatggtcatgtgctgcccaaagcgccataattaagcacctcgacccacattttgttgttgctagcgtctatggctactacggacacctcctgctagcgctggatccaagaagatgaagaacctaaggttgtactatttggttggaaggatgggatgggtgactctattttttactattgtgtttggtttggagatgggtgggatgggttatcaccttagaggaatattctccttagttccgggtgcaaaccgttcggtaaaaatgagcggaccatcttgacccacttagacgggcgcacagtgtgagccgtgctgttacttcgcttgcccgctcgccaatcgtcaccactcgtccgcctgtccaccggtcgtcgtcgagttaccccctgagttatctacttcccggtatcgccgcttgttcgcatgtctgccggtcacctttcatccacctgttcacttccaatcggatagcgttactcgtccgcttacctatcgttcaccgcccaaatcctccgcttgcccatccgtagcccgttctctggtcattgtcaagttctgccccgggtctcctccacctgtgaactatcgaatgcctatgcctagctaccatcctccgctaaccgtgttgcgagatgttgagctcttccacttgctggccgatcaccgctagaaatggaaattgggaattccccacggggtaatgcatccccatccccctcctaataacaaaattttccccacctggcatggggaattaaccctcgcggggtctatgtccccgcttaaaacaatatatacatatcaaattatatatgcaatgtaacacatatattcatattttatattaatatattaacatatatctactaagtcacatgataaaaaaaataagattaacgtttattaaagattacaagtaatttagtcacataagataacttaaaaaaagcattaaacttgtatccctatgccgctctccgtggcggtcgggaacatggaatggaggaccatccccgctcccgtgaaacccggcgggaatatcaatcctcccatttgatccccacgaagaaccaattctaaccatcactgctccctaataagagaattccctgtaggaaacgggaaacaggaaacggcgccattgccatctcaagtcgctgccgcttctacactgtatccttttgatcgtgatgttagcgacggaacctagcttgcacccccacattcatcagacaaattttctccataaaccagctatttggcatccacctcttccacccaagatgtgacaccttatctatacatctggcaacgacgctaacgagagtagctttgttcgtactaaccctctcggtgcttaggacagtaccacctttatactacaacaggtttggaaattggaattttgtggcgaatgacgttgggtagaccatcttagatctggcacattatttccaattatttccatgttgtcacatttaatgtttggacacatgtatggagtattaaatgtaggtaaaaaaattacacatattgtgtgtaaattgcgagacgaatcttttaagcctaattatgtcatgacttgacaatgtggtgctacagtaaacatttgctaatgacagattaattaggcttaataaattcgtcacgcagtttcctgacggaatatgtaatttgttttattattaaactacgtttaatacttacatttaatacttcagatgtgtgtccgtatatctgatgtgacaaccaaacccaaaaattttccccaactaaataaggcctaagttgcaccggaaaaaaaggaatcggtgaaaaactctcatgcatatactatgtagttattgtacattggaaaagagaaaatactaaaaaaatatgtctatgaaaaaatatgtcacatgacaggccctgtttagatcacacccaaaattttttaccctatcatatcgaatgtttgaacacctgcatgaagtattaaatataggctaaaaaataattaattgcacatattgcgactaatttgtaagacgaatcttttaagcctaattggtccatcatttgacaatgtgatgctacagtaaacatttgctaatgatggattaattaggcttaataaattcgtctcgctgtttactaatggattatgtaattagtttttttatttgtgtccgaacaccccatacggcaccctatataatatccgatgtgacacgagaaaactttatacccctgaatctaaacaccccaatagtacaatttctgttgcgacattttcttagttgtccttgcttcggtgctcatccttgacatttatgcattgtcttagtaggtattgtcagcttttgtcgtcaccaacatactactgtgtaacacctctgggcattgtagcctgatccatggtatgatcgatgattggcaaactaacgagaattcactttgaacagaatgagttgtggtagtgacaagagagaatagtcaattttgtccctctaagtttcacttaagggctattttgacagttggttataagactttctagcattatccatatttatataaatgttaatgaatctaggcacatatatatctagattcattaacatttatatgaatatggacaatgatagaaagtcttataatatgaaatggagtaagtaacgctttattttgtacagttcagtgcttaaagcttgcattttgggtcaacgtggtaattggatgaacctaatatgctacaatacgaacataactcaagaaaagtttagccttgtgtatctattgtgttgatatcaacagcgaaatgattgttacatccttgtgtatatatttgaggcctcgttcggattacaggatagccatgggatttttggaggaatactattcataggtttttattccttttcataccattcggatcgcaaaagccaaacacaaaaaaatcacaagaaattttcctacaccatcgattccacgggaaaaaacacattaaaaacgatgggttaattcgatccatgccaatacaaatatgttattttagattgtatatgtgtcatgggaatttagggaattggaacctgccactccgtcgcgttttccataagaatctccgttagcctcaactgcacataaaaatctccgttagcctcaactgcacatgggcaagaaagaaaaagaaggatggaggaagatagaactgacatatatttttaagggaaaattgtaaccatgccattataattttataaaatttgagatatgccatcctgacccatgtggatcctatatgtcattgactcatgtgggtcctacatgtcattgagatactgatgacatatctcaaactcttttttaaccccctagtttacgttgggattcctttcctatttccattgcttcactatcctatatctatcctatagtccgaacaatgaaacaagtctaagaataaacatcggttggtcccatgactacttaagaaggattctatagcttattttatcattgttattttatgttggaatttaaaatataatggtgaattagtcttttagctatatggttcattgtgacgccctgcacttctaacattgaa

SEQ ID NO: 20402 - DNA, 8479 bp, Oryza sativa
  unsure (1)..(8479): unsure at all n locations
tatttggcaataatctaccgtttggcacttttatcttcaatgttaaaagaagcttgcatgcctgcaggtcgactaataatctacagcccggtacttttatcttcaatgttaaaagtgcggaattaatagtttgttaaataataatctatagtctggcacttttatcttcaatgttaaaagtgcagggcgtcacattcatcaacaagattgatcttcattgagttgccttgatcacccgattcattaggtgggcgttatggatcgtatggaacaaaagagcaaagctcaaaagctcaaggaccgattcgaacaaaatgaaacgctagagactaatggcttattaagttggggggaaattgttagtagagaatatgagtttaaaaatgaggacggttggtgggcgttaaaagtttaagagcgaactcccacctttttaatgcctgagcaggggtatataattgggacataattctcttctaggtacgactagataaatctaaagccgtatatcattgcgtacaattcaattctcacttgactcatgattatcatctctactatcgaacaacaaactaggagtaaaacgtctctccctccaaataaaacttaggttaaccgaaaataaaatgctcactctgttttttttaatatatgacgacgttgattttttaaaaatatgttttaactatttgttttgttcaaaaaaacatgtaattaccatttatttttattgtgacttaatttattatcaaatattctttaaatatgacttaaacttttttatatctgcacaaaagtttttaataagacgaatgatcagatgtcgataaaaaaaaatcatatattgagaaacagaggtagtatataaaatgaaaaaaaaaagaaacagaggtagtatataaaatgaaaggatcaaattggccgtattaataatacgcatatattgagaaacagaggtagtatataaaatgaaaaaaaaaagaaacggaggtagtatataaaatgaaaggatcaaattgaccgtattaataatacgcttactttgacaccgacgtatgacatcatttgttagccaagagggagagccgttcaaatttccatcgaggaaaacgcctccccattttctccgctacagcatagtgccacttctttcccccaccgttccagggaccccagggcggccaccggcccaggttaaacgccgctctcgccacgctcgttctaaaaacagggagcgcgctttgccagatctaccccgttccattcattcgcatctcctcccccctcccatcccagcccaagggcacggacaggccagagagagagagagagacagagaggcagagcggaagggagcaatcatagcgccccgctttctttattaggccgcgtcacccctctctccgcttttccgccggccacctcgatcgccgccccctcttccccttcccctcccgtcagcctccgatcggatcccgtcgtcgtcgtcctcctccccttctccaggtacgtaccccctctcgactcctcgatcgaagactcgccgtcgtgcgtctccccgcgcgcgcaattgctcgttggttcttcgggaatgaagcggattgggtttggtttctcgctcgacgatccgctcttgcgcggcgttgtttgttccggttggtggtgccggccattgtgtgggggagagaggggcgcggggtgggtcaggaatggtgttcgtctccggcgatccggggggtgtctaggtgggtgggttgcctaaccgatcggtgagatcggaggcgaaatgtgcgggggttgatccgtggattagctctcaatccgctcccttccgctttgggggcggtggtgactggcagctgatcagtgaccccagtggggttgggtggcgccgaatcagctttcccaatctctggttggtggctgccgtcggcacgtgctcgtgcagccaatctgatggatagaagatgattaacacgagcacacatcttccaaattggtgtgagggagctgggtgatgagatctgcatatgatgtgtttggtttgattgatctcgtaatgcagcccatgtggttgacgagaatacgggggcgattgctttgtgggcatgagtccggtggcgctgtgcagccactggcttcgtgatgagatcaatcagaatagatgggcgcatttgggtctcagtcctctgatgggtacatctccattagcaaatataatgggtactctacgttacagtgtctttcaaatgtagatgggggctcaggtagatgtaatcagcacgtcgtgtatggtttattccggtttacctgttttgatctgacttactgattcgtttataagagtgaaattgtgcgattctggtgagtcattactgggctgcatgcaattgatgatgctttccttcatgatataccccttttacgatggtttcattcaggatatgttcgttttgatcattcacttgtgtgttccattcattcatatttcccaacagctaactactctatttgttgtcttgattcgagttgattgtttgtttgaatatcattgctcttttaacatctggtctttcgatccatgtatagaagtccaaattagcttggctatttttttctttctaatcttgttgacatataattttttcttccccttttcagtgtgcaagttcctattattctgtggtggagccatcttccactaccctgttttcaattaaacctttgtaaagttgctgctcaatgtcaagtgcaaaaccagtgcttgatcctgcatttcaaggagttggccaaaaaccgtatccttctttaaatgcctttatggtttgttttagttgtcttcttttagaaatctacgtacaagagtttctatccttttatgctgttagccccttaattaaaatatagtggcacagaaatatggaggattcaagattttaagccagttcctttgccaaaagcagattacggtaaattttacaatggagattcatatatagttctccaggtgattttttttatatttacattttagaagaatctttctgttatctccactatggaaagtttcaatgatctgttcattttgttttgtagacgacttgcagcaaaggtggtggcgcctatctttttgacatccacttttggattgggaaagattctagtcaagtacattttctctaacatctcaagtttcatgtactgataaatggcatttccagcccacttcttgatttgatgtgttctcattcaggatgaagctgggactgcagcaattaagacagttgaacttgacaccatgctcggaggtcgtgcagtgcagcacagagaacttcaaggctatgaatctgataagttcctatcgtactttaaaccatgcattatacccttggagggaggtttcgcctctgggtttaaaacacctgaagaggataagtttgaaacaaggctatatatttgcaaagggaagagagctatcagagttaaagaggtgactactatttcacctccctgtttcttagactactttatctcctcatgttatatacactaaatgtcctatattcaggttccatttgctcgctcgtcattgaatcatgatgatgtatttatcttggatacggaaaagaaaatatatcaattcaatggtgcaaactccaatattcaagagagagcgaaagctttggaagcgattcaacatttaaaggagacataccacaatggagtgtgtgatgttgcgattgttggtatgctcgacaaccaaatctcaattcatgtaactttctggcacaaatctacacattttcatacaaaatttttgtgatagatgatggaaaattgcaagcagaatcagattctggtgaattctgggttctttttggaggttttgcaccaatagggaagaaagctatatgtgacgatgatgttgttcttgaaaccacagcccccaagctttacaggtatgattttttttttaaattgcgcttacagaattgtgaatccagataggacccttgtcttttagtaatcagatgctccaaacaacttcatattcttgccttccctatgtatggacgcacttcacagtgaagttattttagggtgcgctcattgaagaatttctgtgccgaaaagcattgttctaacacatgatatggcatggactaacttcctccctgatcatacacaggctgctaaacttcatataaaactccaaaaatttatccatcagttgtgtgcaaggcatgtgtatatttatgtattaagatgatgctatttgaaaagtatcgatgctaattacatacatccatttttaggacttcttacttcaactttattacttttggatttctgacagtacattaagcaacttctgacataatttcaacgaatgttcagtatgcagatacaaccattttagctgtatgtatttgcagcttaatgttactgtaaatagcttcctgtttaggtagatacatttttaccaataaattgatttgtccttttctggttgatgaagggtttcataccttttcaaaggcttctcataagtttaatagttttcccatgttttatataggttttctcaggtttttggtagtgttgtattgtagcatagactaaatgggtatcacagttttagttggtttgctacgcttactatatccttaggtctgagactatatatatatatatcgctatgtttatcttactttttttcccagtggcttaactttatttttgtatcctgatttttttccatgccatcaactgcttgcagcatcaataatggtcaattaaagttagaagacacagttctgacaaaatcaattcttgagaacaataagtgctttttggtcgactgtgggtctgatttatttatatgggttggtcgactaacacaagtggaggagagaaaagctgcaagtgcagcagttgaggtaagtctcaagccattgttttcttcttttttttttcttgcctattcaaatttgttaggatctaaatttgcctttgtaggaattcattgctactcaaaataggccaaagacaacaagagtaacccgagtgattcaagggtacgagaatcatacattcaagtctaagtttgaatcatggccagtaaatagtgcaggaagtgctggcgcggaggaaggccgagggaaagttgcaggttgtgtatattgttcatgttctctgagataaaataattgacccttagatcattcttgataatatttgcttttcctatagctctgttgaagcaacaaggagttgatatcaagggagcctcaaaaagcagcgctccagtagacgaggaagttcctcctttgctagaaggcgatggaaaacttgaggtatattttataagctttcagcaactataaaggaagactgggaaaatgcaataataggaatgtaaccataagaaacatgtggatatttcaggtttattgtgtcaatggcagtgctaagactgctcttccaaaggaggagcttggaaagttttacagcggagattgctatattgttctctatacatatcattctggtgacaagagagaagaattttatttgacttattggattggcaaggacagcataccggtaatgtaccttccagtgctcccaagctttagaatgtacatcctccgtttcacaatataagtcattctagcatttcccacattcgtattgatgttaatgaatatagatatatatgtctagattcattaacattaatatgaatgtgggaaatgctagaatgacttacattgtgaaacggagggagtagttggcaatcttattcttgaacttctatactatagtgctttcttcttactttgtctgtgatcaacacaaagtcctgtcaatgccatgttatgtgtgttctcatcaagagcttgacttttatgtcaaataatcaccagttctcatgtgcaattaaatattactagtcatctcaggtgaaaataaatattccctctgtttatttatttacagaagacgccgttgacttttggacattaatttgaccattgtcttattaaaaaattacataattatcatttattttgttgtaacttgtttatcattaaaagtactttaagcatgacttatatttttgcatatttgcaccttttttttttgaaaaagatgaatagtcaaatgtatgtccaaaagttgacaacgtcatctattataaaacggagggagtatcatcttatgggtgacaaaattatctcttataccatgttgaatagtatagggagagaaatactgcaaatattggacagattgtattgagccttggggggcggtatatataggactacatgtagaggagataaggaaggatttagagataaggaaggagtccatacaaatcaatcctatcctattatgactctaagtaccatatactcaacatttttgtcgcctcataccactgttgtgtgatctgtgaacttactctttggttgatttcatacaggaagatcaagagatggctttccaaacagctaattcaatttggaattcactgaaaggaaggcctattctggtactgtattcctactatgacaatgtggacagattttctggaaaggagtttgatacattatatctggtgttgtagggtcgtatttatcaagggaaagaaccaccacaatttattgcccttttccagcccatggtcattctaaaggtatggtacttgatccttaccatattcatgttaaatagaagcagttggtaatagtgggtgttctctaaggaactaggtgcgcactgtctatatagctgaactgtaatgtccaatctcaattcaaacaatatcagttaagtgtatttggcatattgtgcagggtggaatcagctctggataccagaaatttgtagaagaaaagggcttgaaggatgaaacatattctggcgatggcattgctctttttcgaatttctggaacatcaattcacaacaataaagtgcttcaagttgatgcggtaatatttacctctcctgcaatggctgtgcctatgaagattcaacatgataatattgttggtggttttgtatgttttcaaaatggtactttataatagcaaactattctaaaattctatgtgctcatatatagagacatgacagagtagacctagggctgccactgggtatccaatgcccacacccatacccttacccacactatttgggaagggtatgggtagggaggaattacccatttcaattttgattaggggagggtaatacccatcattaccacccatacccattttatgtgtgtaaagcttggacccaaaattttaaaacttgcatccgcactataaaaacttgtcaaattcggttgaattttgtagaaatgatttattgcagagaagcaactttgtgcaagttttgagccatttgtatatgtgaggcccagctaattatgaaattgatatgggtaaaattgggtatggatatgggtcacccatacccttcctagtggcaggcctaagtagaccatttaatagcataattgataattgatggccttagtgagattgtagagtataacaactgcaaacagataaacaatgagggctcaaataatgttgattagtgatttccttagggtgcagctagagaatctaccttgcattatttttgtctgtatttttctttttatggaaacacagaagagtgtggcataaatacatcgattgattttcttctgagtgtgctgctgatgcagaaatttcattttagccacattgttcttgtcctttgcaatgacctttttcttcttactagactcatttgaaattcacaggcatccattatctgtaaattttaatttactgcgcccatctgcttataagtaacatttttctataggtgtcatcaaacttgagtcccacggattgttttgtcctgcaatctggaaattcaatgtttacatggattggcaatgccagttcgtatgaacagcaacaatgggctgcaaaagttgctgaattcttgaaggtatgaaatgaggaaaccccatttaatattccacttcatgtggttattgtcgggaaaaaaatgctgtggacattattggaaagaatttctttatgcgggcacttgaatattatattgcaggtcaaaaatatattttcaaattttgttcctgttatttttcttttcttcttcttcttttttttattttgctaattatgatcatatccaaattccaaaatgtccactagaaagtagaaagtttaagggcttgaaaacaacaatgtcttctgttcttgggaacttttatagaaattcaaaatgaacctttaggaaggaaaatatggtggttgtgtcttgatttggaagaaagcttccaacagcatggttattaagactgaagtgatcatgtannnnnnnnnnnnnnnnnnnnnnnnnnnnnnnnnnnnnnnnnnnnnnnnnnnnnnnnnnnnnn

SEQ ID NO: 20403 - DNA, 14482 bp, Oryza sativa
  unsure (1)..(14482): unsure at all n locations
nnnnnnnnnnnnnnnnnnnnnnnnnnnnnnnnnnnnnnnnnnnnnnnnnnnnnnnnnnnnnnnnnnnttgttgattggattctaaagtacagttatcattttatgtgattgaccaatatgaatgaaagggactagcacaaatataccatccctgtgaggttactaactactggaaatctgtttccgctgtgatagaactaacttggttgttgctccagaatgttttgttctgaataaaccgaaagcatttgatattttcttgaattcctagctatttctcactcaatacgattatctgatgtttccaaacttgcagcctggtgttgctgtcaaacattgcaaggagggaactgagagctctgccttttggtttgctcttggtggaaagcagaattacacaagcagaaatgccacacatgatgttgttagagagcctcacttgtatacattctcattgaggaatggttagttccagccaaaacttgattctgaatttgtcctgttgttgtttcaatgtgtttcttatattctatcagagccctaatgtttctctctctcttttttttttttggtttcgtttgcactgacatgatcaccatttaccagggaaactggaggtatgttgtcttactcttattgtcatgcttcaacaatttgggattattagtttctcaaaaacctttttatttgcaggtcactgaaattttcaacttttcacagatgatttgctgactgaagacatgatggttcttgatacacatggggaagtctttgtttggatgggtcagtgtgtggatgctaaagaaaagcagaaggcatttgaaattggccaggtatgatatgaagatttactcttgctgacttaaatatcatcatctttgctcaactcagcaataactgctttattctcagaaatatgcagaacatgcggcggccttcgaatctctttctcctgatgtgcctctgtacaaagtcgttgaagggaatgaaccatgcttcttcagaacttacttctcctgggataacacaagatctgtggtatgctattggatatttaccactatatctttttttctcagttctatcaattggaactttgtatttaagagatttcaccttggaagcaatttttcgtataagagatctatcctatgttcgtagttcatatttccttctgagcagctctaaatgtccatcagtacttcagtacatatgcatgtagctacacggagctccttcagtgttttgctatatgtttcattccctgtttcttagctaaactaataaatgcctaccacatatatgtctcattagatcagctattatgtttggggtagttttgtggtgtgtatgcttagattgttgccatgttaaacatatggtgtcgaatccgacttaagggtgtcataagaaacaaggaaaatttcttttcgttatgctaatttaggttggtagtcctcaatagaagtaaaagggacctggggaggcaagaaaggatccagttgattttaaaataatttaaattaatctaaaggactggagaacaaggacatccttgcccatatgaatgaatgaatgtgcacagttgctatgaggctggcacatggaagctatcatgctttcttcaattatttattcatcaattctgcaagcttatttttcagtttggttgtacttgcctatactgtggtatttggtcgtaccatttctttgctcacacttgttttagcacaggatataatacttttcacccttgaaacagattcatggaaattcatttcagaagaagctttcacttcttttcggaatgcgctcagaggtacgttaatttttttttgctcttaaagtttgaaattctatgaattatcctcacttaatgtgaaaagcagatatttggagacgtaatgtgtatggattcacttgttagtaacccatctcattaactgtttgcagagtggatctaagagttcaggtgatggtggaccaactcagagggcatcagcattggctgctctttcatctgcattcaacccatcttcccaaaagaataaggtattgttaacactcccaatgcacagcagaaaaaatataaaatttgttgatcttacaaactataagcaatgttgtgttctttttagggtaatgataggcctaaaagctctgatggtggacccactcagcgcgcttcagcaatggctgccttaacatcagcgttcaatccatcagcaaaacccaaaagcccaccacaacgtgcaggtcaaggttctcagcgagcagctgctgttgctgcgctgtctaatgttttgactgctgagggttcatctcaaagcccacgcataggtaggtcttccccaatggcaggtatgacttgtggcctactatttccttcccctgcatatattttaagggtaacaatatcaatttccttcatgtggtgctactaaccaataatagatattctaggcactgcatcgtttctttttgctagacatatttcatgaatagtcctgttcgtttccactacaaagagtggataaagttttggatattcgtggcacgcttttcgaactgctaaatggcgcgttttgcgtgaaacacttaatctttatcttcaggagatgcaaacactaccctaggtctctgcttattgtcctctgtaagcttataatgtgagacttttgatgcattgttgtgcattgattgttttgtaaattttggatgggcgatactgtactcattgactaactgcaagaacagtagatgaagacgatgcttgcaaaatttagagttaacaaatatttctttttgttgatgttggatcttgccaatttcaggtgatgcagatacagctgaactaactccgtctgctgcatccctctgtctgaaggagcatcagaatttttccgctgataaagatgcccccncgagattggggcattatctgaggaaggccgaactgagcctgacgtatcagtggaacagactgctaatgaaaatggaggtgaaacaaccttcagctatgatcggctgatatcaaaatctaccaaccctgttcgtgggatagattacaaacgcagagaggtttgttattttccttgcaaccttggaagcaaagtaggtgttatgtgttgtttctgctaccttgtgaaatggataagcacttaccttacccataaatatgtgagttaattacctgtgcaacataaaaaatgatatgagcacagccatataaaatagcaggagaaatgacttttagtaataaaactttggaggaactttgtaatagtaaaaccacagtaacaatgcatatgttgtttagtaactcgagtacataacagaagttgcagtgagttcaacaaggtttcagtattccaagtggatataacctggtgttatttcgtgcatgacttgcaacatgcaagcaagccactcaaaggtagagcaagccaactagatagtgccctcaaagaaatttagattataggaattgagcctagctcaattggtgggaggtttggttgcctttttttcccctcaattaaatgataccatgttcttctttggtatcccccattgttgctgtttgcatgtacatgtttggcttcagccagaccctttttgggattattgccaatcatctatctgccagacccttcaattttttcctgttttttcaaacttcaacggaaggattgatacatcgatagtattgtttttgtggttttgctctagtccttcaaaaaggaattgcaacagatattcttagtttaaaacaaaacagtggcaaactcacaattggtccattactagcaaccatctgtaatcacagcctttactgtctgctaatgcttcatatgaacaccttgataatgtgaatggtggcctgcatgagtttcaatggctaacttttgtgcggcttctgcagacatatttgtcggacagcgaattccagactgtatttggtataacgaaggaagagttctaccagcagccagggtggaaacaagaactacagaaaaggaagcatgatcttttctgaagcatgaatctctttcccactacaaaggctgcatgtttactagttttgcttgattggtgacatggtacgtgagaggccatgtttgccagcaatcttggtcatgtttcgaagacgattggccggtggcttactctgccgttatcccaagttttacagggtattctttatttgtacatggtctgctctatgcagcaccaagggcgtcactacattgttccgagctttgttctggttcttgtccatccatgtgtatattatttttaccctcaatttggcacaagcggttatttctagcgaggttttggaatgtattatgcacattgatgttcagacttccacttttttgtttctcttgtattgagattcctggtactgtcatactgtataaatcttcttattgttgagtggtgattatgcatggttctattcttattgcaattctgattgtccctcttttctttttccctttttttgcatggataaatctgattattctagtttcattatacctcgtattattctaaccacattaccaaaataacagaacatgcagggttacgatgtcacaaacatcgcctgggattaaacatatggtttgtttggaaacggtctcttcttttcgcttatgcttattgataaaatttgaatttcaaccttaaatttagagttgattgtagagctttttcatcgtagtttatttttcagcctttgcttttaaatcgtttagatcatgtatataacatttttattcaaaaattattttttatttataaatataccgtttggcttattctaccaaacaaccaaacatggggctgaaagtttctatccaaatagaaacttttcctaatagtatagcttttttagattttgagaattattttgataacttgtataattcagaaaatgaactaaaagctacaagttgggaaaccgctctcagaagctacctaccgtctagattttaaactacccagtccacagttactcctgtggtccttaacaaacatttctgaaatccctatcatccattacgccttaatggtggtgtttgaatctcctgaagatgaagataaagtttaagtgttttatgtaaaatgaggtggtaataacgtgtgattaattgagttttaattattacaaacttgaaaaatagattaatctcatattttaaaacaactttcatataaaaacttttcgcacgaaacacaccgtttagcagtttgaaaagcgtgccacttttattcaaaagtttatccagtttttattggagaaaagaatatggccaatacatcaattcatcatacatctgctccagcttcacaagctctcgagcgttttttctgtaccacatggtacacagggcaacaaacactgcaatgccaccgacgacgtacagagcgtcgaaccggcactcgctgcagatcttctcctccctcagcttgctttgcgccctcaggtatgagtggcatgacacgactccatcacctcctccaggtttccgctccgatgacagcatcccagtgcctccttcagcaccaccaggctgcgccgcccgtcgaaccgaccaccgcccatctcctcgatccgcatgctcagctcggtcagagtgagcgccaatgggggcgtctcccccgccatagccgtcacaacatggaactttatgagcaggacatactcagcgacctggcacggtagcagccagcaaggccgcctccttggccgggaggacggagccgaaccggacaacgaagctggcgttcgtcggccagtgtcgctgccctcccagagggtgccagctcgccaggttcaccgcttatggatgcaaacggacagacccgcgaacttacttatatgttaaataaagggtaatccacggattttcacgtcatgactcggcttgacgtgtcgtagaaaagcaagtagccgagtcatagaagtggaatggataggcaagtgatatgtattggtagacacctggagcagaagagaaaaaagggatgataattagtttgtaagcttagcatggcaagtgatatgtattgatagatcttgtaatttcatattttatatcaattgtacaaatgcagatacccattttatttaaacaacccgcacaagatagtatgatatttctattgatatagtaggaaaaatacaagtctatagtcctggaagactatagtcaggaaaaaaaagaaaaagatagtcacaacacgcatttacgtctgatcttgctactaaaaataaaccaagcacacaacaccccagaggaatggttcttctgaatgacgctaagagcgctgccgtcatccgtcctagagaaccaggacgtggttttcacctaaagaaaccattggataggagaaacgcaacaacaccccaacaagaatgcggcgcccgtaggcgtcgccgttgttggtccgagggctaaggccttcgccgtagtttcctccttcccgtgtcaatgcagatacccaattcacttctttgatgtattgagtagctttgaaggaaaaaaatgcacacagagagtatagaaattgtaagtttataacatatggtacatttctcttagttccacactattatctcaaaaggaaatataatagtggctggtgatggctataaatattaaatattatgacaaaagatttaacttttcaaacttcaaaactgaaatttatatttcagactaggtagaatatatagaagcttcctggtggcattgctcctagctataacctgtgttgttgcgcaatgatcaatcgaaaccacaatatcgactgaacggaaaaacagtcctagaggctagagtcgcttcatttctcaattaacttccgtttttgatcgaccccttctctctacgtacagaggagtgcccaaaatgaactaaaacaatccatacccatgaagcgcccataacactccaattacatatcaacccccacacagatctgtaactagaaagtggaaactgcagggttgtgcaaaatgttcaccgaccaataatctcacacggaaattctacagcttgaaactagagaatactaccaattactaccaatcaaccagagccatcatccccaaacgtaatactatgagtgtagagtcgtagagatgatccatgaacaacacgaaacaggaagaaagaaagaacaaaagagtggaaagattacagattgaggaataagaataagtggctatataaaaggattgattgatttcggcgtgcttttctatggaagggagatgatccagataatgtcagtttgggtagtagtctcattaattggcagaacatttgcaaacctaggaatttggggggcctcggtattctcaatttggaaaaattctcgcgagctttaaggctgcactggctctggtttggctggaaggaagataatagaccttggcataacattgaagtgccatgtgatgaattggacagagtgcttttttgagctggaacagtcattaccctgggaaatggaaagaaatgctccttttgttctgataactggcttcagggttgcttacctaaagatttagctctagggatcttcaacctgtccaggagaaaatgaaacaatgtgcacctcagccttcaaaacaaccactggctggcgatcctaaaccccattaccacgataagtgaaattgatgaactggtccggctgggtagccgattgtaagaagtcatgctccttaaaaacacccccgatgacattcgttggaaatcgactcccaatggagaatactcagcaaagagcgcttatgaagcacaattctaatgtatgatcactaacataaacttctctcccctatggaaggcccaggcggaaccaaaacatcgttttttcggctggctcattttgcattagagaaccctaacggcggaaaatttgctgagacgtcactggcaatgtaactggatatgaagtctgtgtacaaacactttcgaagatgcaaatcacttggccaaagaatgcagcttcataagaaatgtgtggaatttagtatgcagctggcttggttacaatctctcccccacaatcttggcaagacacacccatttcgaattggtgggattcctagatttttcttgcaaaaggagattcagcaaagaagaagattggcgctctactcacaacatggtggcaggtctggctcgagcgcaatcgtcgaatcttccatcataaatgctaaagcgaatcacaagtagcttgcacgatcaaagaaaatattgatttaattgagctttcgagataagcctaaaggctaggtctcagctgagtcgtttctcttctcctctgtaataggctttatgagtttattttcctttctggatgtcccctcttttctttgaaccttaatgtttttcgttttgtctgactctttttaccctaatatatccgccagagctcctgccgttaatctttcaaaaaaaaaattacagattgaggaagaagattaaaaaattacagattgaggaagaagattgggcgcctcacctcaccaaggaagttcatcagatggattggataatggatagtggataggggggaaaggcggcagtactaaaaacggcagagattgcattgcaattaacgtctctgcaactggaatggatcgataggccagccggccggccttgcgtggtctacggctacgccggctaagcgcatcggttgaaagcaagcaagcgctgcatctgtgggcttcccgtggtgtaccaagatcaggtctagctagaggcttaatttctggtacgaataatgtgtcaggctggccgatgtttgttagttgatgtattgaaatctactccatccatctcaaaatattatggattttgaatggatgtgatgcatcctaataccataaatctggacatagaatgtgtcgtatctatccaaaatcccttatatttcgagacggagggagtatcgtggttttcttattttttattttacagttttactgttgttgatgtatatatattttacttgattgcagtcaccttttctaatgcttatatgtctcctatctgtcccttccaaactttgaagtaaaacaatcaattgtttttatcctaatttcttatatatagtgttatctgtaccagaaaaaaattacagtacagctgtgattacggtgtaatttttaaaatttgttgtaattgtagagtaaaaaaatagactattttttataaaataatatgatactataaatatagtcttcttttactaagtcggacacaacccatgcacagcagttgaccggattaattagacgttttcttgaactggacaaaccgaacgacgataataacaaattaacaagtagacacaaattcttaaaactacatagagcattttatcatatacggaagcaaagttaagctgctggctaatgactaaacatgacaattagtgctaatctaatagtacatgtgtagccgggctaatgactaagcactgttatttaagcatctaatccaatgctggtgtcgggggattttttttttaatttttttgaactttttaatttttaattttaaaactaaatcatttcaaaatttatttataaaatctgaacctcttagcctcgccagcccgtctgacgtgacaaaacaataatagcatgtcacttgcagcgggcgtgacagttttatcttgccacgccagcgagagcgccgtggccaaataatgctgtcacgcgggcaacgttgatgtggccaaataacgctgtcacgccagcggagcggcgtaacagtattgttctcgcgtggacaaaagattcatatcttgaaaataaaatttggatgggtttatttttaaaattaaaaataaaaaataaaaaaatcgtgtcggggccctggatccgccactgatgcgcacaccgtattcacgcgtatatacatccatgcagatgcgtcctggcaccagcatacgtacgtctatgaagagattggccgtcaacgtctttacacccaagtactctacgaaaatacaagtatccatatccatgcatgtcaagtaaacgagttccatctaagtatgcaagttttaggataagggagcctgcataactaattgagctttcacttctacttggtattcaattaagtggagtactaagtatcttaaaaagatatccagagttgtacgattgaatttcttttcaaaacacgttacctacattgatattattatactcatcgatatgaacacccaaacacactcctacctggccctataaacatcacatactcgaaagataccacattgtgacattgacgaaattaccgtagatgcctcgctgttgatttgtaaatcagttacctagaaacaacaaaaatatcgtaaaatgtgggcacatatactacatcagagatttaaacctgagtagataggtttcatcataaaaaatctaaccagttgagcatatatcaattcatagtgcacgattattggattgtgctaacaactaggctagtaacatattaccattggacttactaccgcctcatgataaattttctcgctggtttacaagccacaatcaaaatttgaatttttacaatttaattttagagttgattttagggctttaaattgttctctatttttcaaccttgttttttggactacgtgctagtaatataaatagaagtataaaagtatattcaatctattttgattattttatttatttgttttatttcttattaaccgtagctcaaacaatctagattttgtgggatgaaattggtaaataggacagatggctagctagggtacacagggtagcacatttcccgtgctgcggaggtcaagcggtgtgtgagtgagtgtgatgtgtgaacatgttgtgcatgttttcgttgtatttatctagctagcaactatttgcaatgtttgatactagcttctaatgtgagagcaataaacttcactgtaaaattgtttactacatctatccttaaaaaaagtatatttttagatatgaatctagacatgaattctcccagccaacctatccaagttcataactaaaaagatatatggatgaatgtagtacctttttaaccctttcttgatttgtcaattgtttccaaaactaaaaaatgtgctgtggaggtcaagtggtgtgtgaatgagtatgatgtatgaacgtgttgtgcatgttttcgttgtatttatctagtaactatttgcaatgtttgctactagattctaaggtgagagcaataaacttcactatccatcctatatatatatatatatatatatatatatatatatatatatatatatttagatatgaaactagatatgagttctctcagccgacctattcaagttcataactaaaaagatatatggatgaatgtagtacttttttaaccccttctcgatttatcaattgtttccaaaactaaaaaaaaaagggagagaaaaacttcaaagtgtgtatatatgcaaccggggagtgataattaaggttattaaagaaaaataccatttcagatttctcgaaacgggtgatagctaggataggaataacattaacggctagaaaattggtggatgtgtatatctggatatatacaagaataacaggaaagtcaatcgtcggttaccataatctcacatattctcacaaatagctagtactaattaatacagtacataattacaacactcttactgacggatatacactgcagccaagagatagcactgtacaatgcccgtactattttcgtgtgactgttcgaccaagattctatttattgcattgttatccatgcttttcttggctggctcaaaattcgataccaattaattctgtcatacaggtcgacatatgcagatacatgttttcttctgattatctgattatggaaggcattaagacacggtatactactgtgcatatctgcatcagccagataggtcctgcagggactgtataaatacacaagagaggctatatacagttacctcgtcggaataaacctcacccctgtacaactccggccaccgattccggcgaccaagttggtacttgataaactccggcagctatcgattccgttccggcggccggctagcagctagctctgtggtcgatctcctcgcggtaggtgttaccctcttggttaatcaccgtccatttttcgtaatccagcttgaactgataagatgagtatagatgctttttgcttgcaaggttttgtgtcgcaatgctagtttctttttcttttttcttgttaatatccatttttctttttcttttatcaaaaaaaatatgtgggtgtaggggtggatctaggggggaaaaaagcaggggctaaaaaaaactagacaaagctccaacttatttttggcctttctgtatctatgtcggaaaattttggaggctcaagggtctctaataatccatatattagtagcgggcgctcaaaccccgtctccgtgatagatccatatatatgggtggtttttgtttgatctaaaaagatttttttttctttgtaatccttatgttgagcgatagatattttatttttatgtaagatatattagatatctaagttgaggctttttttaagggctaatatttttcattcacatagatctcaatgttattataatttttccatgtcatatataaacttaagaccgaactaatgcatcttgtttttacctttgacttttcattacttttcaataggacctaaaagggattagggagtcctaattgccctaggctttgtctttaccccttgtatgatgtgaacaccagacataggttcaataggaatgaatagtttgcggatacatatgagataatgttttgcgctatatgtcaaagttagaaggtggtgaacataaaacaaagttaaagtttcactgaataataactagcgacgatgaacataaagaaattattgaagtttaccctcaagaagtagtaatattaatgattgattttgttaattttgctagctagaatatgcatacaacagcagatgttatcatcctttttatttatacgtactgtcatccttttctcctttggtatagattggttttatgaagttgatggaaaattgaccacagatgagtttattattcattcatgaaccgtgaacttctcttaaaaaaagtaaaataaggaagttcaatgcgaataatctatatgggggattaattacttgtcaatgcttttcatgatatttaatgttttcgactgtaagattaacaaattgtgcagagatgtatttttcatgcatgataatttggaagtgcacccacattgttccatgaacttgcattgctagttttatgttaaattctcgttcacaacaaattaactagagacaattaattatcatgatatataggtaatttagcatcaaactgatcatttacaatcagcattactgtttttgaaaacaaaaaaaataaaaaaaaatgctatatcgttacaacggtggtttattttactaacatcatcatgacatcagcatgggatctaggtaccaaatactgttacctatgagtatcatgtatgataccccgatattagatatggttcctatgtttatcatgtctaatgctagtatcatataagtaccaaatttgtgccatgctggcgttatggtgatgccagaaataaagtattccattctggaatggtatagtgtcttctggtaatccttatttagaaaatgtattataaccatttaaatatagtatatgttccccttccatctcaaaatgtaaatgattttgggtagatgtaatctatagtccttaaaatgttagtagttctggtggtgtccattcccacaccatctctactactaccgtgtgagccccacaatctataccattacattatcttttaacgagtcctcccccgtttcaccgttggctctcagtacttggactaaataagtgtttgttaattgatttaataaattagaaactcaatttgttgtccgttacaaagcacaagctcttagctatcctaatattattaatctgaacaaacttatatcacatccatctaaaatctcgtatattatattttgggacgggggagtaagaatgatcgagtgcacgtacattttaggtcgtaaatttactatctttgcaaaaagtaattaacgatggcttatatacctcttctccggtgagcagctcaccttcatcaatggagtaccacgtcggcggtgtcatcggacagtcacccaagcccaaggtcgtcttcgtgctcggcgccaccgccaccggcaagtccaagctcgccatctccatcgccgagcggttccgcggcgaggtgatcaactccgacaagatccaggtgcacgacgggttccccatcatcacgaacaaggtcacagaggaggagcgcgccggcgtcccc

SEQ ID NO: 20404 - DNA, 3007 bp, Oryza sativa
aggcggccgacgacggcgagctcgccgccatgctcgacggcgccgtgcgcgagatcaaggccaacacctaccgcctcgccgcgacgcaggtggcgaagatccggcggctgagcgcgctggacgggtgggacgtgcggcgcgtggacgcgacggtggtggtggcgcgcatggcggagggggcgccgcacagggagacgtgggaggcggtggtgtggaagccgtgcgaggagatggtcggccgcttcctcgaggcgtccgccgccgtggatgacgatgacaatgccgccgccggttcgccggcggcgttggcaccgatgacggcggcgtgtcgcctgagggcgcagctggtgcagctgcaatactaattagaatggagtggcttggcgttggctagcgttagtgctactactataattaatatatatagtgcaagcagatcgcgtttgattagagtgacaattatatgtcgtcgaaagtacgttttgtgatggaagtaacatcatccagtcactataagtgggacccatatgtcatcagtttaattaaagagatgattttttttgcggggaaattaaagagatgattaggaagaaggttttccttatttattcacagtggagtgctattttacaaatagttctagtatataaatatagggagatggattttcataattggagaggacatgcattccctcgtttttttataccacctatatatatatagaaaaaatgataatataattaatacaaaatatatcacttcacagcctccatgttcaaatttgtaaacaaaacaaattaaaccaatactaattaatgtatgttcatagttatatatatttgtatatttcatggtaatgatggttttcttgcattttatattataagatgttttgatttttttaaacttttaaaatttaattgattttataggaaagcgtagcaacatctaatataacgccaaattaattttactaaatccgacatctatagaaatgttactacatgcctttatttttataaatttgtttgaatttaaaacaatttgattgaaaaaaaattcaaacattgtataatataaaacaaaggaagtatataattaaggtattgtagttcgttgttgcacgtggaatctcgtgtctggaactcgatgatctttagttccaagagaggaagcaaaggtagcggacggcagggttgatcgatggcgagtggcgagatccaatgccgactgcaaccgtgcaactaaccgccggcgccgccgtctgattcgctgcgacaagctgggctgctgggcagcagctaagcaaccgagatcatcgagacggtctcagaatctgattcggattggacaaccagtagtttaatcgatcgatcgcctgtatatatattttgggttagtttatcccgtacacatagaatcgattgatcgatcggcactacaatacagcgagcgagagagattgatcggtcgagagatgagtggatccgtgatgatgatgcagcggttggcgcgtcaagcggcacacgcggtcacccagcgtgccaggaatcagacggcggctacggctcgcggttaccaccacgccggcgtcgctgcagctggtggtaagaacgtgacgccggcggcggcggcggcgcggcgacatccggacgtggtagtgacgatagaggaagcagcaggtgcagggccgcggccatcgtcgacgtcgcaggaggacgcggcgaggaggcttcgttggctactctacgaggcttccttttggagaggttgctccgtttactttgctggtgtcgccgccgccagggtgatggctcgataattaggtggtcactcgtcgccgcagatttctacgtacgtagctagtagaattatttgtctcttaattttccagcatcagcgcaagaaaagggcaataatcgatctatagaatccatatgtagctaacctctgtgtgtgtgtgattgttgtgtgccgtaatgcataattaattaagctgcagaaatagaagaatgcaagcggcggtgacgaaataaatgaatatgccaggtgttctagtgatgcatgcatccaatcgatagctgaatcaggcatgccccttatacgtgccaagttaatttaaaatccacacacacacacacacatatatatgtgaggctttttacatcctactgacaccttaagcgggattgaaattaaaaagggcacctataacactttatatgtgctgatttattaaaaattcggcaataataacaaaagtgtcaggttttaatatacctgcacttattgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcatccacgtcaagccgcgacgacaacgacgatgtccggcgcctcttcctccacgatctcctcaaccggtcggtatctaaaccctctccctttcatctacaatgtcgttcatcaaacccaaatagaaccacccgactagatctaacctaggtgatcctagtgcaaagtttaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgttgacgccggcaacggagggggggaggggcaaagaggcgccgcctaggagccactcgacggccgcgcgcgcacctgcacgcgcgtgccgcgagggggcccgcggcggcgccgccatctccgtcgtcgacatctctctctcacacggtgggggttagagacggtggggggagc

SEQ ID NO: 20405 - DNA, 4271 bp, Oryza sativa
  unsure (1)..(4271): unsure at all n locations
atttgaaccaacgggagaattttcacagagagagaattacagagattttgctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtacaatggaggtggtgttagagaccacatacttagaatgagcaacatggcttccaagttgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcagcaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggaatgcatagaatgcattaaaggaaaatttgtaaagagcatcaaaaagggtgcaaaacgaagcgcaggaattttagagatcattcatacagatatttgtggtccatttcctgtgaaaagtgtggatggctatgactcgttcataacattcacagatgattactcccgctatggttatatttatccaattaaagagcgatcagaagccctggataaatttaagatattcaaagctgaagttgaaaatcagcatgatataaagattaaagtagtaagatctgaccgtgggggggagtactatggtcgacatacgcgttatgggcaagtccctgatccatttgcaaggttcgcgctagagaatggaatagtagcccagtattcaacaccgggcgaacctcaacagaatggggtagctgaaaggcgcaaccgtacgcttatggatatggtgcgcagcatgatgagctactccacactaccactcggtttatggatggaggcgttaaaaaccgccattcatattctcaacagagttccaagcaaatcggtgcccaaaacaccgtatgagctatggacagggagagtaccctcgctaactcacctccgtgtgtgggggagtcctgcagaggccaaagtatttaacccaaatattgggaagttggaccccaaaacagtcagttgccattttattggctatcctgaaagatcaaaaggctatcgtttctactgtccaaacagttatacaaagtttgtagaaacgagacacgacgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacgccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatannnnnnnnnnnnnnnnnnnnnnnnnnnnnnnnnnnnnnnnnnnnnnnnnnnnnnnnnn

SEQ ID NO: 20406 - DNA, 7343 bp, Oryza sativa
  unsure (1)..(7343): unsure at all n locations
ttcaacatgtacagatgcagggctacacctgctcctataatgaagggcaaaaagtatggggcatcgcattgtcccaaaaatcagtatgagctcaatgaaatgaaaacaaagccatatgcgtcagctgtaggaagcctacagtacgcccaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacactcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccgcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcaggggcgcccaacccaatggctggtgggcccccgtcacactgcgccatataaaagaggggtggaggccggtacggcacatggaactagatttaccgacgtcaacaacttcaccccacaataaccctaatccgatcgagaagggtcgccaccagtgaccggaaacggcaccggcctatgcatgtcaagccgctacgacaactacgatgtccggcgcctattgctacacgacctcctcaaccagaaggtatctaaaccctctacctttcatcaacaatgtcgttcatcaaacccatatagaaccacccgactagatctaaccttagtgatcctagcgcaaagtttaacacttatatgcggaataaaagtgttggtttaaaaaaaagaaaaaaactaacgcttcattggagccaagccgagctgagcgtgagcatgggagaagagaaaaaaaaacatctttttaagtctcatccctatcctcccaacgctatcgtcatcaatatccaattcttctctctcgttcgctctcatcattttgtccttgctccctctctctcgtctccccacccgagcttggttggtgagtggcggccggacgcctctgctaggcacaaccaccataggcacggggatggtttttttcgctctccccggtgcaacagcgactgcgtcttcctccgtcgtcttcctctcccctatgcagcggccatccgattccaccaacacaaaaggttctccactcgtgcctccctctcctctcctctactctcatgtcccgtgaggtggagaaggatgcgcgggggctagatccggcagcccccgagctcggcaccaccacgacggcgaggaggaggactggcgaagagtggcgatggtgataggcttggccttcggtgagcaactaatggccgcgatagcctcggtggactatgattcggtttttgtagttaaccttttgtgttgaatgttgatattctatatatcattcggtgattattctaatttgtgatggattaggattaaatttttgcgttggatttgtaattggattgggattaagtccttggctcaaaacatgtgctcaattcgagccgaagccgatgcgtcgagccacattattttttcatttctagaacctcaaaggtgcaccaacatctatgattctccacatcagtgtcggttacgaagtctagtatctatgtgggattctcaaatggcacccattaggtattctatagtaatgaggtggtttgttgttaaatatagtttctcagtataagaactattagcaatactaaaaaagagagatgcaaaatgcatgagccaataaaacttgcatccgagtctcaactgttcggctgctcagcttcttcatgacatacttgaggcttcatcggttggtgagtgggtcatgactatagatggccataaggcccgcccggcctaggcacggctagacacggcccaccagctatcggaccagcatggcccggtcggcacttcgtgccgggccgtgctggcccatgggctacacctccagccctgccacggccccgtgtcgtgtcggtccgaagacacgggtggtctatcgtgcctttttttaaataagtctattttctctccctcctcgttgggctgtgacatatgtatatatatagctaaaataagtccatttttcctccctcctctttgggctgacatattatatatatatatatatatatatatatatatatatatatatatatatatatatatatatatataccccattcaaatgagtatgaaactttttcaattacttaggtattaacattaaccactttactaactagttcaaagcatgtttgtactgaatttgaacttgtttttgttagattttgattctaggtatatagcatccatacatataattatttaggtacgtaatcactgattgtgaaataaagttaaatttgagttgttttgttgataagtataggtatgaatcgaattattataactaggtatatactcacaatttaaaaattttgaaaattttgagtgattttgtgcattagataccatggtgcccgggcaccatggtgccccatatgagtgtcctatatatatatatatatatatatatatatatatatagctaaaataagtctatttttagtccctattctttgtgtgtcgggcctggcctgtcggcccatcgtgccgtgccgtcccggtcattttgggccagcccaacgtgccagtggggggcctaggcacggcccggtggtcgggccgtgccgtgcttgggctgggccaaaatgtcatgccgtgggccaggccgtcgggcctcgggccttttggccatctatagtcatgacatgtcgacgtgttgtgctcctttgatggccaatccaaaaacccgaaagttttggccgtcttaccgagtctctgaaaatctcgacaccgcctatctataaatcttggcttcgcctcttatcacaagcatcctcttaattttaatggtgcatgaaattttattaccttaaaaaatattaatatttatgtgagggtgattttgttttatttaaaaaaagcacattcttttgttctattttgaacttgttaccttttcttctcaacggttgtgattttttttgaaacagggtacagacacatgcgcctatataagtgagcacacttgcacaccctatcttataagtactctaaaactaaatcggcatgatattcacaagtcaccacaagcgcatcaatagtgacatgtaagtcgtttatcgctaaaagaataaattttaattaccctcacaacatatataaattggagttctcattgttaggtgtatcttgagattcacgaagtcaactattatgatctttttctaattaccctcacaacatatatagatttaaaggtaaataaattatttaaaccatggaatgttgaactccgtggtatatcttcagctcaccaacaaagtatgcatgataagcaacatatgcttcattagcagactactgagttatctatctcatcaaatattttctttgttcattgtccgacactgaaagtattatatgggaagacattaaaacatacatggtcatgaccgtgtgagggtaggtggttactatgtgtgtatggatctcacctgcctagataccgtggagatactcattggagtactactgcctggcggtataatatttgtggtgtagctcatattttttttttagattttcaagcaatttttctttcataggatgcatttttaggcctagtttagttccgaaaacaaaaacttttcacccatcacatcgaatgtttggacacatacatggagtattaaacgtggaaaaaaacctaattacagagttcgagtgtaaattgtgagacgaatcttttaagcctaattgcgtcatgatttgacaatgtggtgctacagcaaacatttgctaataatagattaattaggcttaataaattcgtctcgcagtttcctaacggaatctgtaatttgttttgttattagactacgtttaatacttcaaatatgtgtccgaatatccgatgtgacaatcaaacccaaaattttttccaactaaacaaggccttaatgaaggggagagcatttctgtattcctatcttactataaagttatcccccactaactccttaaacttaacatgcaaagataccacatcatcatccactaattaacaagatgccacatcatcatccactaacaatcatcacattaaacatcatgcaaacatgctatatctttattctttttataatttaagagcttttcaaatacaaacatgttaaattatcatccaacataattcacataatgtttcaatgaatatctttattatgttttatgatatcctatatacttatttagttcatcctcacttagttagtgcttaaatgattaatctatggtccaaattatctttttcctttttttcctctaattaagtcatatcacataaattgtttttagcttttagatgattaatctatggtccaaactatctccctacttttttcttccataaagtcataccacctcactttttacgtttgaatcaccattctacatactatttaaatttaaattatcataaaccacattaatttacttaatctgatgttatatagctatcttacacgttattttttttttgttatcatactaaattcccgcagcaatgcgcggagtttcacctagttgttttaattgaaaggctttaaaaatccatcttcttgctttgagccaaaagtcgtcccatctcccttctcttcccttctcctcgcacgctactgattcacttccttctttttcttactccctctgtgtctcattttaagtacaaccataagttttcgcgctcaactttgatcgtccgtcttatttgaaatttttttataattagtatttttattgttatgagatgataaaacatgtatagtactttacttgtgatttatgtttttaaaatttttttaaaatttttttaaataagacggacgatcaaaattgggcatgaaaaatcatggctatacttaaaatgggaggagggagcattgtgcatgtgtcctattcaacccattgatgcgtcagggcagtgtagctcacccataccctcttattcctgacaagtgggactgtttattttattttattttgttcttgttgcttccctctgttttgcattataattttttttgaacttttaagtcaaactttttaaatttaaaatttatagaaaaatgtagtggtatctatacaataacaaattagtttcacgtactaaagctaacacatgatatattttgacaatatatttgtttgtgttagaaatattactacgttttttaagagagaattgcacattggaccatgtatttttacccatgttatactttggactaaggttacaatacacttttcactttagaccaggtttctttgcaaaatgttttacattgtacctgtcttctcctccagctgccccatctctctcctctctttcttcttcttctttgttgtgacccaaggttacggacaagattgggggatagacgagaaaacaccattttcccgcctatcatgaggaatgagcccgaatacaaaatgtacacacgctttgaccgatgagatttttagtattccaatatgtcctgtctgctacaggctttttatctactttatatagttcatagctgtacatgtgagattacaattgtgcccctcattgggcccatgtgagattacaattgccccccgccacatcagcaatcccaagattattttggtatatttcaggggtcattatagtcttttggcgcaagctagatagagtgttcaagtggtccccgagaatattctcttggcatctttattgctcaaattgccttcttcatgaccgagagccttttccaccaccaagggtcttctccatgggtcttttctacggcaagttgtcttttccatctcgaccacccttttcggcttacctggcaattgacctgtcattaacttagaaaacactcaaaacatatgatttggcttagtagcaagaacttgctcgaatagtgttttccaactcgaatggtattttaccgttttcctgttcgaatgactctttgccacccggatacttagaataaagactcaatctcctccttagtagtgttttgggccgaatatggaggaatggtggtgacccctgccacaacattcttcaagagccacgcagatctgagcaagtagccatgagcagggcacaacgagatcaagccgcccctgcccagtgcccacatagttctgttcgttggctccttaatgactaggaaaatgagcagatggtctccacgcttatgctttctgaaggctccaacttcttcgctgccctgagctcaagcaccacactgctcatgcttgtcattgttgcctttggtcctgtgccagttgagctaccttcacattcacttctcctatctgttgcgacaccaccgacttgacacatgtcattacttctttccctggaactttgaaatccttcccctgccgctacctaggcttacctttacattttcgaaagcttaggaaagtggatttcttgcctctaattgaaaagattggatcgcgtctccctagctggaaaggacgctactttacgtcagaagggagaagaattcttgtgcaatcagtgttaagtgcattgaagacctttcatctaactgcccttcaagctcccaaatnnnnnnnnnnnnnnnnnnnnnnnnnnnnnnnnnnnnnnnnnnnnnnnnnnnnnnnnn

SEQ ID NO: 20407 - DNA, 987 bp, Oryza sativa
  unsure (1)..(987): unsure at all n locations
cccacatagttctgttcgttggctccttaatgactaggaaaatgagcagatggtctccacgcttatgctttctgaaggctccaacttcttcgctgccctgagctcaagcaccacactgctcatgcttgtcattgttgcctttggtcctgtgccagttgagctaccttcacattcacttctcctatctgttgcgacaccaccgacttgacacatgtcattacttctttccctggaactttgaaatccttcccctgccgctacctaggcttacctttacattttcgaaagcttaggaaagtggatttcttgcctctaattgaaaagattggatcgcgtctccctagctggaaaggacgctactttacgtcagaagggagaagaattcttgtgcaatcagtgttaagtgcattgccgacctttcatctaactgcccttcaagctcccaaatgggtaatcagcagaatagatcgttaccgcagatccttcttatggaagggagaagacccagacaaaacaaatccgggaagtagcttggttaattggggtacagtctgtagacctaaatttttaggaggccttggaattccagaccttgagaaattttctcgcgctctaagactacggtggctctggttcaaatggaaagaggacaacaagccttgggttggaatggatttaccttgtgatgactgcgacaaaagactcttttaggctgccactacgataactgtgggtaatggagaaaaaacaaattttggcatgataaatggctgcaaaatacatgtccaaaagacattgcacccttgtgtttcaacctagctaagcgcaaacagagatcggttaaaacggaattgacaaacaattcttggctcctttcctttcggcaaataactacaattgaagaaattagcgatcttgtccagcttggggnnnnnnnnnnnnnnnnnnnnnnnnnnnnnnnnnnnnnnnnnnnnnnnnnnnnnnnnn

SEQ ID NO: 20408 - DNA, 853 bp, Oryza sativa
tttatccatgcaaaaaagaggaaaaaggaaagaagggcaatcaggaatttcaataagaatagaaccatgcataatcaccactcaccaataagaagatttatacagtatgacagtaccaggaatctcaatacaagagaaacaaaaaagtggaagtctgaacatcaatgtgcataatacattccaaaacctcgctagaaataaccgcttgtgccaaattgagggtaaaaataatatacacatggatggacaagaaccagaacaaagctcggaacaatgtagtgacgcccttggtgctgcatagagcagaccatgtacaaataaagaataccctgtaaaacttgggataacggcagagtaagccaccggccaatcgtcttcgaaacatgaccaagattgctggcaaacatggcctctcacgtaccatgtcaccaatcaagcaaaactagtaaacatgcagcctttgtagtgggaaagagattcatgcttcagaaaagatcatgcttccttttctgtagttcttgtttccaccctggctgctggtagaactcttccttcgttataccaaatacagtctggaattcgctgtccgacaaatatgtctgcagaagccgcacaaaagttagccattgaaactcatgcaggccaccattcacattatcaaggtgttcatatgaagcattagcagacagtaaaggctgtgattacagatggttgctagtaatggaccaattgtgagtttgccactgttttgttttaaactaagaatatctgttgcaattcctttttgaaggactagagcaaaaccacaaaaacaatactatcgatgtatcaatccttccgttgaagtttgaaa

SEQ ID NO: 20409 - DNA, 262 bp, Oryza sativa
cccggagctcgcgcggatgtccttcagtttctggacgacggccttaagcctattgaccgactcgtccttgccaacgagctgcatgcttgccgatcttgccaatggatgaagatcctactaggctgaccttgccgtcgttgcgggagaccgcagaagggcagcggcgggcaagcggagacggcggcgagcgggggagatgcgggcatggcggggagtgaagacggcggcatccggcggtggccgccatggaaagggcgaggtc

SEQ ID NO: 20410 - DNA, 778 bp, Oryza sativa
  unsure (1)..(778): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgagcgggattatcttcttcctcggcgagtgcctcgttagctggcagtcggtcaagcagcaggtggtggccctgtccagctgcgaggccgagtacatggcggcctccgccgcttcgacccaggcgctctggcttgctcgactgcttagtgatctcctcggcagagacactggagcggtggagcttagggtagatagcaagtccgccctggccatggcaaagaacatcgtttttcacgaacggagcaaccacatccgggtgaggtaccacttcatccgaggctacttggaagggagcatcaaggcgagctacatcaacaccaaggaccagcttgcggacttgctcaccaagcctcttgggaggatcaagttcctcgagctctactccaggatcgggatggcccaacttccccacaagacgacgcacaagacttagggggagaatgatggataagtctttgtggtccttggtcgtgggtacttccttttcttttgagtagtttcaccttttcaggacannnnnnnnnnnnnnnnnnnnnnnnnnnnnnnnnnnnnnnnnnnnnnnnnnnnnnnnn

SEQ ID NO: 20411 - DNA, 867 bp, Oryza sativa
  unsure (1)..(867): unsure at all n locations
nnnnnnnnnnnnnnnnnnnnnnnnnnnnnnnnnnnnnnnnnnnnnnnnnnnnnnnnnnnnnnnatcggttccctatttacccgattcctgggggaaataaccgtttcttataatatggtaataaccatattctaaatatgtcgatatttatagagcatgtctatacttgacccgcagctacatatgactgactcttcaatcaaatctctaacttttgtacatggctaaaatgaagttaatttataatttatatagtataagcttgaatttatgtatacatataacatacttatgtaaagttaaatatatgtttttatagtttaatgtatccgtatttgttacctgtttccatctgtaccgacatgtttccgtccgtattgttccgttttcggttttccgatatttccgatatcgttttcgtttccgaatttaccatttccgatttcatttccgagaaaaatatggttacggaaatggttgaggctgttttccgatcgtttccgcccgttttcatccctataaatggtaacctgagtactcgaccttttctccttaaatttggatgcgtggtagttaagatgttgtgcactcgtgttctgctaactaatatcggacacaagatgactagatgagtcgtgcagtacactacggcttcttgagatagccaaaactcaaaggatgaagggtacgtgtgcaagaatccacagattaacaaggaaaaaatgcgctccctgacctcgattgatccatgtgacgtcttcttttaaaaatatagataacaggtacgtatcatatgagttatctccagtgaagtccatagagcatgtactccttttcttaactttattaaaaggtgatttgtaggcg

SEQ ID NO: 20412 - DNA, 664 bp, Oryza sativa
  unsure (1)..(664): unsure at all n locations
caacttacccgttcgcctcgcggttgccgaacacaccgtcgctgacatgcagcgcgcgctggattcttccatcggggaggccgaggccctccgcttggcgggcgagatggggcccgacatgctttgggactcggtctcccgcatggatcgcgccggtcggcaagcgggcctctggaaaggccagacgaggacgcgcccttgcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctgatggcgctggaggagttccctcccgggaccgaggacgacgcgcgcgcgcgggtcggggatgctgccgaccacatcgtcaacggcttcgaggggtcggcccctcggctcgcgttcgtctccagctccgacgaggagggcgacgcnncagccgggtgaggaattgacgggtggcgacgaggccggctacccgggcgcatcggaatgagcccccgagcccccgcccatccttacctttttttctttttctttcttctaaggccttcatgcctcgggtaccgagctcgaattcgcctat

SEQ ID NO: 20413 - DNA, 247 bp, Oryza sativa
cagactgcctacgccaagcgcatcgtcgagttgggcgggctcaccgcctgcaacccagcctacactcccatggaggaaaggttgaagctgagccgcgacaacacggctgaggaggtcgatgccacgcagtaccggcgtattgtgggcagccttcgctacctcgtccacacgcggccagacttggcatttgctgttggctatgtcagccggttcatgcagcgaccgacgacagagcaccagcaggctg

SEQ ID NO: 20414 - DNA, 746 bp, Oryza sativa
agttttgtgatagattgatcaaagtatctgtagttttgtgaaatttactctattaagaaatatgggtgaccggtgaggaccttaacttgttcgtgtctcgcagggcatcaatgtcgcgcctgaggatgcagtcgctgtctatgtacaaggcctccaggagagggcagctctggatgatcgccgagattccttccttgcttacatggtcgcatttgacgaggcgaatgctcctcaggtatggtgcgctgcaaacgttcaaggttttgttgttgaaatgatcagtaattcagtacttatattcagtagtagttcagtcacagtactccctgaagaacaatctatatatatgtatgaaattattgatcatacgagttgggtttcaaccatgataatataaatgttttataatgaatgattttgggcatatatacatatgaaaatgacgtaactaagaaaatttttcatgggcatgtcaagttaatttgtgtttagttttcacttgtgtcaaggagccaaaatctgttccaagtatttttcatggtagtaaacttgtatatatattttcactcgtgtcaaagattcaagctagctgccaaattatgaatttatgttttttttacatttaatatgattgttagaaatatcattatatattttattctattcttttattaaccccatcttatcatgcacctaactgattattcatgccgatcatcactcatcaggatatataattaatctgt

SEQ ID NO: 20415 - DNA, 672 bp, Oryza sativa
  unsure (1)..(672): unsure at all n locations
nnnnnnnnnnnnnnnnnnnnnnnnnnnnnnnnnnnnnnnnnnnnnnnnnnnnnnnnnnnnnagtcactattcattgccccctaggtgtttgatcgcgttccctagccctagccctcctctgccgcgttgccctcgcgccccgcgcgccgcgcgccgctccacctcccctctgccgtcgccgtcgccatcaccgcgcgtgccgcctgccgccgcgccgacgtcgccgagccgccccgagcccgcgccgacatcgccaaccctatgccgcgcgtgctgccgtcccgttgccgcgtcgcctcgagccccgagcagccgtcccgtcgccgcgtcgccgccgtcgccgtcaagcccgcaccgcgccgcgccgcgtcgtcccatcgtcgctgtcgcgccgtgccgtcgtgtcgccgcccatcgcatcccgccccgagccgcgcgccaccgctgtcgccgtcgccatcaacgtcccgtcgccgcgcgcgtcccatcgccgctgccgcgccgcgtgccgtctcgtcgcctcgcgccgcgagcccgccgccttgcgccccgcgccgacgggccgccgtcgtttcacccttcctcctccttcccctctctttcttcccctcttccctataaagactccagcccaatccccccctttttcaccccactccattccctcctctt

SEQ ID NO: 20416 - DNA, 817 bp, Oryza sativa
ataccttgcaacctattcttctggcatactccgtactatgccttcgatgcgtctagctaggctcgcctgaagttggattcttgctttccaaatttcaaaagtacaatttctgcagcaatgccctgaaatgagcaatatatataagcatctaacatttgaatgattccaaaggttcggatattctgtagagctgtatgggggtaaccgggtaacataattaagcttaccaaattaaagtaaagtccgttgcaatcttgttgatcaaaagcgtttgtacgtatgccagatttgcttcggggttttgatgcttcaatgaaaggaaaatcgctcatgtaggtacttaaaccagtattttgaaactaatgagttgctaatgagtatttattaataaatcatatgctaagagcacctgcaatggtaaagtaaggtgctatctataaaacatatacatctcagcaatagactagattaataataaaccgcctcaatagtatgtctacatgggtatctatagctctctcatgcattgtctcgtttttctctatagactatctctaaattagtagatagctttgctctctctcttcatttaatatcttccatgtaggaaaatatgctgacatagatctcttatagagagcctatagataaccattgtgggtgccataatgagttgtttcgttttgcgtgtgctagagattagtttccaacatcaacattcgaacacagccttaattaatcaaattcgacactcttcttggtattgctacccaaaacaaatactcacaataaaaatttatggagggagttttaaata

SEQ ID NO: 20417 - DNA, 700 bp, Oryza sativa
  unsure (1)..(700): unsure at all n locations
nnnnnnnnnnnnnnnnnnnnnnnnnnnnnnnnnnnnnncaaattcatatacgttgttctagttattttaaactaaatacttttaaaattattgatagtcaagttataaaagtttgattacaaccttatccaaaacgtcaagaattataaaaccgggtgaagtaattatagaacttgagtagttttgcgagcggttttggtcctacatgacagtttaatcaacaattttcttttaagaaaatatgggacccacctttcagattctatctactgatctgtatctttttcccctctcacctctatctctatctctctatccctggctgaggagtcgcgacggctacaagcctactcttgcgcatgctagcggaggcccagtaggagcggcgatgactacggggcttctcgcgcaagtgcccgcagagactgagaatgagaagtgtgagtcctctcgcatgcgccggaggaggctgagaacgagtggcacaagctacggggcatcttgcgcacgcgctggcagaggccaaggaggaactgaggtggctacaagcattctcacacacgacaatgtcagtgtgcgtggtggtggagatgacgtggccaaagcagctttagtcatgaagctcggcgagacgtgctacggcatcactacctgggaggatgcgacggagagggtcgcattggtgcaagttcgctgcttc

SEQ ID NO: 20418 - DNA, 960 bp, Oryza sativa
caaacatgaagctacattttgaatgaggcctcgtttgaatggaaatttgaaaagaatttccggcccatataagtgggtgggccaggacttcagcccatccaaatgtggcgttgtagcctccgtgtactagcacggagtaattgccgcccaccgcccgcgtctgctcagctggtttaaatttgaatccggcgagcaaaccaataactcttccctcttcagtcttcgctcagactcctcgccatttgagccatcttccgttgagacgtgtaagctcgaatctttcatcttcccatctgatttcgccaagttgtttctacaaagatttgcttgcgatttcttttgtcttggcagattcgaatccgggaacggaggttggaggttactgagaaccagttcgacgaggaggcgcgcgcagcctgttcggcggaatgctcgggaggaacgccatgctcgggccgccgcgccgtggcgagggggagacgtcccggcgtggagagggaagcgaaggcgacggcaatggcgagggcgacgcggttgaccggctcagcgccctctcggacggggtgctgcaccacatcatgtcgttcctcaaggcctgggaggtggtgcgcacctgcgtgctctcgcgtcgctggcgccacacctgggcgtccgcgccctgcatcgacctccgcgtccggtacaatgacgttgacagcgagccgccggaggagctgcgcgatttcgtgaaccgcctcttccgccgtagggaggcgtcagcgccggtggacacgctccgcctgcagtccagcgacccggacgagttgtttgacaacgacgatgccaacgcgtggatccggactgccatcaaccgcaatgctcgattcattcatctcactggacaccgtacagagatcggggtgttaaagcacagggccttggtctctacccacctcaagatcttgaagctgtcctatgtcc

SEQ ID NO: 20419 - DNA, 6126 bp, Oryza sativa
  unsure (1)..(6126): unsure at all n locations
nnnnnnnnnnnnnnnnnnnnnnnnnnnnnnnnnnnnnnnnnnnnnnnnnnnnnnnnnnnnnnnnctaatcaccatttcaacatgctgaagaaacagtttttcttttaccactcacctggtctctgggtgtccagttagcacatctgatacttctgcactgcagtatcaattaacaatagctactagtggaggcattctgggtttcccatcatctgtcttaggcattcaatatactattaaaaccctcaagtttgcagctttgggaaagtattgttcttatcttttgaaatagcttgctgttttttgttgtcacaataatttatcttttgacattagttaagattcccatagaaattcccatctgtacaattttgttcaagaaaatacactttgtaggagtaggtgataatctgctcacaatatatcactaagttattgtttttattctcaatgtattgaatatcacttgtatgcatgatgtgaagttgattcagtatttcaattaccatagttcattgctgaaaaatcacttttgtgcccaatatgaaggtggttctttctagggagttgaaaagctgcccaatttttagcaacttgaagaccttgtcccttggtgaatggtgtatggctgctgaattcgatacattaatcttcttgctacagcgttcacctaatttgcagaggcttttccttaaacttaaattggtaagttacctaacgcttataaagaggtatgaatatgtatgatagtttaataaattccattgttctgcaaaaagaacttcaatactaggaagccgttggagagcggtgctaaacctatgggaagatcatttacttgtaaagacctgcaaatggtgaagatcagatgctctaaggatgatgtaagagtgcacacactggcatgtttgttcagagcgaacggtattcccattgagaagatttatgtccgtcggactgggagttcttgtaagttagatggtttcttcatgtcattttgtatttttttttgcactatcagtgctaaattacccatgtctttgctgtttagttcaagcatgtgctaaattatgctcgtctatgctgttttttttttaaagatgttctatacatattgccatgttcccaataggcttgatatcttaccaggcttttctgttaaaacaccctaaggctatcctgttcaattaaacattgtgtttttgggcatgatcttaatgtgtgtacttacccgctttctgatatttctaccagacctccgtggcgagaagtttatgagagacctaggcaaacatgaactggagttctgggggtcagattcagagttctgtggtccaaattccgagttctgtggttcagattcagagtttgaggattcagatatggagttctgatgcaacattggactagctatcgtttatcatatcttctactcatattattagttattatctttggattgcaaccatctctaattaatgtactacttagaaaatgctctgacggcaagaacccattaagtaccgagttgcagggccgtgacagatgttgttatgtgtcttttgcgtaatagggaactatgtatggctatccaaatactgaaatgctcttatccagtgcaatgagttaacagtgaaaatgttttgaagttttttttttatatatatatactataaacgtgcatgaatgctctttgcttgaatgtctcaatggattacatgcacctttgctgcataatatgcactattttgtgcctgagacccgcttttttgaagatttaccattcatgtctatttcctattggaatggagtcatgtagtaataatgtccagtcgaagccactgtcatctttacctctatttgctcctttgcacccatatcagctttacctgtagcatatactattatttgaattttacagttcagtagacgtcgaacgtggtgcactacaggttaaagcaatgttctggccttctgggtgttgttaactcagaaaattccatttaactaatgtttctgctgtcaccttttattgtaaactgatgagttaatgtttgcctgagattaaataggtgatttcaatgtctattctgaactcgttttgatcttatttcgtgtgtattagaaaacgtattcaattttctaatggattgttagttgttacaacagtagatccaaaaatgcaatatttgttcatcccatgaacaatagcttatactgcaatgggatattatttttagttccaacgaaataaaactctctcctgttataaatttcatatttaactagaaaaaatgcatgtgctttgctacgggaaaaaaaactcatttatgactctgattgtgtattactcacttcatccaaaagtcttacgtgtaacttttttgtcaccaggactaagcagaaattaactcatctctcatgtaacaaagatcaaatgtttaataagaaacactgttttccaagcatgtgggagagcgccaagccaacactgttttccaagcatgtgggagagcgccaagccaccaaccagtaaactgattataaatgtctatactatgaaatgggaatttatgatcagttttataactaggcttataattatgtttatatttgaatatttttaaaaataaaatcttacggtagtttttcagcgattcttatctatgagccgacgtggcattgctgacaattttgtaggcaacggcgtcaatggagtccgtaccaatatggttttcatgtatggaacggtctgttattgcactggacataaacaaaaatcggaaagtgtgtgtatcatttcctatgtattaaagaatatatttctgttggtaaataattttatgaatttgcacatagcatctactgtccactaaaaccacatacattctattgtaatgcaagtaattttaatgcacaaaaataccctttgtgtataaaaaaatagtattcactcatctgaacatgttaattagtctgggctcctcaaggagagataatatggagagataatctcttatatgccactgaaaattagtctaatcccttatatgccactgaaaattggctcttcccttatatgtcataggtccaaacttacacatcctctcatgccactctcgtcagatgactgtgtgttgaccattaactttaaagtaaaaaagacgtattttctgatatataagggatcagactaattttcaatgacatataagggattatcccaaccaaataatgtagacaacgtagagaggctgagaagtgggccaacaaagtgcatttgcaattagtttctttcatataaggttactactataaaagattttgagaaaaataatgattaaaaaaatagcagggctgaaatataagaagtggagggctgaaatgaaaaaaaaaaactatgtgagacggtgagagggttagccttcattgtagtttgtagagctaggatattcaaagtgctcccatcctatttttttccacctaattgggcctttctcttctctgtccccattaactagtcctaattatctgtgtttttttcccacttacagaagaggatgaggcgtcgggatggcgagtcatatccggagtttttccccctttcttctcactccaactgatgagtggacgaagcagacgactctctccctcatcggagacctcatctgctcgcgggagtcggatctgttgtgctggagtcgaagagctcgccagcggtcaaatccatggtgcggattcaggggcagcgtgagcaagccaggctagctccctggtaggcccccgtccctctcgcctcactctctcttcctccgtcctagcctaaattgggcgcaagtgatgcggattgagtgcagccgcacccaacgggcctttcacctcatttgaagaaaacatagcgatttttatcttggttggatcagttcctatttatttttgattccgtgagattatatttgattacgcatcttctatgacttgatttcttttaatcttattcttggattcgatttcagttaccataaacatgtttctaggtccgatttatttacaagataggattattttgagggaatttgggttgcatctgtttgtttttgtgttcatgctttcaagtgacttttgaggtgagacggcattgagacacgtgcggagcatttgagacaggtgtgaagggcaacaacgtgccaacgtgagggaagcggaggctcacaccgtgacggaggaaagcggactatcacggacgaaggcgtaatgtgaagatcagaaacatatgaattttttaattagttaagactagaaaaaaatacccgtgcattgcaacgggtgaaggttattttattcttattatattatacggtttagttaagatgaaattcactttgggaattcgctttaatatataactttttagaaaatcgtgaactacaattaagagtccgatcgtctcaagttagcgtgcgagttttttttataagagatttcttatacgactccttttgtattttcaaaagcgaacgaacttaaaaaccgactcatacacagatgacgtaccaaagtactagcaaaaaatatttttaatttttataatagtagagattagataaagatatttgtaaatttctactctacgggcctatttggttctctaccctacctatttattggtagtgccaaaatctaggcaaattttggcactgccaattttttggtagggaaaagttaattagactacttttggtttaataccaatatggagccaaattttaatagtatggtgaagaatattctagaatatgtccaaattgagtatgggcactatcaattgtttggcttcaaaccaaactagcatatttactatttaaattaccaaaattttggtagggcacagttttggcttcaatccaaaacggtcctacattcggtctcaaaactgacataagtggcgacgtctgggcgtaatttgaatggaaatttgaactaatatggcccatatacttacatggatgggccagaatttcagcccaacccaaacgagacgttgctggcctccgttcagcatggagtagttgccgcctccttatgctcggtttgttgtttaaactttaaatttgaattctgcggaaaccaagaacaccatttcagccatcttcttccttcgagagacgtaagctcgaataattcatcttcctcttttgatttcaccttcacatgcaagttgtttcctcaaagatttcctcgcaattatttgtcttgataggttgaaatcgaagaatggaggttggaggttactgagacctagttcgacgaggaggtgaaggcaacctgttcgacggaatgcgccgggggaaagccgctctctggcggccgcgccatggcgagggcgagacgtcccggcgtggaggcgacggcgatggagaagcggccgaccgcctcagcgccctcccggacggggtgctgcaccacgtgatgtcgttcctcaaggcgtgggaggtggtgcgcacctgcgtgctctcccggcggtggcgcaacctctgggcgtccgcgccctgcgtcgacctccgcatccggtacttccgcctcgacagcgagccgccggaggagccgcgcgatttcgtgaaccgcctcttccgccgccgggaggcgtcggcgccggtggacacgctccgcctgcagttgagcgacccggacaatttgtttgacaacgacgatgccaatgcgtggatccggactgccatcaagcgcaatgctcgattcattcatctcactgggcaccgcaaagagatcggggtgttaaagcacagggccttggtctctacccacctcaagatcttgaagctgtcctatgtcctgatcgatgacaagatcctcaagcagctttcttcagggtgcaaatctttggaagaactggatcttaaggactgcgtgatgaccggccatcagatctcctctgcttctttgaagactttgaagatggataggtgcaagatcaatgtggacctctctatcactgctccaaaccttgtttttctgaacatagtcacaccttacatccgagttccatcgttcaagaacttggagtcgctggtgacatgctctatcatacttgatgaccttttcttgggt

SEQ ID NO: 20420 - DNA, 2229 bp, Oryza sativa
tcacaacctttcaaatgttagaagtttggaactcttagctggtgctggagaggtatagtcttttcattatgttgtatatgtattttgttttcttcaatatccagcccttttgaacataatgatatttttctgactttttccaaagaaaccttttccctttcaccagatatctggttatccagtgagaacatgtgatacatttttttgctgcagtatcaattgattaaacctacttacttactcatagcattctatgattttccatcatccgttgtgaggcatttgattggcaactaaatctcttgagattgcagctttgagagagcaatgctcttagtcgttcaaaaaaagagagagcaatcctcttagttttggtgtgattgcttgttactttttgttgtcgtgatagtgtatcttttgacatcagttaagattcccacagacaatttcgatctgtgtatttttgttcaaggaaatacactttatgatatactccctccgtcccataaaaattgcatttgtagctccaaggctttgtcccacaaaaattgtatttctagtcatatggggcccaaccaattgattcatctatataagttttcttccatcccacgtaatttgggctgctaatgcttgcaattttattaagtatgctaattatatgggttaattctctcaaacttccttttaatcatttgtatatatggaatgtgtgtatgcagtgggttcattaaataaggttattgtggtcatttttcaatcatactattttgtcctaaattagctagaaatacaatttttatgggacggaggtagtagatgttaatccactgtcaatatatcaccatattattgttttcattcttgatgcacattgaatatcatttgtatgcacgatgtgaggttgattcaatcattatagttcactgatgaaaaagcacttttgtgtccaatatgaaggtggttctttctagggaattgaaaagctgcccaatttttatcaacttgaagaccctgtcccttggtgaatggtgtatggatgctgaattcgatgcattagttttcttgctacagcgttcacctaatttggagaggctttttcttgaacctcagttggtacgtctcctctgacttatatgtagagttccgagtatgcgtgcatgttttaatagatttcattgttctgcaaaaagaacttcaatactaggaaggcattggaaagtggtgttaaacctacgggaagatcatttacttgtaaagacctgcaaatggtgaagatcagatgctcgaaggacgatgcgagagtccatatgctggcacatttgttcagggctaatggcataccctttgataagatttatgtccatcggtctgggagctctcgtaagtcagactgtctcttcttggcattttgtatttatttgcattatcagtattaaattacccatctatttgctgtttaattgaagcatgcaacgttaaatctctatcctgctttctgaaatatggttaaattatcatgtctttcctgtttatacatatgaccgtgttcctcaaaaagctaaatatggttaaatggacattctgcgctcctgatagctattctgttatcaggcttttctgttaaacaatcaaaaggctattctgttagcttgaagttttgattttctgtgtgatcttcacatgtgttcttatctgctttctgatattgctaccaggtctccgcagcgagaaggtgatgagagatctagccaagcaagaactggagttctgggggtcagatgagttctggggttcagattatgagtactgtggtccagatccggagttcggggattcggatttggaattctgatgcaacgtcagatcatctatcgttcatcatatcttctatcgtatttagttcttatgttcggattgcaatcgtcttctatatgtacttagaaagaatctgacggcacgacgcattaagcacgcatagcagggccgtgacagatcggttattcctctttggggtaatattgaatgaactatgtatggctatccaaatactgaaatgctcttatccagtggaatgagttaacattcaaatgttttggagtttgtttatataccttaaacgtacaaatgttctttgcttgaatgtctcaatgggttgcaatcacctttgcactaacataatacttcctcaatcccataatacttcctcacgtatttcgaaattcaact

SEQ ID NO: 20421 - DNA, 2729 bp, Oryza sativa
  unsure (1)..(2729): unsure at all n locations
nnnnnnnnnnnnnnnnnnnnnnnnnnnnnnnnnnnnntttcgttcatattcaaacctgtctatttacatggaaacaaaagacacgattagatcattccaaattccaattagacattttgggcaattgatcgtgataaattgggtagccttctcgtttacgtgaattgatttccgcaaccgccgccttctccgtcgctccggcgaacctctcggtaagtccgatccgtctcatctccctccttcccatctctgtactctatccctgacacgcaataatgctgtggaagttcagcgggaggtggagcgcaggccacctgttcgacggaatgcatagccctggagaggcggcgcgcggcggcggcggaggcgaggatgacctcctcagcgccctcccggacgcgctgctgcaccacgtcatgtcgttcctgcgggcgtgggaggtggcgcgcacctgcgtgctcgccgccgctggcgccacctctgggcctccgcgccctgtgtcgacctccgcgtctcgcgcggcggagtccaccgtcctccacccagggagttcgccaagttcgcctaccgcttcttgctcgagcgggaggtgtccgcgccggtggacactctccgagtgctgtccagccccgtgtgctacgacaatggggaacgagaggattactccactcgggatgtcgaggcgtggatccgtgccgccatcaagcggagagcccgggtgatcaagcttaccgaccatcaagacgacgaggtcttctctgacttcgacaatgtccccatcgtcacccgccacctcaaacacctgaagctgtctggttccgttttggaggacaggaaggacactaaggcagctctctttccagtgcccttctttagaaattttagagctcaagggctgccttctagaaggcggtgagatttcatctaccactctgaagtctgaagagcttgagcatggtcgagtgcaagatcgaggaggagctcaccgttgctgctcctaacctcgtgtcactgtgctgcatcaagccattccaccaagctcccttgttcgaggattcggggtccctcgcactggcgacgggcactatcgtgctcgatgattcattcttctgtggtggttttaagaccctatttagatgggactaaaacttttaagttttatcacatcggatatttggacacttattataaatattaaacatagactattaataaaacatatctataatcttggactaattcgcgagacgaatctattgagtctaattaatccatgattagcctatgtgatgctatagtaaacattatctaattatgaattaattaggcttaaaaaatttgtctcacgaattagctttcatttatgtaattagttttgtaagtagtctatatttaatactctaaattagtgtctaaatatagagactaaagttaagtctctggatccaaacaccatctaattctaggtggaaagacatcgatgaggattgtgatgaaattgaaggaagagatacccgatggatgttgctcggatcattctgactatggcagtgatgcaatcacctttgaatatagtgagattgtaaatgactattgcgagcaattctagatttcatttaactttgcaaactccggccgtatagttgttttggtaaaaaaaaaatttaacatatacgaacacacatttgaaataaaacgaatggtcaaacatatgaaaaaaaagtgaacggcaaataaatggagggagtaattgattgcctagtaaaattactctatatatatagttagtgaaacaggagcagctagcacctagcagcgactaaactaaagctcatcgtggtcatcctcgtcgtcgacgttgccatcttccggtgcgccgccgccgccgccgccggacctctggtagaccgccgacatgacggggttgcacacgtcctccagctccctcagcttctcctcgtactcctccttgccggcgtccgggttgccgtccagccactcgtacgcctccctcaccgcctcctccaccttgtccttctcctcgccctccatggcgtccgccatcttgccgccgagcgtgttcttgatgttgtagacgtacgcctccaggctgttccgggcgtccacctgctccctgtgccggcggtcctcctcggcgaactcctccgcctcgcgcaccatccggtcgatctcctcctggctgatcttgcggtcgtcgccggagatggtgatcttctccgacctgccggtggccttgtcggcggccagcacgctgaggatgccgttcgcgtccacctcgaacgtcacctcgatctgcggcgcccccctcggcgccggcgcgatgccggcgaggtcgaacctgccgagcagccggttgtccctcgtcatgctccgctcgccctcgaacacctggatggtcaccgtcgtctgcttgtccttgtacgtggtgaacacctgcgtcttcttcgtcggcaccaccgtgttgcgcgggatcagcttggccatcacgccgccggccgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20422 - DNA, 4240 bp, Oryza sativa
cctggtgctgccgccgacgaggacgatctcgtcgatgtcgcccttgctcagccgggcgtccgccatggccttcctcaccggcaccatcgtcttcttgaagaggtcgctgttgagctcctcgaaccgcgcccgggagagcggctccgacaagtcgacgccgtcgaacagggactcgacctcgacgcgcacctggtgctggttgctgagcgcgcgcttggcgcgctcgcactcgcggcggagcttgcccagcgcgcgcgcgtcgccggtgatgtcgcggccgtgcttccggcggatgaccttgacgaagtggtccatgaggcgttggtcgaagtcctcgccgccgaggtgggtgtcgccgttggtggcaaggacctcgaacacgccgttgtcgatggcgaggatgctgacgtcgaacgtgccgccgccgaggtcgaagacgaggacgttcttctcggcgcccttcttgtcgatgccgtaggcgatggcggcggcggtgggctcgttgatgatgcggtcgacggtgagcccggcgatgacgccggcgtccttggtggcctgccgctgcgcgtcgttgaagtaggccgggacggtgacgacggcgcgggtgaccttctcgccgaggtaggcctcggccgtctccttcatccgcgtgagcaccatggcgctcacctcctccgggctgaacacgcgcacgtcgccgtccttcacctcgacgcgcacgtgcggcttgccgttccggtcgacgacggcgaacggcagcagcttcatgtcgcgctgcacctcggcgtcggagaactgccggccgatgagccgcttggcgtcgtagatggtccgctccgggttggccgccgcctggttcttggcggcctcaccgatgagccgctcgccgccgtcggtgaaggcgacccacgagggcgtgatccggttcccctggtcgttggcgatgatctcgacatggccgttccggtagactccgacgcacgagtacgtcgtgccgaggtcgatcccgatcacggtgccgccgccgccgctcttggcaccgccacccttggccgccgccacagagccggcaggcgacggcgtgaggaggagaagcgcggcgaggaacagccccagctgcatcgtcgacgcgcgccgcggccgcgccatgatcgtcgtcttcgcttttggttttgtgtcgatacgagcgtcgcgatatatatacagcgtgcggcggccgaggccgagcccgactccgatctgatgtgtgccgctgccgaccaatcggagggagtacacgtcagcggcgtgatctgggccgttggttgatctgatcggacggtcagggtagagtgtgagacgtgttaatgacagtgtgccggtggccgtgcgcgcgtagcgtatcggtgccgactcggtttcatcttcgtacatggaccggtacggactctcaacggtttacagagttggatcgagtcattgagctactcctaaacgcagtctcatatagcttcaactttatactccctccgtccctaaatatttaacgttattgacttttttaaacatgtttgaccgtttgtcttgttcaaaaacttttatgaaatatgtaaaactatatgtatacataaaaatatatttaacaatgaatcaaatgataggaaaagaattaatacttacttaattttttaaataaaacgaatggtcaaacatttttaaaaaagtcaacgtcgtaaatatttaggaatggagggagtacttacttaataggtgtggattgattctcgaaattgctacgttttaaatactaactagaaaaaatgcatgtgcgttgcaacagaacaaactaaaattttgataaacaatagatccgtactttgaacttttccagaaattcctcaaactcaattcgaaattttgaaagtgaatatgatttttccttttgaattatttatttctttatctgcctccccttgttctaaatttattcgggttcttatacatcaaaatccatccaaagataaaaaaaatccttatagtcccatgttttgattgatgatgaacgaaaaaaaaattgaatggtaaatgagaacgctaagattttcctttaaatactttgcgatcttcctagactatctttcataatttgatatagtttcaataattattaataatattttttgaattaaaaatttgattatacaattaatcctacaccgatcccctgttgatcaagcacaagcacaaatataccgataacgttctcctcctagctcctggataagtaccggtacagaataaacagaaatcactggtttaaaactggacagataaacggtgttgtaattaatcctaggactacgtgctcttgcagtcttgctgatggactcatagtgtgtattcgtgggttgcggcggcaagcgcaaaaaccaattgagttagagacggacgtatatgacccaagaaaacaaacgcaccatcaattcagtcacagatgacgtaccaaagtactggtggaaacaccttcactttttacaatagtagagataagtagagaataattctcttatttgaataagccaccgtcaggcgtcaacatgggtcatcaaatgcccaatcagaaatattgacgacgatttcttctaagctccaaaaaattaaacaattagaaaattatcaataaaaatttcttctcaactccaaaaatttacatcctgttgcaatgcacgtgaatttttgctagtataattgtaatggaaaaattagaactatttgtacattagtttttactaacatggatcatcacgtgtgtatgcatgtctccaagttcttccgtgcatcagtgcatgcctcatcacttaaaaactaattatgtgtcaggacaggtgaatccacaaagacactgacaccaattcggagacaaccaaccgcattggccgggggcagcaggcatgcaggaggcccagctggcccacgaaaatccaacgctcctgccttgctcgttcgctcgtgtacgcgatgaggcgcagagcggaataccaaaccaatttaataagggtgatgtacgaaatatttttgacaaaaacatcttaaatttttataatagactagaaaaaatgtccgtgcgttgcaacggtttaaaaaattttaatcttacatattacttaagtccgcaggatatcctactctagaaaggaagctcaaggttgatcaacatgagctggccattatttgctcaataaaaatagaagcccttttatgatttttgcattcatgcacaacctatacgcatgaatgcatttaaaacagccagttagacagttaatactttcttgagatgaaaatagataaatgacggatacacaaattttacaagaaaaatccttatgggaaaaaaatcatagatgtcgattgacaatggaatagaggaattggatttaaatgtaggggatacattgaatttgtcgcacccttccatgtggcatacaagagatatatcaagcgaaaaatctaggagtcctaatatgaaaagacttaaagtactattaggaaactaattttgtaatacgaagtcgtattacctaactaacccgaaaatactgtatgttgaaatttggatcacatatttaataatctccgccttgagacgaatttcctcttgtagcataaaaatcttcattctcctaacaacatcatgatgtgacaaaatcattgtgcatcaaatagtcacttggactatatataaaaccgtaagacccttaattcagaagaggtacaccatacttcaaactgtcattggaaataaatcatgaatctgttggtataagtctgtgtgaatttagcagaaatgcgatatactctgcatgcaaaaacgaagtattttgatctttataaaaacctcctagtaaactgacatgtgagcttagaaaaactgaacctagagttgatttacccaaacagaaccaaagcattaatgcagatgaattgtttccctggtatgaaagagtgtgcatgaagcgataatctggaaacctcctcctagtgcaaaagctggagtggtaggagcagcgaataattttacttgtccttctcggaaaccgtgcgagtagatggattggtctgtgcttgcttgcttttcctgtgcccattgcgtcgacctgcccaggcatgcaaacggatagtccctccgttccaaaaaaaaaaaaaaaaaacaaaaaaaaagacaaaccctagtttccatgccaaatgtttgaccgttcgt

SEQ ID NO: 20423 - DNA, 2263 bp, Oryza sativa
  unsure (1)..(2263): unsure at all n locations
nnnnnnnnnnnnnnnnnnnnnnnnnnnnnnnnnnnnnnnnnnnnnnnnnnnnnnnnnnnnnnnncttaccggttggtcatcttcaatgcagattaaattcgacaaattaaagctaaatcaaaagggaaaatcataggaaaaatgatgaggaaggagtgaggaatctttttttgcaatcaattagaggaggaaatacatgggagaagcagatcgacgtcgcgacaacgctagggtttggcacgggcggggcggaggcgcgctgcacacatgggatcgcgtgggaagagatatatggaaaaatattaggtatagatagatttagttatacataataactataactatttattacctaataacttactctatggcctatcacatttggaagattatggctagtcattacacaagttacttttctagtaaaagaaattatacattacttgggccggggccatgcaagcctcgatgatttcagcccgctcgttgtccgttatatgttaatctatccgatacttgtaatacttttatttcttctcggtaattaaccgaataagcaaactggaacagaatcggatcgggagacaagaaaaattgacgacgtacgaatattttaagaataacatcattaatttttataatagtagagataaagataaagaaaaataaaaaataaaaaaaaatcttgcaaccggtgggatcaggaccccctgcagttgtaatagggactgcaactttagcagtcgttgcctcaccgttagatcaaataagaaaagctcagattcggccagggtactgtagcacgcacataaagtcctgttgcgcactgtagcatgttctgtagcttatgccgttcatcagcttgatccaacggttgtaaatggatatgactgcttaacttgcagtcactgtactaactacacttgatcttgattccaaccggggcccactcgcagtttcggtatttagggttttccttttatttttttaatcttttagcggctcatagtcatcttctccaaccgccgtcggccgccttcccccgtgccggcaaccgccgccggctctgaaacggcaagaactcaccgtcgatcggacgaaattttccggtgagttcaattcccatctcctcccctgcaacgcaatattctcgagggactcatcttcttgcaaattcctggcgcaagatgagcgggaggccccgcgcaggacatgtgttcgacgaaatgcctccgaagaaagccaagctgtccgccggcgccggcgccggcgaccgcctcagcgccctcccggacgcgctgctgcaccacgtcatgtcgttcctgcgggcgtaggaggtggcgcgcacctgcgtgctcgcccgccgctggcgccacctctgggcctccgcgccctgcgtcgacctccgcgtctggcgcggcggaggccacctcccacacccggaggagttcgccaagttcgcctaccgcttcttgctcgagcgggacgtgtccgcgccggtggacactctccgggtgctgtccagccccgtgtgcgaccccgaggtggaggattactccacttgcgatgtcgatgcgtggatccgtgctgccatcgagcggagagcccaggtgatccatatttctcaccatccgaaggacgaggcatttagtaacttcgaccatgtccccatcatctcctgccacctcaaacacctgaagctgtctggctacttgtttcgacaaaggacactaatgcagctctcttctcagtgcccttcattggaagttctagagctcaaaggctgctatctggatggccatcagatatcatctgcctctctcaagatcttgaccattgtcgagtgcaggatcatggagggcttcaccatcgctgctccgaacctcgtatcgctgtgctgcgtcacgccataccaccgtgctcccttgtttgagaatgtggggtcactcacactggatgcagccactatcgtgcttgatgattcgtttctatatgctggttatgaatacgagtatgaagacatcgatgaggatgcgatcgaaggaaacggtagcgaagacggtgaaggttccttgaatgattctgactacgacagtgatgctgtcagtgatgcaagtacctgtgaatacagtgagattgcaaacaactatgatgatgaaaaacagcttgtagagcatgatgaggtacataatcgaagcannnnnnnnnnnnnnnnnnnnnnnnnnnnnnnnnnnnnnnnnnnnnnnnnnnnnnnnnnnnnnnn

SEQ ID NO: 20424 - DNA, 2007 bp, Oryza sativa
  unsure (1)..(2007): unsure at all n locations
nnnnnnnnnnnnnnnnnnnnnnnnnnnnnnnnnnnnnnnnnnnnnnnnnnnnnnnnnnnnnctgcagcattcaccaaatctggagaagcttttccttgaacttaaattggtacatatatttatatctgtcgaatttgcttgatgctttacacttttcatatttcgacaaatcaattatagcacatattcactaataattatcttcttctgcaatccaaaaaaaaggattatgacaacacacaggcaatgaaagaaggtaccaaaccaaagggatgctcatttgcttgcacacaccttaaaatggtaaagatcaaatgctctattgatgatgtgagagtccattggttggcacagttgttcaggactaacggcgtacccattgagaatatctttgtgcgtcagactagcagcacttgtgagtgatacttctcttgtaactctcatctctgatgaagttgcagtaccgtcatacattattactgtttttgttagatggaaagcatttggttcacttgatgttctttgtggtgcatgatcgaaaaccataaactaatatgttttgttttctgacatatcctccaggccttcccgccagaccatggtaatgtgaagctagagggtgggaccaataatatcttatgatcttgttcaatatgataatttcgctttatcacattgtatttagcagggttctgaagggtaagcatctgcactgatcatgctgggattacagaatatgtgatgcttcttttgagtgcattggaactatgtatatatggctaccttaacgcgaaaatgatcttatctagtggaatgattttagctatgttatctctagcttgaggtcggcttcttcctgaaacgatttgacgagttctttttgcttaatgctataactgaaagtgtaatatgttcaatcttctatgtgtggtaaaaacgctgtggttgctggattcgatacttgtgacataaaaactttgtacagcgacgagccattaccaatgcgcatatgaaagacatgtccagtcttgcatggatggtaaagcccctgtggatgcaacaagtcaattagttctctctgggaaaaaaaatagtaatacatgcaacagtagttttcatatgttgcattagtatgctatataatcagcactcagcagtaatcgtcgttccgaatcagaagtagaagtatcaatctcatctttttagacagtccagcgaagataaaaccggccagaattttatgaagagagagagagaaaccacaacatggaaaccaaagtacaacaaacgctgtgtttagttccaaaatattttttcaaactttcaacttttctatcacataacttctctatacacacaaactttcaattttttcgtcacatcatttcaatttcaatcaaacttccaattttagtgtgaacacccaaagtttattgtagcccttgactactacggtcactgccgaaagggcaactctacgaggctacgaccaaactattacaaatccgtagcctctgctcatatttccgaaagatctgtgccaatgtcatggtatcaaatgaatccagaatattttttcagacgcgtgccaatgggacatagctttatcacttgatcagtatatacagagtacggaccaacatgagacttggtcaggtcaccggttatcgaatgtatgactaacttaggaggggatgtgacctcttctaagaggatgaatctgactaggttaagttttttttggacggagggagtaagctttgctaatttggcatcgtacgttttgttcagatatatgatggacggggacggaacggatttacgattttacggttgatgaaatcatacagttcgtcatatcattatctgaaaaaaatacagtccgtcatattaaaaaggaataagtccactttccttccctcaactcatggccgtacatgaatagcatccctcaaccgcaaaaccgggtatatcccccaactctgaaaaccgttgcaaatcaactcc

SEQ ID NO: 20425 - DNA, 3033 bp, Oryza sativa
gttttttaaagggattaatggtaaggagaagatgaaatgaggtggagatgttagcccaaacactcacttgcacacacacagctctctctctctctctctctctttcactcgatgaaacacacacatacagaggaggcaatgacagaggaagaagatgaacagcacgcaatgaaacaaagagacgcaaggaaatttcttgtcactacacaccagtgaaccaccacacacttcactttctattctccacacattaatcacacactgattacatgcttaaatagcacacacgcgcagcagcacactagccacgttttttccacactaaccggccaccagtcacatgacttagccactaattaaccactaatcacgtctctatgcatgcaggccatatctccttgcatgcaaatgcactaacacacatgcaacacagctaactgatccacaatccatgccactactcaagctacttgacttggccactactcccagccgatatccacctatagcttcctacatgcaagcacttacatgcagatcatggattttcttgatcaagctaactcatgcacgcactaatcacaactcacacaataaacaacaagattaagtctaacaggagattgctgacatgtgggtcccgctggatgacttagcaagtcaactaccacctaagcaagtcaattgccacgtaggaataaaccacttccaaaatcgtccggggagttgatttgcaacggttttcagagttagggaagggttatactcggttttacggttgagggaagctattcatacacggccatgagttgagggacgaaaagtgtacttattcgtaataaaaatcggagggatttaaagctatacgtactcctgtgaatgcccagacatttaagccgtgtggtgaagaacggcctggttaagcatttgggcctagaatagagggcccatattggctcgcttatctatttcgttagttttcattttttagagcccaggagcggctcatcggccatcgccaacacatttgatcttctcttctcctgccccggcgaggcggcgaccgccgggattgaagcggcgagaactcgccatcttttccgacgagtcaaacctagtaagctcaatttccttcccctcccctcccttccccagccaccgcaaccttcttctccagagattgatttcgtttcaaattcccgacgcaaagaaagtgaccaaaaagatgagcgggaggcggcgcgcgggacatgtgttcgacgaaatgcccccgaagaaagccaagccgtcccgcgggggcggcgctgcggaagaccggctcagcgccctccccgacgcggtcctgcaccacgtcatgtcgttcctgcgggcgtgggaggtggcgcgcacctgcgtgctctcccgccgctggcgccacctctgggcctccgcgccctgcgtcgacctccggcgtctggggcggcggaggccaccttccgccgccggagcggctcgccaggttcgcctaccggttgctgttcgagcgggaggtgtcagcgccggtggacattctccgggtgatgtccagccccgacggcgaaggggaggaggattacaccacttcagatgtccagacgtggatccgtgccgccatcaagcggagagctcgggtgatccagcttaccgaccatccaatggatgaggcgttctttaacctgggcttcgtccccatcatctcctgccacctcaaacacctgaagctgtctggttctttactgtggaacacgacgctaatgcagctctcttctcagtgccctgcttggaaattctagagctcaagaaatgttctctgcacggccatgagatttcatccacctctctcaagagcttgaccatggtgaagtgcaggatcatggcagatgtcaccattgctgctccgaacctcgtgtctctgcggctctgcgctgcatcaagccataccaccgagctcccttgttcgaggatatagggtcactcatgttgagtattatgtgtttaggggtatattagtaatttcctatctctattgtactcatatatgccctttgggctaacacaatagtaactgttcattctccaatttcccctaaattgtgacatggtatcagagcaagagcaagggatcaaaccctaacgtcgatccggagtccacgccggcacgccggtggcagctcgccaccggcgagcccatccaatccgtgcacatcctcgtcagcttcgtcgtccaccaccgtcgagccgtcaatcgtggcagccaatcgttcgtcgttcgtccacaagcagcaagcagatccagtcagcacaagcaacaagcagcatcaagcaatcaaatccacaagcaagcagcggatgcatgaacaagcattcagatccagttcttcgtcaccacgtcagtcgtagccaggccgtactcgtcgcggatcttgtcgtcgcgtctcgccgtggctcgtcgttgtcgccgcattcccattgccggtcgcggcgctctcttcatcgccgccagcgcggtctcctcccatgtcagtcgtccagctttccgtccgccgcctgcgcgcgtgaccatctgcatcgtcgccgcacaggtcaaggtcctggtcctcttggtctagcctgctctgttctctctgcttctccacatagatgcttggagactggttactggacttaacagcaacaagccatcgtcttccctaatatcaagtagcagcgacagcaatttgcaagtgtcatgcagatccaccttgttccatattcaaacatcaacaaatagcagtagagaagcccatatcgagttatgcttccctcatcatgcagccggcctctgctcttgccggatttgtgaagccatccatagtctcaactatcttgattgttgaattgttccatcaacagatctattttgtgtttgctatgcttgcttactgctgccatcaacaagtcaattaatatcctttggtcttgcaaacatatcattgtgcttcagtttgagataggcaacagaaaaccaaggcacag

SEQ ID NO: 20426 - DNA, 1542 bp, Oryza sativa
ggttcgtcgaagtcatgcttgtcaatcattatcactatctcgctcgctccatgtcgaagttagccttctatcatcaccagaagctccacgtcggagctgatctttgtcatatcaccagctccccatcggagttgacatcatcatcaatcattgaagggccgaagaacagtttgtgaaggtccttcatctcgtcatcatcaccgtctctgaatcagtgaagagccaaagaacagtttgtgaaggcttttggtactaagggctgaagaacagtttgtgaaggctcaggtctacttcattgaggataggatggttttctcttcttctaattcattcaagagcaatgcttcgacaacatcttcaaacatggactttgtattaatagtagggggtcatttatcttgtgtttagtttcaaatgcaatgctattgtatacacattgcatttgagcaggggtgttgagtattatgtgtttaggggtatattagtaatttcctatctctattgtactcatatatgccctttgggctaacacaatagcaactgttcattctccaatttcccccaaattgtgacaactcacactggccacaggcactattgtgcttgatgattcacttttatgtgctggttttgattaccagtacaaagacttcgatgaggatgcaattgatggaatcaatagcgatgatggtgaaggttgcacgagtgattctgactacgatgatagtgacgcgaatacctgtgaatacagtgagattgcagatgactatgatgatgaaaaacaacgtcaagagcattgtgaggggcataatccgattgatgattatgatgatgaaaatcaacatgaagagcatggtgaggaacataatcaaattggacttgatgaagttcttggtggccataatgttcttcacatcctatcaaatgctgaaattttggagctattagctgatggtggagaggtatagctatgaatcttcttctgctccctgttacataacattttcccttaatgcggatacattaattattttcatcattacataagaaaaaagctttctcaatttctatgcactgaacaaattacttgtatgttctatatgaaggtgattcttaatagagcgctgaaaacttgcccaacttttagaaacctgaagacgttgtcccttggtgaatggtgtatgggtgctgactttgatccactagttacattcttgcagcattcacctaatctggagaggcttttccttgaacttaaattggtgcgtgtatttatattataatatatcggttgcttgatgcttcacatttttcatattttgacacgtgagttttagcacatgtccattgataatttatcttcttctgcaaacaaaaacaaaaaggattactacagcatacaggcaatgaaaggagttaccaaagcagtgggaagatcatttgtttgcacacaccttaaaatggtgaagatcaaatgttctatgaatgatgctagggtccattggttggcacagttgttcaggactaatggcttacctattg

SEQ ID NO: 20427 - DNA, 1231 bp, Oryza sativa
  unsure (1)..(1231): unsure at all n locations
nnnnnnnnnnnnnnnnnnnnnnnnnnnnnnnnnnnnnnnnnnnnnnnnnnnnnnnnnnnnnnnntaatgcagatgaattgtttccctggtatgaaagagtgtgcatgaagcgataatctggaaacctcctcctagtgcaaaagctggagtggtaggagcagcgaataattttacttgtccttctcggaaaccgtgcgagtagatggattggtctgtgcttgcttgcttttcctgtgcccattgcgtttcttgcccaggactgaaacggatagtccctccgttcaaaaaaaaaaaaaaaaaaaaaaaaaaaaagacaaaccctagtttccatgccaaatgtttgaccgttcgtcttatttaaaaaaatataaaaaaaattaaaaagacaagtcacgcataaaatattaatcatgttttatcatctaacaacaacgaaaatacgaattataaaaatatttcatataagacggacagtcaaagttggacacggaaacccagggtttgccttttttttgggacggagggagtacaacccatatgagtggggtagtcgacccagaaactgcaggcaagtcaaatcagcaacgaacttggcgtcgcgggggaaccggcaactgggcaagtcaaatcggacccaggcgacgtacgaaagttgtggcaaaaacatctttaatttttacaatagtaaagataaagataaagaaaagatagagatatactagaaaaaatgccgtgcattgcaacgggtaaaaatatttttttattgatacattaactattaactattaggagctaagcaataaattgaaacgttaggatcggtatatattataatttaaaaagttaataaaaatccttcctttagttttaggcccaaattggtcattcattcctcccttttcaaacctaacatagtctgatacgtggtcagctcatgcctatgttcggcatgcggcttcaattgtggactgggcactcgcattggcatagccactactattttcaccttctagctggcaaagccactaccattttcattttccgaaagccattttggggccggtatgatgcggaagccatccttcccccattaaaccggatcgatttttttttaagtccttaaaattaatgggggtttttatttaattgattttttttggtcgggttttcccaaaatgaaaagaattcacaataattgggaataataggtggaagaagtttaccggttggt

SEQ ID NO: 20428 - DNA, 774 bp, Oryza sativa
tgattgtctggccttcgtgttagggttgtctattggatcacctaggtttagatctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgatgatgtgctcggttccgatggcggtgatgcggttgcagcagtgacggtgtcgacgacgaggcgtggcgcggcggtggacttcccgtcactggctgcgccccctcgatcggttagggtttatggggtggagtggcggcggcgacgaacctcgttccttgtaacgttatcccgtcccgtcctccacccctctttatatggcacagtgtgacgggggcccaccagcgattgggctgggcgcccccgatcagggcgcgggtcaaggcccccttgagccgttgggctcaaggggagggagatccatctaacacttcgtagttctgtaattgtgttgatgattgcaactatgtttatactcttcattttctcatggtgtcaagtccaacagctgagacatcttggccacattactgtgcatgtcgcctgctctagtatgttataaacgttatctggtggccaatactatttcaatgatggtttacatttggaaccatttaatcagggaagcaagtggtgtggacaaacttttttttttccacttatcacaaatttattttatttttttc

SEQ ID NO: 20429 - DNA, 909 bp, Oryza sativa
attgtgagcacacgtatactcatttaagaaggtgattgctgctaagatcattgtaacattctctataataatctttctaatatgtggaacctagcttgcaaagggcatatatgcatgtaacgctcctttgcccccatcccaacccaaaattgaagtatcagtgttttgtaaacacactttccatgcacatcgaagcatcggtgtcttgtaaacacactttccctgcatgcttcatgctcctctttgatttgcagaaaaatcatttgaattttggaggatttcaatcctagagaaaaaattcctataaatgcctttggtacagatgattaaatcatgtcatatcctttaaaattcctatggaatggacaatcctatagcgattttgtaggaaatttagtaaaagcttcaacctcttgaaaattttccttcgagtatttctctctcaaccgattcctatgtttttcatgtagtccaatcaaacagtcattcttatgtttttcttttattttgtagtcatctgttttgcacttgcattagaatcatctgttttgatttgtgggcatggaattcaaaagcgaagtctgatcaaacaaacagatcatcatcacaatgcaaggtgcatatgggcgaggtcatcaatcatcagactgatcgtagccgtcgcatctgtcataacagtagtaatcatcatactcgtcataaccttcaagggcggaaggaagcttgacagtctttgatcgcggcgcactttgctaccagggcgtcctcgacatcgcaagatcgtagcagttgcttacgtcaaatagctcaaggcagcggcgaatctagaataaaaattacccgggatccactacatagtagttatctaattattcactagtaaactattcaaaatagcacataattagt

SEQ ID NO: 20430 - DNA, 128 bp, Oryza sativa
ccatgccttctcgtgcatcggcttctctcctccaactccggcgggctccccttcttctccggcgccggcgacaccccaactccgacgggttagggtttggggttggggtgagggtaggaggggggttg

SEQ ID NO: 20431 - DNA, 1113 bp, Oryza sativa
tccccgtgcaacagcgactgcgtcttcctccgtcgtcttcctctcccctatgcagcggccatccgattccaccaacacaaaaggttctccactcgtgcctccctctcctctcctctactctcatgtcccgtgaggtggagaaggatgcgcgggggctagatccggcagcccccgagctcggcaccaccacgacggcgaggaggaggactggcgaagagtggcgatggtgataggcttggccttcggtgagcaactaatggccgcgatagcctcggtggactatgattcggtttttgtagttaaccttttgtgttgaatgttgatattctatatatcattcggtgattattctaatttgtgatggattaggattaaatttttgcgttggatttgtaattggattgggattaagtccttggctcaaaacatgtgctcaattcgagccgaagccgatgcgtcgagccacattattttttcatttctagaacctcaaaggtgcaccaacatctatgattctccacatcagtgtcggttacgaagtctagtatctatgtgggattctcaaatggcacccattaggtattctatagtaatgaggtggtttgttgttaaatatagtttctcagtataagaactattagcaatactaaaaaagagagatgcaaaatgcatgagccaataaaacttgcatccgagtctcaactgttcggctgctcagcttcttcatgacatacttgaggcttcatcggttggtgagtgggtcatgactatagatggccataaggcccgcccggcctaggcacggctagacacggcccaccagctatcggaccagcatggcccggtcggcacttcgtgccgggccgtgctggcccatgggctacacctccagccctgccacggccccgtgtcgtgtcggtccgaagacacgggtggtctatcgtgcctttttttaaataagtctattttctctccctcctcgtgggctgtgacatatgtatatatatagctaaaataagtccatttttcctccctcctctttgggctgacatattatatatatatatatatatatatatatatatatatatatatatatatatatatatatat

SEQ ID NO: 20432 - DNA, 4524 bp, Oryza sativa
tattttaataagataaaagatgagaaggaagagcagcgggctacagatctataggcagctgacaggtaggaccatatattaatagtatagtaagcaactattgtataaattggctattagattgactatagatgaatcggagctagtagtgagcagtactattaaacttgctctcataatccatttaatcccaaagcaaaaagtaacgagtttagaacaatatgcccagaacatttgctttaaaccgtagcacacgacgtctgctgtaactgtaaattcgaactatactggtagcaaggtaaactaagatgacagtggcttcaactggacatgaataactccaattcaaatggacatgaatggtaaatattctgaaggggtatatcaaaagccctgaacaattttcgccagcatatggattattgagtctcttacatcatccttagagcatcgatcttgaatattttgaaggtctgggtttcacagcgaccagtcacgacatccgccacgggcaatttaattctctgttaagtttggagttgcgaaggcctagcacaaacatcgtaaagttataaggtggaaagtgtacagaacaatattcaagccaaagcaacagagaaaatattgctggcaaaagttttagtgtaaaagaagttaacactacctccgttgtcttttagatgaatgaactaaccaacatcaaatataaaaaacaggagtagttcaaaaaaaaaaagaagttaaatagttgaactttttccatttgattgttcatgtttctatcacgtgatagcatgcctcttgatcagcatatcttttgatgaaatgttataacatttgtacaacaaaaagaattaaaaaaaggaagcaaatatatgaacaataatacttacggaagctcccacttcgacggacgaaaatcttctctaaggacaagccattagaattgaacaactgtgccagcatatggactctaagatcatccttggtgcatctgatcttcaccgtactaaggcgtttacaggcaaacgatcctccttttggtttgatacctttttccaattccttttggatgttgtaactcttttagcaggcaaaaaaaagccaaattagttaactactaccaaatgctgaaacttacatattgaattgcaaatcattgagaaacattagttgatcttgtaccatttcaagttgaagaaaaagcttctccaaattaggtgaattctggaggaagagaatcaatatgtcgaagtcagcgaccatactgatacaccactcaccaagggacaaagtcttcaggttgctaaaagttggacaacttcttgattccctgctcagaaccacctacattgtacgtgacagtgaataacgagttgcaggataaaagtatattcaggtatgcagtgccattttttccttttttgctaatgaaattgcatatattcctaggactggtcttaggattataggatacatataaacaaattgtttgctcaacatagggagttgtttgtatgcaactaaatgtttgcagcgtccataagtttcaatgctggagggaactcctttttagtgaaaagtgcgaactttttgaagatatctaaaagaaatcattagcagaatcattccactagtaaggggggaaaaaggaaaagccccccatctaccatgacagcaagaacctaaagcatgccattctagtcaatagtagtaaagcagatcaatcttcctaaatttgaacacactgcatataattgaaagaagtgcacactataaccaaccaaaaaaaaatgcattccaatgctatattttgcaccatgagtgatgagtccctgctgcacattagtgaaagcgaaagtatggattatacaagaatattagtagaagttaagggaggtacctctcctgaatgagctacagctccaaacttctagcatttgaaaggctgtgaagaacattttgtccacccaaagttttatcatcattgaacccattgttagaactggagccatgatatttaccacccatactgcaatcacctccatcatcatggtctttatactgctcaaatttatattcattcacaatctcattgtactcatatgtatcagcatcactattgatatcattttcatagttatagtcatagtcatcactgatgtcactggaaaggtcatcaaaataatcttcagaagagccaccataagaataatcagaagagaaaccatccacctcatgtccttttttagaatcaccaataagtagcgagtcatcaatcatgatacttcctgtgaccagcgacccagagtccttgagcacgggaacccatttcattggtgtgatgcattgtaaaaacacgaggtttggagcaccaacagagagattcatagtgaacttgcattcaaccatgatcaaactcttcagagtgactgatgaaatctcacgggcacttaccacgcatttcttgagctccagttcttccaaagaagggcatcgagaggagaatcccctgaaaacatcgtcatccagctcggcgtacgacagtttcaagattttgagatggttggaagcgaagacctggtgagcaaatacaacgaacatcccataatgatcttcaagctgaatcacccgagcttttctcttgatagcttcactaatccacttctcgacatcgacattcttaaacttgtccccgaaaccatccacgtgagcagagcgcagccggagcgtgtccaccggcgcgagctcgtcgcgagcgagcagcagccggttcacgaacctgcgcgtgtcactcggcgcattgcggtcgcgcgtccagaggacgtcggcgcaggggcagggcgcggaggcccggtggtggcgcatgcgcctgttcatcggcggcggctggcggtcgctcgtcaggaggatgtcgacgcagggcgcggaggcccagaggtggcgccaccgccgcgagagcacgcaggtgcgcgccgcctcccacgccttgaggaacgacatgacgtggtgcagcaccatgtccggcatctcgctgaggcggtcttcgcccgaagcgacggcgtcctcctccgcgatgccgggctccccctcctcctccgccgccgccggcgggtcggtttcgttcagcggcatttcgtcgaacacctggacttcaccgtaagcgacggcatcctcctccgcgctgccgggcttcccttcctcctcctccaccaccgccgggttggtttcttccagcgacatttcgtcgaacacctggcctgcacgggacacgacagccatggaaacgcaactcgagatcagaacaaaaaaagaaaaagaagaagaaaagttcgcgacgaatccttgcaagaagcaaccaaacctggagaaggggaatggaaacttacggagagatcagctgcgatggcgaggaatctcgtgatccttcagagcaacgggaggttgaagacgaaggcgtagtggttgatcctttttttccccctttttgagaggagaaaatagaaatagttgaataccgaaatgggactctctagtctctactctctacccacccaaggaatttcctccagattccgatgttttactcccacgataaaacaaacagatttattatgagactagctaaaaagctaaaaaactgtgagtgttttttcagagaaaactttcaaatctaacttatagtatatagtttcactagaactatactataataataataacttgtatatatgtattaaaataatatatgcaactttatatctaatttatatagagataataatgtagttatagtgtagttacactatagctacaatgtaattatagcgtaactacaatgtaactagcatgtaactagagtgtaactatgtaacttgaacaaatctgccataaacatgcgatgatgggattagcttgtgaaaatagggtttagatccggtagcaaaatatctaagcacaaatcttagcgcagaatcaacggccaaaaaatttgacagttttctgtcgatagttagctagcagaaccgtttacgggtatcacatgaacttttcttttcaagatttatacttcggccatcttctccggtgacagcaacaataatttggtagcgatggtcaccagaataagttactaaacgctcaggcctagagatagtacgcgatgtgtctaggcggttgcggtaaaaccaagtagccttaggaagtactagcgtatctagcagcatgagccactagagatgggcatgaggtagcaaggtctttttcgagaggaagaaatggaggatggcagggaggaagtgtggcggtgataggtggaaggaggggaaggggagacaaaagactagggtttatggactagggtttttaaccgaaggtgtgaaacggtccgaacaacttgatgtagagcatgaaaaaaatgccagacaatttttacgagagaattgacttaactctaaatagaaactctagtaagattgattttccttttttgtatggtgatgtgttgggccaatcggggatcct

SEQ ID NO: 20433 - DNA, 1816 bp, Oryza sativa
  unsure (1)..(1816): unsure at all n locations
ccgtgccgtgccagcccacgtgccgcgctcacggcccaggcacagcccaacacacctcgggccgtgccgggccggcccgaaagaatgacggcccatcgtgctttttctcagagtaagtctaatttttctccctcttactgggctgtgatatatgtatagctcaaaaaagtctattttacctccctcttctttgggctgtgatataaatagctaaaattaagtatatttaaggtccctattctttggacagcgacatttatatgtctatttttagtccctaaactttgtgtgtcgggcctagcctgccagcccatcgtgccgggccagcccgaccgtgccgggccagcccagcgtgccgggggaggcccaggcacggcccggcggtcgggcctgtgcctgggcctgatctgtggcgatgcgtggacatgttgcaccatgaggatgtaaacagattgatcttgagagatttcctgtacgcaatggcaatggtggccgtggaccgttcggatgggcggccggcttgaggagtttgatgggaagatctttgttgatgataagctgctcgagtatataggggtcaggtagttatatatactaatgatacttctattgcatcagtgtttctccgactctgaattgattaggtttgaaatttccagagtgaagttctatcgccctaattcgcctgaatttttttaaaataaaaactagtgaatttagcaaaagttattcattttttgttcaaatttttcgtaccgaaatatcaaaatttcggtgatatattaattaaatcctgctctgaaatggtctaatcatttgaaaaatcttgcgcactaatctgtcattcgttttgcttgcattgctgcaggtcgccctctctgaagcggctgtcccttgcatgttttctgctcctgtatctccaaggaagcattaacccagttaatgagaaagtgtccactgctagaggatctctccctcgttggttgtggaagtgtcgtctttcacatgctttatgagatcaccggcgaaacgtgcccgcggctgaactgcctccagctgagcacatgtacacaagctcatccgcggcttgcgtgtttcgggtacggttatgggccgctggggatggcgacgttgcaccagctgcgacacctgtttagttcaacgcgtagtttggattttggttgaaattggagatgatgtgactgaaaagttgtgtgtgtatgacatgttaatgtgatggaaaaagactgaaatttagatccaaattttggatctaaacacaaccctaattctggactggacggtatcaacattgatgacgacgagctgacagccatcgatgatagctgccctcaccttgagccactggcatgcccacatacaatttaccggtgtcactggacaccaggtaaaattgttaaattctaactaatttatgctattttgattagtatactagtgaataattagataactactatgtagtggatcccgggtaatttttattctagattcgccgctgccttgagctatttgacgtaagcaactgctacgatcttgcgatgtcgaggacgccctggtagcaaagtgcgccgcgatcaaagactgtcaagcttccttccgcccttgaaggttatgacgagtatgatgattactactgttatgacagatgcgacggctacgatcagtctgatgattgatgacctcgcccatatgcaccttgcattgtgatgatgatctgtttgtttgatnnnnnnnnnnnnnnnnnnnnnnnnnnnnnnnnnnnnnnnnnnnnnnnnnnnnnnnnnnnnnnnnn

SEQ ID NO: 20434 - DNA, 3596 bp, Oryza sativa
  unsure (1)..(3596): unsure at all n locations
cctaccatataggtatagcatgccacctaaaattaaaaaaaaatgctttttggacatgtgcagaaaactgcatgtctatctgttcctttctcacagcactagcagttagtaaaacaggaaattacgggaaccaaatcatttcacttttgcctattttgataagttctagttcttagtcctctcttttcactgccatcgaaccttggtagcgacaagaccgacggtagcgacagtgacaaactatgaatataaacagcggtggaggtgaaattctagaagacaacagtttgcggatgtacaaatgcatttctttcaatgctatgtggcatgtcatgtgtataaagtattctcacatgaatagttacatgggcaaatgacacagttaactcacattagtgacctgcagatatgcattttaaaaataaagtgacctatatgatacacctaaacaagttgaatgaccttcatacattttacttttgtcttttttgttgcatcttataaaatttgcatttaatttgcagtgatatattacatattaatttatcatctcatgttttttgaattttttaaataattttggatggcgcacaagaaataagggacttcctctcgagggattaaaagagtttcccttttttaaatgtgacaaaaaaaaggacccaaaacctccagtcacaaatggttgctacgtttttaggacagcgtttcctcttgtgaactttgctgtagaggcaaaataaggagattgggaatatgtagccactgtacgaatagaaatatagaaccatgtaaataaataataaaatttctaatgcaattaattcaacagaactgaggcactaaacattaaatcaagagcacaatcgaacgcctcacacgcgattgcatatcgaggggcggtccctatcaaaataattcaaatccgtaccggctatacggccaatttcaaccaaattaaagcaaacacgaatattcagtataaagaagaatccaaaaaatcagagtgcgtgggggaatcaaattcaaaaaatctcacgtctcgccaaggaagaggaggaagccgtcgtccacggcgtgctggctccggaatgcctcgcactgccccttgctccggctgacggcagcctgcgccatcccgcggaggccggcgccggcgtggccgtggccgcggccgcgcatgtcgatgcggcgccacaggtcgggctcgtcgcgcgcggcgcggcgccaggagcggcacacctggccggcccccgcgaggatctcggcgtggtcgcactactaagtgatttttctgcacgagacctatgattttttgcaaacggaccataactagtagcgtatgtaaaattcgagtggcattttcacagacggctccttaagacgtccgtttgaaaaaatcgattttcccatacgggtctcttaagcggtccgcatgtcatttttgcatgtgactcacttaagcacccgcatggaaaaatcgatttttccatacgggcgtcttagggagcggtctgcgaaactagttagtctatctgactcatatgaacttcaaattgaatgattctttttcctaaatatttctaaaatcatgctctatcatgttattgtgttcttactcctattattttggccattttttcatttatttttgttttatcaattaaaaatttgaatttcaaatcttcgaataatatgttaaagcagtaaatgatttcaactgaaaaagttatcaacaacaaagttgtataactatcaaaatctataacttctattttggtcatttttttcatccgacaaagcgataggaacattttcacaaaatttacatatctctcttatagtttatacaactatataagagaaatgtacattttgtgaataaggttacaaattattttgtcggatgaagaaatgacccaaataaaagttatagatcttgatgagttataccactttgttattgatgaatttttcagttgaattcatttagtacttgtaaatgttgtttgaaattatcataatttgaaattcaaattcaaattgttcaaacaaagtcatctagaaaaatgacgaaaacaaaagttgtagatcctgataagttatacaactttgttgttgacaacttttccatttgacatcatttactacccaaaaatttatttgaatttcttatattttaaaattcaagttttatatagttcaattaaactcggatggagaaatcaccaaaataaaattggtagatctcaatgagttctacaactttgtttttgacaactttttcacacgagttcatttagatagataaaattcaattcaaaattttattaatttaaaattaattttttccctcctcctcctttcaaattttttcatctcctcttctctctcccctcctatccagatattttaactccctatccttatccttttcctatctctcctctcagcctctcactctttcctcctctcctctctctctctcaccgacgcacggagcgggagcggcggcggctgcacggcgcggcgggcaggagcggcgcggcagcggcaggctcggcaccgacggcggcggccttccccgacctgccatccggcgcggcagcgcgcggcgggctcggcaacggcggcggcggccttccccgacctcccatgcgcggcgctcccttcctcgatagcaacaggcacgacgacgacgacgatggcggcgggtggcgggtctggacggcgggcgcgcagcgggctcggcaccggcggcggcggcctcccttccctgacctcccatccggcgcagcagcggcaggctcggcaacagcagcggcctcctttcctcggcgcggcgcttccccccctctcaacgccgcggcagcgggggtggctcggccgcctcaggcggcactgccctgcgccgattcggtgccgccgccgacggatcaggcgacggcgggcggcgggggtgacagatcctgcgacggcgtgcggcgggggcgacggatccggcggcgggctagggtttagggttttttggattttttttttgtttgccgaatttattttacggcggcgatggcgtccagcgccagctccacccagtccctcgcctcctccatctccatctccaccgctgagccacggccgccgcgacggcctccgcggcggcgagcggaggagggcattatgcggttggtggtgagattgagaggaggaaaagctacacgcacgggattggtgtccggctccgatggagtagtagaagtagcttcttgcagaagccaagctaaaaactggactagccaaactgtatagtcgactgtccagtttgatctagagcagtcaaaactgacgttagagcaaaggttaataaatgggcgcgcccacagtcaacactatagctaagccaatactagtgctccctcacggttttataattctcgaagttttggataatgacacagtttttaaaatatatctttgatcttattttttatatatataataaataaatgaatgtttacttttatcatagaannnnnnnnnnnnnnnnnnnnnnnnnnnnnnnnnnnnnnnnnnnnnnnnnnnnnnnnnnnnnnnnn

SEQ ID NO: 20435 - DNA, 821 bp, Oryza sativa
cgcgggttagccacttacacccctaaatcccaccacctattgcccttcccatccgctgcctgtagaccttctcgtgtcctccctcctgccttccgttgcgtcttctcttcgaatcaattcgttctttcccccgctgacctttctagtccttcacctgccaccgccgacggccagctcttgtcccggcagttgccttggtaattgcaatgtcaaatactccctccttccaaaaatatgagacctatttcttgttgcatcaatactaagaagcaattaactcacttgtcatatggcaaaaccaatgaacatgcaaccaataagtagtacttatggctacttggtttccgatccacaatttaatttagtatatagcgactacaaataggacttagatttttggaaaacccaaataatgaaatagatctcagactttaaagagaacatttattaattactttgaagagaatattccatgtactacatagtactagttcataaaattcatcaactaacatgagtgcagaacgaacttacatgaatctaaagggagaaaatattcccagaaaaaaatagttgaactccaacataaattccactcgcattgatcaaatcatgcagttcttcatttcagaaacgtcctcatgcacctgggaagcgcgttatcatacttgtcaagatcttcctcgtagcgggaaggaccggaataatcatcatcatcatcatcaaattcctcagacgtccattcatccgagtacatggaatattccggatcagaatacaccgaataataccgcacaaaaccgggggagatggggagcctc

SEQ ID NO: 20436 - DNA, 710 bp, Oryza sativa
aagagccaattttcagtggcatataagggattagactaattttcagtggcatataagagattatctctccatattatctctccttgaggagcccagactaattaacatgttcagatgagtgaatactatttttttatacacaaagggtatttttgtgcattaaaattacttgcattacaatagaatgtatgtggttttagtggacagtagatgctatgtgcaaattcataaaattatttaccaacagaaatatattctttaatacataggaaatgatacacacactttccgatttttgtttatgtccagtgcaataacagaccgttccatacatgaaaaccatattggtacggactccattgacgccgttgcctacaaaattgtcagcaatgccacgtcggctcatagataagaatcgctgaaaaactaccgtaagattttatttttaaaaatattcaaatataaacataattataagcctagttataaaactgatcataaattcccatttcatagtatagacatttataatcagtttactggttggtggcttggcgctctcccacatgcttggaaaacagtgttggcttggcgctctcccacatgcttggaaaacagtgtttcttattaaacatttgatcttgttacatgagagatgagttaatttctgcttagtcctggtgacaaaaaagttacacgtaagacttttg

SEQ ID NO: 20437 - DNA, 1328 bp, Oryza sativa
  unsure (1)..(1328): unsure at all n locations
tggaatgatctaatcgtgtcttttgtttccatgtaaatagacaggtttgaatatgaacgaaatttacgacaagcacccactgggatttacaccgtgtttagtttcaaagtttttcttcaaacttctaacttttccatcagatcaaaactttcctacacacacaaacttccaatttttccgtcacatcgtttcaattttaaccaaacttctaattttggtgtgagttcacacagtcttattactgtaataattattgcctaatagtactattcggtattctatagtacaagtcacaagtgcgaatgtactgtgctactctccccgtcccataaaaaaccaacccagtatatgtcacatccggtactaaattcgttttttatgcgacggaggaagtaggcaccaaacagaacgtgtgactaatttgaacagcattacaatgcaaattaaaatctgcataacttttatttttcaaaagcaatttcatatctaaaaggcagggccatcatcccataatataaggcacgatcaaatttgggacattctccaaaactaatctttgtgttataatttctcatatattatagcaacaaaattataaccatatcaaagtaaatccaaatgtcaatccaataatattattttcagcaaataaaatttaatttatattatactaatggttagtcaaatgttttaaaagttgaatttcgaaatacgtgaggaagtattatgggattgaggaagtattatgctagtgcaaaggtgattgcaacccatcgagacattcaagcaaagaacatttgtacgtttaaggtatataaacaaactccaaaacatttgaatgttaactcattccactggataagagcatttcagtatttggatagccatacatagttcattcaatattaccccaaagaggaataaccgatctgtcacggccctgctatgcgtgcttaatgcgtcgtgccgtcagattctttctaagtacatatagaagacgattgcaatccgaacataagaactaaatacgatagaagatatgatgaacgatagatgatcgacgttgcatcagaattccaaatccgaatccccgaactccggatctggaccacagtactcataatctgaaccccagaactcatctgacccccagaactccagttcttgcttggctagatctctcatcaccttctcgctgcggagacctggtagcaatatcagaaagcagataagaacacatgtgaagatcacacagaaaatcaaannnnnnnnnnnnnnnnnnnnnnnnnnnnnnnnnnnnnnnnnnnnnnnnnnnnnnnnnnnnnnnn

SEQ ID NO: 20438 - DNA, 593 bp, Oryza sativa
gtccgccacccatgcgcttgcgacgagagcgccgaccaggagaggttccacggcttcgtcaccaccatgctcctcaggcgccgcccgttcgcccccatcaaggcgctccggctgtgctggagccacgacggcgacgccaacaactggatcgctcatgctgtcaggcgtggggccgaagaaatcgatttctccgcgaggcatcaccaagatgatccgaaaccggagctagagtacacgagcttcatttctcacaagatcaagatcttgaagctgacgcgtgtccggatgggcatcaagtttatcacgcagatctgctataggtgcacttttttggaagaattagagctcaagaatgttaattcacttgaagggcagattcaatcgacctcgctgaagcgcttgtctatcatcaactgccttatctctgatggatttttggttgatgctccgaaccttatctcgctctgcttcttcagacctctcagcggtaagagcacggagggagccaatcactcgtctgataataggagttggccattctcagcgtcagtgtgggagtttgatgacgatggatctgatcatgatgatgattt

SEQ ID NO: 20439 - DNA, 773 bp, Oryza sativa
tgttacataatataaagcaagacaatcgtacccatggtttcacacaattgttatagctctagttaactagttcaggatttctagcaagaagttgtacttactcaaaaagctatgagacattgcaataactagcagatcagcagaagtgttgctatattaagattaatactctatcatgcgcacatcaaagataaataaagtattgtataattaatatataaggaaattatattacaaaaaaaatctagtaagaagaaactatcatacatagtcactagctatcgtatggatcctctcctctattctgacagcaaccttctggagatcaatcaatgctgtagtagtactttgcaatttcgtttgcaggctgaacaatctgcagacagaatgttgaatggtaacatgagagatttattgtttcaatatggtacttccaacctaaatagttcaaaaatgtggttctaatataacaagcaataaaagaaacaggcaactgaggatttaggggttgtttcgtacaagaaatacatatgcaaactgttcactatttgggcaatgcatgtggcaaagtaacatgttcaaaattgtaaatacattctcataaataatgaaatataatttgtccaaccagaagtgagcaagattttagcaattcgttatacatgctaagagtctacaagagagcattcataaccaataatcaggagaaactatatataatgcaaaaacaaaaagagaaaatgatgtgggagggtaccgagctcgaattcgcc

SEQ ID NO: 20440 - DNA, 922 bp, Oryza sativa
aattcgagctcggtacccaacttgtagctgggtagtttatgtattcagacagtttttatcagcatatgttctgatgcgattggattgctggtagttataaaatccctgtgctatctttgtagggcctcctgtttgaagagccttcggctcatctcatgcttgggtgtctcaaatgaaggaattgaggaggcaacaaaggaattccctcttcttgaggagcttgagctctcattctgctacaatgttactcatgaggcgtatgcggctatcggcgcggcatgcccacagctcaagcgcttcaggcttagcaaacgatccttctatgattcaggaggtatccgctggaaaaacaacgatgatgctggtggaatttcaaagatgcacgggctacgctccctgcagctcttcgccaataacctcacaaatgaaggtctctcaaccatcttggataactgccccaacctggagtctcttgacattcgccattgcttcaacatcgacatgggcgccgactccctgcgagcaaaatgtagcaggatcaagatgctgaggccacctgatgactcaactgatgactatgacttcgatgtgtacactcccaggaggctccccatctcccccggttttgtgcggtattattcggtgtattctgatccggaatattccatgtactcggatgaatggacgtctgaggaatttgatgatgatgatgatgattattccggtccttcccgctacgaggaagatcttgacaagtatgataacgcgcttcccaggtgcatgaggacgtttctgaaatgaagaactgcatgatttgatcaatgcgagtggaatttatgttggagttcaactatttttttctgggaatattttctccctttagattcatgtaagttcgttctgcactcatgttagttgatga

SEQ ID NO: 20441 - DNA, 866 bp, Oryza sativa
agccgggcaataaaaagcacgctctctaaaaaaatttatatgaatgcaaaatttacatacatgaagagcgtggagaaaattcttcccagaaaagaaaaggttggactcacattgataacacattgaccaaatcgtgctgaaggttcttcatttcaggaaactacgcataccccggggaagcatcttaatatcttatcatatttgtcaagatcatcctcgtagcgggaataataataataataataataataataataataataataataataataataataataatcgtagtcctctaattcctcaaagtagaatggattcctaatcatagtccaaactgatacaatcgacaagagaaggcgtgccttcttatggacaatataatgtctgctccggagcccgctgcttggtagcgtgcgaaaaggtctgccaacctaaagatcgcggagggctgggaataaaggatctcaggttgcagaatgacgtactgctgatctaagaggttgttccatacgcatagctcaaattcgtcatggtctacgtggctctggcaggaagctagggacaaatcgttggcggatgacctgaaccttggaccccactggcgcttcctccaaaactctcataacatccaaactctaaatgtcgtgtagaactgcctttgtaacccttcttttattaattaaatttaaatacgatgggataagaattaaccctaattaaaaattcaaataaattatataaaaataaaatatgagtaatattaatctagggtgaattcattagttgagataacacaaatattgagtaaaatgcatatatgcaaaatttagaattgtggaatcaaatttatatgggaaatacac

SEQ ID NO: 20442 - DNA, 2876 bp, Oryza sativa
tcccccccttctccaccccactccattccctccgcttctccctcttccccttctccacgcgccgccgtcgtcgcgccgccgcgccgccgttgtcgtgccgccgcgccgccaccttcgaagccgccgcgccgtcgccccggagccgccgcgccgtgcgtcgccgccttgcgccgccgtcgccgtcatcgccgccaccgccgccgccggtgagccgtctcccccccttcacctcgcgcccaccgccgtcgccgcccggggaagcaaagagccaagagagagagagatagaaagaagccgggagggagcagaaaaaaaaaaggagaggaaaggaggaaggagccgggaggagagaaatagagaaaaagagagagagggagagaaaagagagaaaaagaaagagaggagagaaaaaggagagaaaaagaaagagagggagagaaaagagagaaaaagagagagagggagagaaaagagggaaaatagaaaagaagaaaaggagaaaatagaagggaaattgggggagaaattaggaggatttaggaaataaaaatggtcggggttaatcatagattatttttggaaattcctcgagcgtaatagtatttcggtcgaaattccgagttaattataaaaatatgtttcttgatcagattagattaaaattggtagtaatttagatataattaataactaaacaattagatgaattcttatagactattatagattattttgggtaatctctataagtaattgattcacggtagaaattcggatttaatcactaggaattttagacgtatattatatttagtcgtttagtcctagactaaaatttaatcgtataatattataagataattttaggattccgtccgatatttagcttgcgatagaaatttccaatctattatatggatataatgctcgggtagattaaattaaaaacttatggcaacaaaatatttatacccgcaaaatagtttaaatcgaaactgggtttgccttagttcgcggataataaagttaatataaagaaatcgactttcgcattcgactttcatttgattcatttggatttttatttgaattctaaccgaattcaaatcaattttcgcacgtaactatagagcccgagggagttgcggatccaagcgaagatcaagacccgcaagacattgagcaaggcaagtcatcactattccttgaacatgttgatcctaattgcgaaattgttttgtttacaaataaaattgcatgcagtgatgaacatcctacttgtgattatgccatgccttgattattgtttacccttaaatctttgtaaccatgtttacgtatgagtccctagtcaacaatgacaattgcttagaaatgctattctagaatcatgcatactcatatttatcaaatgctatatggttgggcaattacctttgggaaggtaattgagatgcggcatgtggagacatgagcgccacattgccatgatgttgatgacatgatttgtgaaaggagaaataaaattaaacaactgttttcgactggggcggatggaggatttgggtggtatctggaaaaggctagtaccgtccccagtcaattaaggaccgagccatgaagttaagcatgaaacgacccccgtacaaccgtacttctcgaatgggtatagacctagcggattagatagccgagcggaggcagtatccctgcatagatggttcacccctaagtgaggcaggtgcgctacgatgggacggccgttgaggtagggccgagaagcgtgccctacatcggtgtcgccattggtaggactgccatgagtgtgtgagagagagaacttaacttgaaccataatttaatatgcgtgtgagacttctctttccccgggagcgccagaactcctctcactgctagaaacatggacgcctagagtgcatgaggatttaagttcatggagcgggtactgccaatgcgaggttatcgaaaagctttgccgtgacgcgtctcatgtgttgagacgaggctcatgtgttgggcagtcgcggagtgcgggtaaagtgtacatccaccgcagtgtgagtaaaccaaatctattcgaatagccgtgctcgcggttattgagcaccgggacatgtattacacttggctagactctaaattctttaacttgtgtgggatgggatattgcatgatgatttttatgctgatggagccacttcctgagaggcggaaatgtggacgtcctcagaaaaccataacgactcaatggcgggaagctatccttgggatcacaatggatggtggacagaaccgtcattgtttaatatgaacactggtattaaaatttgatcagtctatgctaggtcttaggcttgtgaaaagaattacaaaacttgctttgcgcgaaagaaccatagccatcctttgaattcctctgtcatgtgcatcattgttgtggtggcttgctgagtacggttggtactcacccttgcaaatataaaattaatcagaagcgggagatgaagcctcggaggatccctatgcctactaccaggagggagatgaagacgatggcgctcagtaggtcttagtacggtcgttgcctgtggcaatggcatgccgctgcctgaattccgctgccttatctatttctgcttttggatgtattccggaccgctcggtccgatgatttaagactgtgcctgcgggcttatgatgtaataattcatactagactctcgtgtatgagtacttgatatttcagctatgagttcgtgtgtaccagactacttgatccagggaaatggtactgtttacacgattgattcctgttataaaaacgggggtctacaccgagacggctcggcacgcgg

SEQ ID NO: 20443 - DNA, 9652 bp, Oryza sativa
  unsure (1)..(9652): unsure at all n locations
cggttcggtggagcaaggccgggtgcagctcgaggccgacgaggaagaggaagaacgtcgccgctgtgctcgtgtgctcggtgctgccgcttgccgtcgccccgtgcgccgggtggccgctgcatctcatcgtcattggcggtgggtccccggcggtgcaccgccgcttccttggccgcgcgtcgagccgtcccggttcgagccgttgcgccgaccgtgtgttgtgccgctgctcacctgcggcgggaggaagaagaagaaaggagaaagaaaagaaaaggaggaagagagatggagagctgacatgtgggcccaagggcatttttagcatttcacgcgatttctctctccttctcaactgaaaatcattattttaatcggcacagtgtccattggcaaattaccacgttatggagtgtttttccctaaaagtgagtttaggcagtgtcccacggctaaaaccacacaatagcagtgtcctatagcaaaatttgccttattgatatgattcgacgaaattgatcctccaaagcaaactaagtcataatatatttttcttcaaggtccttttctctccctatttctcagggatcattctgtaatttctctatggctgtgtttggaaaatgggttaggagaggtaggattggaaatgcaaatgaatgaagggataggataaaatagggtccctttgaagggtgggaaatcatatcccaaacccattttccaaacataatctatgtgaggaggtcttttctgtaagatacctcatattccaaactgacggcgtcatcgctgtcaaacggagaccgtcaatttcgaaccgggcgggatcgagaagattccagaaccagaagcacatccgcctcaaacacgacaaaccccccctaccctgttcatcttcgagagattcctcccaatcccgagcagaatcccccgccccggcgaatccgcgcggcgctcgaggtaatccaatccctcctcttcctccgccctccccctccctcgccgcgtcggctcgccggacggacggtgggttctccatggtgtcggctttctttgtgggctctgccgatttccgcgttcctgaggccgcgtagaatctgcataggagttgtttgggtagatttagttggcggaatcccccgcggtgtgtggaatggaggtggattagcttggctcggttcggtcccatgcgtggatatgctgggccgcctttggagcatttctttgtggtgtggctacccagctgtataataaacatggcgagtaggattacttcctgtgtagtcaatttagccattccatttagggatttctgattctgttgcaggtgtccgtggcactggtggtaccttgatagagactagagtgaatgcctttttctttgttctgtttcattgtttgctgcatcctgatgcaaattagctcggcctgtaaactgtaaaggttgcttgtttgtgtcgtcgagatgggatttagtgcgccgcggcagtttgatgatgaattagggccttagcaggttctttggttaggagaatgttaatccagggtgaagagcgaagaagaacaagtagctcattaagctgcaattcatggtattcatgaaaagttgaaacgatatgtatttcgtttgtaattcatttccacagcttttctgttaaaaaagacattgaggtgtgtttgttattcaagtagtggaaccacgtatggagttttctggaatgggaaaaaatcctaatggagcaatactgtgtggaggtcgagtctttaccgatacttgtcacaaaataatttagttattagctctcttttatgaaaggtagaagaatggttgtgaataactgggaatggttgaggaggatctgtttgtctattgtgtacttttgtgcactttggggctgactatagttttgtttgtagctttgcacaagatattagatgtgatgcctttgtcacttgctgaaatactgaattattttccctttgctgacagtgaatttgactagctagtagccacgcatgaagccagatggtgaaactcagcttcgtcctacagctgctggacatccagatcctggtttgggcacatcatctgcagaatacgtggcctctctaggaccagctacagtatgatctgttctctttcttgtctttagaaacatgacagtacaggtagtgcaacgactacctaggatccttttctgctcgaagttctgatggtaaaatttgactacaatttgatcaagaaataaaagatacattattatatgactaatttcttaccagttacatcgatacttagttcttttaccaaccttctcttatactgctcaggttcagccctaataaataaattatttctttttcaggctccagtatcttatccatatatcagtacctattatggaggcacttatggtgcttatagtggacaacctctggtaatttacgttaccgatatagtcagatatcagatttactatagcagctgatttttgttatctactttctttaggttaacgctgctttaatggcaatgcctccgcattctgtgcccttggtgaccgatgctgttgtagagcccatatatgtcaatgcaaggcagtatcatggtatattaaggcggcgccaatctcgtgcaaaagctgaatcagaaaataaggccaacaaaatccgcaaggtatttcctaaatattatacttgcttgagccatattttcaagctatttatcagacagggtgaaactgctttgccacctcttcaagattgttgttgaagattgacccatgccatcaaaacaggccttatcaaaatttcaagaaatttatgggaaaatgaaaattaatctgtttgctccaagttcagcatggttgtgacaacttattgggtttttacagtttcccttttgtttgtgaattgttcttttttttctgattgatacatccattgatctcatagatgaatatatgtgttcatatgtgtttggaatttcatttcttgctttcctcctttttcactgttgcagttatggatttgcaacgccttaggccccgttcgatctcccgtgttggagatggattttgttgcacgcaaaacgagaaacctaattagcacatgattaattaagtattaactattataaatttgaaaattggatttttttttcaaacaacttttatataaaaactaaaaaaaagtaccagttaacagtttgaaaaatgtgctaacggaaaacgaggaagttgaagtttgaagttgaagaatagaacagggccttagtctagaatcccacatatcagtcaattaaggggaaaattcctcactttggcatccttaatttgatcttctatagttattttgactgcaaaacttagattgtaccagattttagcaaggtttaaggggggcaatatatctaccctgttatttccatcttcctgagaatatctttcatctctattcaagtttctatcaaaactgactgtgctaactaatttaaacagaacaccattaaatgatattgtgagtttgtgacaatcttaatttagacgatatggctaatccaatagctttgtcgtaagtcacttttttcctttatattgataactacagaccgatagaagcaatttatggttaatttttttactaaggtgctcaagtaatgttctcctcactaaatttaatatagtttcacacttgaacacgtagaggaccaagcaaaaaaaaggatatgctccttgttctaaatgctttatcatgtttaatgggcactagtttctgttcatattgaaactcagttgtgttctttgtttctcatttctttggtaccatttggtttgttccttcttcagccttacctacatgagtcccgccatctgcatgctttgaaaagggcaagggggtccggtggtcgatttctcaactctaaggctgtggaggggaagcaagacactaaatctgtagataaaaaggatggagctgtgccatctgaggagaagagagacaagaagttggcaaatagcattatcaaattggagaactcgagcccaacaacacaaccaggtgcagatgcgtccgatgttgtatgatgcaaatttagccaatccctccctaatccaaccaaattgccagaatcgatcgaattgtgtgcttgctttctgttcgtgacagtttaagtctgacatagctgttagttttgatgattggataaatccatgatagtatagtgaacatgttgtgggagcagttcagtgctagggtttgttgctgagtgtagattatgaaccttgtgtcactgttgtgttttgcttctgttaatgaatggtagcttacaatgggaacttttgtgaatttcaggttgaacaatagttccttggaaataccatgagaataacttgtttacagaacggtttgttcattcccaaattcgctgaggacttgcttggataaaaatgtgtcactgttgttcggtgtgattgctaaccgtatatgataaaaatttcatgcgcttaaaagaagcaagaaagcgtctggagcaattcagcaatatctgtgtgcttagctgacctacgtgagcatacttggtgcacgttatgaactttttactcttcgccttggcaaaatctactcctgaaagcaatggcaaatacagaacagaaataggtagtgtgtgtggattgggggcaagtgtatggagattgtggctgaccacattgggaagggtggcagttgccttggaaggagagaggcaacaccggctagatgaagggtatggaactaatgaatgaaccctactcgttagtggtaaagtgtggttgggctgtcgaatgagtacgtacgaaggagaggagaggtgggccttgattcagactaatagagaagaggacttatatgtccttttcttttagcaaataatcataaatgttctatagtctattgtgctacggaaatttaaggaaatactaagttatttaaagcattgagagattttattaaaaatatatccaacacaacttcttgataaaattgtattccatggttctattttcttgtagaattgtctttaactgtattttaaacttcttaagaaaaagcctggcacgaatgctagaaactgcattttagaatgatttattaaatctcaaaagtttcaaataaccatggcacgaaagctgcaaaatgaaccaaattttgcttgactgggagtgtcagatcaaagacgatggatgattgctaaagttgaagaactcaatttcaactcagtgagctagaactactcccctccacccaccaccctccctccttccctaggtccactcgtggatggtgagttgaatgtttgtagagaggctcaatgtaattttttgcctattaaggaaaaactcatcatgtcattttttccacatgggggtagtgaagtggttgcaaatggcaagaaaggaggctaatgatgttgtcttccctaaatagggtgtgaagtcatgctgcataacgcaatacataggagaagaggagggaggagacgaggggtaatatgtctggtttgaatgcattgggagtaagatgtcctggtttgtagttgaaaaatagactcaattaagagctccatagataaaatcagactcctcttattttttttatttatcatatataatcctcgctttagcttcaaattccgtgtgtcatagatgttggattacaaatgccataaaactactttatatagtttcttttttgtcgatgttctagaagctaccgcagatgttgtaagcgagccaatgttgtcatgtgggccatacctttctccacgatagcatttactctttttgcgggtcccatgactcacaccaacaactaaagccaaaaaggttcaattttgcttatatcattcacctcttcttgttcttctccatctctaagcacttctacctaacgaaaccaaagaggagaagacttgtgttagtcggtgccatggacgagttagggatcatcgagcaaggcgtcgactggaggactcgccttggccaagacattcgcgattgcatgataaatgatatgtgagtgcactctctctctctctctctctctcacccaattcttacttttttttgccatgagaaattgattgcagtgttttgaatcgatgataatttatgaatattggataccctgctcgatgctatagtacttgtttagtgatctaattgaatcatgatatgtatcagtagtcagatctaatttgacgttttctagatccaagagttgtgataattctgtggcttgctatctaaccgtcacgataacctaaaaattggcatcagttttggtataaaaagttgttggtgaggttcaaacctttgtgtattgatcatacccatgtttagaaaatgatcccaattaatgaactaaggttgcatgtcgatagttctttaccaagttacttggccagttctttgcatgactctaagctttatggactagtattttagtactgaaacttcagctgtctgtcgattttttgttatattatttaactagtattttacttcagcgcctattctttccctgttcccaccatgaggaggaggaagagggagagacctggagaaaggataggtgattgtttatatgtatgggtatatgtaattgcttttaatgcaggtgataaaactcacaagaaagatgatcccatatgcatgctcccacatcattttctctttttctttttgcattatatatagtttctccttattattggttatgaatgctctcttgtagactcttagcatgtataacgaattgctaaaatcttgctcacttctggttggacaaattatatttcattatttatgagaatgtatttacaattttgaacatgttactttgccacatgcattgcccaaatagtgaacagtttgcatatgtatttcttgtacgaaacaacccctaaatcctcagttgcctgtttcttttattgcttgttatattagaaccacatttttgaactatttaggttggaagtaccatattgaaacaataaatctctcatgttaccattcaacattctgtctgcagattgttcagcctgcaaacgaaattgcaaagtactactacagcattgattgatctccagaaggttgctgtcagaatagaggagaggatccatacgatagctagtgactatgtatgatagtttcttcttactagattttttttgtaatataatttccttatatattaattatacaatactttatttatctttgatgtgcgcatgatagagtattaatcttaatatagcaacacttctgctgatctgctagttattgcaatgtctcatagctttttgagtaagtacaacttcttgctagaaatcctgaactagttaactagagctataacaattgtgtgaaaccatgggtacgattgtcttgcttcatattatgtaacataatacaatataatgtattggttgcaagatgctctacaccaattttatcgatctaattaaaaatgtttattactccttcatttggtatcgtgcacaagacactaggactgaggctgtattcaattaaagtttttcattttacatagttccaaatatttatgtccccttttcaatttattggcttcaagatgtaaatctctagattaattctagaatatattgattttatcgtgtgcactgattttattgtcatgcaattacttgttttggtggtgttcatatactccctccgtttcacaatgtaagccattctagtatttcccacattcatattaatgttaatgaatctagatatatatatatatatatatatatatatatatatatatatatttgtctagattcattaacattaatatgaatgtgggaaatgttataatgacttacattgtgaaacggaggaagtcccatttaataatatatgcacttattcttgacttgctagattgttgacatgttccttttgctatatatctttgtataatctttttgaaactcatatggttatggttcatcaataggatgttcagttttaaacggaagttctcataatttttttgtcttacacttagggtgattatctacggaggatttgtctgacaagaggtgatttggactcatatgatgtatttttgaatgattgtcaacgtcagcaagcttcaatccgttcatccatcttgctccatcaggagaataagcaaggtgatcaaattgtccaggcaaaaagaaatattaaggggacatcatctagcagtatgttcttgagaatttgaacaccagtgtactcagcagatatattgttttgatctgtttttatggtgcctgtatgacaaaagaattgtttgcttagtaaatattcgagaaaagtggttttttttttacccgagtctacacatgaatctaatgttctgcactagtttatacatgacaatacatcatacatgcaaagacaattttcaacgtctacaacctgatcccgtttgattaaacaagcattgtaatgtttttcttctttagacattggaaatttgggtgcaaaacgatgaatattagttattcttatgcaacggatgattcaagtgtgtacattgcctcctaattatgtgccccctttttttttcaaaagataaattggagctagcccaccgtactgacttatatcatctatgtaaaatgaattacagatggcaatctctctgtgaaactagagttaagcaaagcataaaaactacaaatttgttgtaagttgtttaggtggttctccaagatcaagtatcaacactaaggagcatgtgttagagtcaatgccagtaattgttctccactaaaataatgtaacacaatatccacttttatattgcaggtgtgctatctaatcaagtagccctaaatgaccacaaggagcactcacacccctacgagaaggatatgatcagcaaactccctaacgatttggtccaacatattatgtcattcttgtcaatgcgagaggctgtgcgcaccagtgttttgtcccattggtgggtcaaccagtggaccttcttgaagtccattcagcttaatatatattggtttcatatggacagagaaaaattcagtagtttccttgacaaactattgctaagccgtgtccaagctgatgctcccatggacacattcgagctaaaatcttttgcaattgaccgcgccaattattggattaatcatgcaatcaagcacaatgctaaagtgcttaaatttgctgaatatggaaaatgggaacctttctacttggatccaaatcttgtggagttaagttctcggtatctagaaactttggagctgactaatgttgctctagatgcgacgatattcaatcagttggccaatgcatgcccagcattgcaaaatatgctgctgacagactgcttactggaggtagaagaaatttcatcaagctcattgaagaatctggatataattgactgctatattctcaaggacctgagcatttgtactcctagtttggtttcattgtgcatcaagaatgaaagaacagacaattcttcgttcagaaactcttacctaatattcgnnnnnnnnnnnnnnnnnnnnnnnnnnnnnnnnnnnnnnnnnnnnnnnnnnnnnnnnnnnnnnnnn

SEQ ID NO: 20444 - DNA, 4163 bp, Oryza sativa
ctaatgttgctctagatgcgacgatattcaatcagttggccaatgcatgcccagcattgcaaaatatgctgctgacagactgcttactggaggtagaagaaatttcatcaagctcattgaagaatctggatataattgactgctatattctcaaggacctgagcatttgtactcctagtttggtttcattgtgcatcaagaatgaaagaacagacaattcttcgttcagaaactcttacctaatattcgcaacggccattatcattgatgcttcaaatgtcagtagcatggagttgttagctatggatagacaggtactgtactgcttgccctgtagcactgatcctttctcccaaacactctgtacattactatttgtttcatagttttactatttgtttagtatatgcatttgtacattactatcatacattttcatgtgaatatatttatgcaaatgaattttctttcataacaaggacacaacataaaacattcattttgcacggtatgtatatacccgatttcaaatcgacacatacttctctgaccaccttttttaccacaattgttttggatttcatagcattaacagtatttaagacttaagacatgtttttttcctgtgtacatatgaagttcacattcgtggagaaagacgggggcgagccaatgttcaagaatctcagaaacttgagcctaggtctatggtgcattaacaacatgttttcgcctctacgtcgattcgtccggcattcgcctatgctgaggatggtgactctgaggatcagtccggtcagtgccatccattgcattgcatcatccccatgcttcctgtgtccagcttctttttcttttttttttggttactatcattgttgaaagcctagagctctaatgatgctgcaaacctttcaacttcagctggattggaagtcccatctcacgaaggaacatcaggagatgctgatcagcattcgtgatcgtcgtggcctgattctttatatcgattggtattgaaggccaagggcttctgcggtgctccaatggtgaataaaattgctgccaaattaagctggttgctgaaacattgagaccaatttaagtttcttttcgttttaatcgcagtggatcaaacttgttgcagtaataattacctgttacttgactgcatgtgtcagcctggagtctggatgttgtctttgatgtggtgtcattgttacttatactgtttcattatatggatgaaccaatgagtctttaagaacctcatatcataattcacctgttagaattcatgcttgcttagtattcaggtaatgtcataaatctgcccagtttctagctttgcggcatcaaacattttttttttcaaacataatgatcctatttcacattctggaacttttacttctggtaactgtttgttagttctggccaactgacagccgacgctgtcaacttggcgcggatactggtaacattttgtggtcttgttttgatatgtactcatatttcagaatgttttgtgttttgatttgtcctaagttaaacttcatcaaagtttgaccaaggttataggagaacgttttttaacaccaaaaaagtatattataaaaatatattcaatggtggatttagagagattaaattgtgttgtaaatgttttataattttttttataaacttgaagtaatttgacttaggataaaaccaacaccttacattctgaaaggaagggagtagcgattagagttgattccgctgaactaatattttcacaattccaaagagattaagcctaatcatggtctatattttcaggcgagttatgaaattagtttttcattcgtgtctgaaaactctttccgacatccggtcaaacctccgatgtgacacccaaaaattttcttttcgtgaactaaacagacccttagatgaaagagacacacacactactacactcaaacacatccatagaaccttcctcctcttagtcaattgttccaagctatttattagatttattgtacataatatttaatatttagtattcatccctataaataacactatcatccatcaaccttttaactgcattccttccataaagaaaagaccccagcatgactttttaccccctccgtcctagccaaaaatgcatgtcttgaaattagaacactgtctatatagccaaatccccaataatagaatgagaagtttcattatatgccacctttgctgctgaggatactaattcttgttctgtaccactccgtcaattctagcgcgctgtccgccaacgtttttctgcttcctctgtcatgttgctgggcaccaccaccgtcgttgccgctcagtactgccaaaatcgatagcgtcaacctccccctctcatcaccctcctttctccgatgtcccctccaattttgcattctcttccccttgctgcaacctactccttgacccccaaacggagcccaagccggagctccaatgaccaaaatcaacctcgcagctccaccaggtatagctcctcgtgaaaaacccaccctgcatcgaatcagcgacactactagtcatcactattagcagccactataacgatattcacctgcaagctccacaacctccacctctttcaccgacaagctgaccagcaagttccgcggattatgttgtgctgacttcctcagccttgacaaggccgcatcaaccagctaccgcactccacgggtgcccttcgatgggatggcgataggagggagcgattgggagagggaaggggacgagggtgtttggaaaagggtggtgagaggggggctcgatgatgcagcaacaacaggggcaacagatggacattgatggactagcgtgcttggattgatggattgactcgaaacgaaagaattcgcatactcggcgataaatgataaaagacatgcaaattgagtggcaaaaaatttcgagagatttgcaatttgagtggcgtgtaataaaatttcttaagtagaacttgaagcctctcgtttgctactttttgtcatgcagattttcatcaaatttggatgaaagctttacaaatagtattgaataagatgttttccctttttttttcttcggtatctataatatctgatgaagtttaggccgtattattttttatctttaaaaaaaaaacctgaaacccgtcctggtgcttcgaagcaggcccgtcctcgattcgccaaaaaagcaagtccccaatctctccgtgagttctcttctcccacctcgtccccctcgatcgcctgctccggtgagaattctcgcgatagaattctttcttcttggttgatttcctccttgcgcgcgtgatgctgtcctcgtagctagcagaatcgcgctttggtggttgatgcggtggatcgctgtttccattgcaggcaacctgttcgacggaatgcagcagggagcggcggggcaggctgggccgtcgggtggtggtggaggcggtggcggtggcggtggcggtggcgcggaccgcctcagcgcgctcccggacgcggtgctcttccggatcgtgtcgcacctgggggcgcggcaggcggtgcgcacgagcgtgctatccaagcggtggcgccacgtgtgggcgtccgcgccgcgcgtcgacgtccgccacccctgcgcctgcgacgagagcgccgaccaggagaggttccacggcttcgtcaccaccatgctcctcaggcgccgcccgttcgcccccatcaaggcgctccggctgtgctggagccacgacggcgacgccaacaactggatcgctcatgctgtcaggcgtggggccgaagaaatcgatttctccgcgaggcatcaccaagatgatccgaaaccggagctagagtacacgagcttcatttctcacaagatcaagatcttgaagctgacgcgtgtccggatgggcatcaagtttatcacgcagatctgctataggtgcacttttttggaagaattagagctcaagaatgttaattcactgaagggcagattcaatcgacctcgctgaagcgcttgtctatcatcaactgccttatctctgatggatttttggttgatgctccgaaccttatctcgctctgcttcttcagacctctcagcggtaagagcacggagggagccaatca

SEQ ID NO: 20445 - DNA, 12923 bp, Oryza sativa
  unsure (1)..(12923): unsure at all n locations
nnnnnnnnnnnnnnnnnnnnnnnnnnnnnnnnnnnnnnnnnnnnnnnnnnnnnnnnnnnnnnacgcagatctgctataggcgcacttttttggaagaattagagctcaagaatgttaattcacttgaagggcagattcaatcgacctcgctgaagcgcttgtctatcatcaactgccttatctctgatggatttttggttgatgctccgaaccttatctcgctctgcttcttcagacctctcagcggtaagagcacggagggagccaatcactcgtctgataataggagttggccattctcagcgtcagtgtgggagtttgatgacgatggatctgatcatgatgatgatttctttgcaattgctagtggtggtgaacactttgatgataagagagacaatgaatctgatcaagacaatggttctagtgatgaagactcagatgataagagagaccaagaatctgatcatgatgaagatgttccctcttccccatattctgattctaaggactcctgtgatggcagtgacagtgaatgcgagtcttatgaatccagtgataaggagggtgatgatcttgaagattgcgacagcaatgatatgttggaaaacttgatcaaggtagctaggggcttgacagcttatcatggagaggtaagtttaatcgccttgctgatactatttcgttattttatttgtatgcttttttccctgcagtactgcacgcattgctttttctcaattctttgcaagaagatttccattgtatgggaaacgaactaattgccagtgtaataacagaattgtcttcataaactaaatgtgtagaaggaagttttgtcagttctgctggtgatgagattcccaaattagtatagctatctcagttaatagtgctagtattgctgatgttagagtactgccactcaaacaaatgaaaatactactgttgtagcttgctgagggcaacattaagaagttccttactaattgatcagccaaatgaatggcaacattaggtactacggcaagttcttatgtccgtacctgatctactagtgtgcaagtattcaataacttttctctatggtgttgaactttgattatatcttatagttgacttcttgttgtgccttaattagaactctcaattagcatcttttttttatttgtcgaattctccatttgccttggccagaagaaattatttattttgtcatataagaccaagctagcacattagtttctcttttttagataatggaagtacaactcagcacatagttactacagcattacaataccaatatctcacaaatatttcacaattgacttgagagaaaccttgggttcttctcataccaggagaacaattaggtttccattctagaacatttgttggtagtgcgacatgtgtactaactgattgctaaaagtgccagtaactttctaggcataggttggtattcccctgatgattgcaaacctgtgatttttttcctctaatctggtcttcatgtaccacttctgattttatggcacatattgtagattcgtagtagtgctctggtaggagaaatgttttgggccactgaatcacttgatatgtatggaaatgtgcaggtgcttctgaggaggcaattggaaaatttccccatgttcaataacctgaaaactctgtcccttggtgaatggtgtatggttcctgacttcagtgctttgtcaaccatacttaagaaatcacctaaggtagaaaggctttatcttcaccttgacatggtacgtgtactcatatgcttgttaaatgtttgcttagagtgtttaagcatgttattaatcccttaaaccattgttttacaaaagatccacagaggaagaggggacatcgatccaagtggaggatcatttgcttgcaacaacctgaggaaggttaagatcacatgttgtaaagatgatgaaatggtccatatgctgaaacaattcctccaacgtaacggcatatcacttgagaagattgttcatcacacttctagcactcataatggcgaagaagacggaggcggggactccagtgcgaaacggaaggcgcaaggcgaagttgcgaggctagcagtgaaacagaggagggcgcgaaacagtagaagcccggagtgaggggaacatgtttaaaatgctgaggaatccagtgctgagtttacattgcagttagcagtagaattcttcacaggatgtgtatatgcatcaaatctagtacaggtactttggggacatgaaaaattatgcatccgttggtgttgcatgaaaatagatcgttggtcaatgttcagtgacttggaatcctgtgaattgctatatgcctatatcatgtttgatgtattgagtagtaattggcagcggctacatttggatttgtgattccacgattgtctggccttaatctcgtcatggtgtcgatgtttgcaactatgttcatactcccctaaaaaaagagagaaaatatgcccttactctagccaaattaccatgtcttttcaagcatgtctatgggaacattatagcatagctggtgtttgagtgatcgtgtaattcgcacgtaattaccgaagaaaggagtacgcacagtatatatttctatccaggacagtattcgaaagtaagagccccattggttgtcctaataaaccaaaaccaaagtcaaaatttgaattttcaaatttaaatttgaagttgattttaagatattttcaacgtggtagtttcttttttaggattggcttttaagtcgctaaaacacatatataaagttttatgtataaattattttttatttactaataaaccgttttgacttaataggaaatatggtcaaccgatgaggacctaaccactgttggaattgtattggctgatagatacataccatttctaactgaaaaaaaaatacattttactcctactaactatttcgtcatcgcacgaaaccccctaaattatttttcagcttattttacaccctcaactattaaaaacggttcactgaattcactttagttcataaatggtatttatcttttcttctctctatatataagttgtatttcacactaaaatacaaatatatactctcttactgctattactattatatttgtgtaatgaataatcgaaattagttgccacaaaaaatttacccctgtaaaatccaaaacaaatttttttcagactataaacatgtttaaaggtaaatactgtagtagtagtagtacaaaaaatgaaatcggaaatttccagaatcgacattcttttttttccactggaggaaaattaaacaaacaaatacgtatcccctatatatattgggcatttttggtagttccttccccctcgtctcccgaagcgcgaagccgttctatcggaactcgaaagcagcgagagctcttggcgcggcccatcgatttcgccaagaaatccccaatctctccgtgagttcttctcctcctcccctcgatcgcgtgctccgatgtgtttcttgcgattctcggtggttttccgctcgtcgtagctgagcagaaacgttcgttgtgggttcttttgattcggggagtcgacgtgtccattgcaggcaacctgttcgacggaatgcatcagggagcggcgcggcaggcggggcagtccggcggtggcggtggcggtggcggtggcgcggaccgcctgagcgcgctcccggacgcggcgctcttccggatcgtgtcgcacctgacggcgcggcaggcggtgcgcacgagcgtgctctccaagcggtggcgccacgtgtgggcttccgtgccgcgcgtcgacatccgccacccctgcgcctgcgacgagcgcgccgaccaggagaggttcggcgacttcgtcaccaccatgctcctcaaccgccgcccatttgcgcccatcaaggcgctccggctgtggtggagccacgatggcgacgccgagacgtggatcgctcatgctgtcaggcgtggggccgaagaaatcgatttctccgcgaggcatcaccaagatgatccgaagccggagctagagtacacaagcttcatttctcccaagatcaagatcttgaagctgacgactttcgggatggacatcaaggccatcacgcatatctgttctaggtgcacttctctggaagagttagagctcaaggattttcgacgacttgatggacagattcgatcggcctcgctgaagcagttgtctatcatcaactgctttatctctgttgcctttttggttgatgctccgaaccttatctcgctctgcttcatcagacctctcagctttgagagaaccaaggaatccatttgctcgtctgataatcgtaggtggccatccccagtatggaaggatgacaacgatggatttgatcatggtgatatctttgcaattgctagtggcgaacactttgatgataagagagagaatgaatctgatcaagactatggttttgatgatggctctgatgataacatagccagtgaatctgatcatgatgatgatggtcccccttccccatattctgtttcctacgatggtgacaatgaatgcgagtcttatgaacccggcaataaggaggagtctgatcgtacagtggcctatggtgagattgcagatgagtactccagtaatggtgatcccggtgatgaatatcggggaaattatgtgaaccatgattctgcgaattacggtagagctaataagtttggaaatttgaacttcccagtgaagtcaattgtggatgcgtcagctcatgaaggagaggtaatatttaatcaccttgctgatactatcgtgttctcaattttgtatgctttttctaaacttctttgcaacaaaatttgcagtatggaagaggaactagttaccggtgtaataacagaaatgtcttcataaacttaatgtgtagaagagtgttttgtcagttctgttgatgacattctcaaatcagtatggctagctcagttacaaagagtactagtattgctgaagttatagtattgccactcaaagaaatgaaaatgctaccgttgtagcttgctgatgacaatattaagaagttccttactaattgagcagccaaatgaattggtgtcacccagatgacattgtatatctgttaggtactaccgcaagttatcatgttcctacctgatctactagtgtgcaagtattcaatcaccttctctttatggtgttgaactttgaatattatcttatggtcgacttgttactgtgccttaactagaactctcaattagcattttttttttacttttacctgtcgatttttctgtttgccttggccagaagaagtttcttttatcatataagaccatgctagcacattagttactcgtttctagataatggaagtacaactcagcacttcagcgtagtcactaccaatatctcacaaatatttcacattgacttgagagaaaccttggattcatttcataagtcataacaggagaaatttaggttgccgttctagaacatttgttgctagtgcaacatgtttactaactgactgctaaaagtggcagtaactttcaatgtataggttggtattcccgtgatgattgcaaacctgtgatttctttttacctgctcatctaccacttttgattttatcaatgcacatttcgttgttctctggtaggagaaatgtttttggtcactgaatcattttgatatctatggaaatgtgtacttgtgcagctgcttctgaggaggctattggaaaatttccccatgtttaataacctggatactctgtcccttggtgaatggtgtatggttcctgacttcagtgctttgtcaaccatacttacgaaatcaccaaatgtaaaaaggctttatcttcaccttgacgtggtacgtgtactcgtatgcttgttacatgtttgcttaaagtgtttaagcatgttattaatcccttgaaccatcgttttacaaaagattcacagaagaagaaggtgcatcgatcccagtggaggatcattttcttgcaacaacctggagaaggttaagatcacatgttgtaaagatgatgtaatggtccatatgctggctccattcctccaagataacggtgtatcgcctgagaagatttttgttcgtcgcacttccagcccacataatggcaaggaaggcagaggtagtaactccagtgcgaaacggaaggcgcaaggcgaagttgcgaggctagcagtgaaacagaggagggcgcgaaacagtagaagcccggagtgaggggaacatgtttaaaatgctgaggaatccagtgctgagtttacattgcagttagcagtagaattcttcactggatgtgtatatgcatcaattctagtacaggtaactttggttacatgcagaattaggcatccgttggtgttgcatgaaaatagatgattggtcaatgttcagtgacttggaatcctgtgaattgctatgtcatgtttgatgtattgagtaattggcagtggctacatttgtctttgtgatttcacggtctgatcatctggcctaattagttttgtcatggtgtcatgtttgcaactatgtttatactccccgtaaaagaagaaacatgttcgtactgtagccacattatgctcccctaaaaaagagaaaatatgttcgtactctagccacattagcatgtcgtatgctctagtacagtgcaggatagaaataaaaacatctattttactcccccgaattattttacttgatcacttaacccctaaactattttctttctcgttttaactctaaactgttgaaatggttcactttaccatgctagaatttatacatagtagaatcaccaccaattcactagtactcccactacttctacattctttcttcttgctattactattatatttttgtcatgagtaatcgaaactactacctgtaaaatccaaaccaaatattctgagactatagtctatatcttactaaccgatttcagggtaccatccctggcacttgattggcccacgtggtatcctgaaaatttagcgtacatcgtctgaaattttgccacgtggtagaggatggagcatcattccattaatcagtgcatgagcagaaacatttcctaaaacccagattgccgtgtgaactttccagatcactccacacatagagaaggcaaagatgtaaaagagctgcggctgccccttcaatattcatagaattaaggctactatttaatactccctctataaatttttattgtgagtatttgttttgggtagcaataccaagaagagtgtcgaatttgattaattaaggctgtgttcgaatgttgatgttggaaactaatctctagcacacgcaaaacgaaacaactcattatggcacccacaatggttatctataggctctctataagagatctatgtcagcatattttcctacatggaagatattaaatgaagagagagagcaaagctatctactaatttagagatagtctatagagaaaaacgagacaatgcatgagagagctatagatacccatgtagacatactattgaggcggtttattattaatctagtctattgctgagatgtatatgttttatagatagcaccttactttaccattgcaggtgctcttagcatatgatttattaataaatactcattagcaactcattagtttcaaaatactggtttaagtacctacatgagcgattttcctttcattgaagcatcaaaaccccgaagcaaatctggcatacgtacaaacgcttttgatcaacaagattgcaacggactttactttaatttggtaagcttaattatgttacccggttacccccatacagctctacagaatatccgaacctttggaatcattcaaatgttagatgcttatatatattgctcatttcagggcattgctgcagaaattgtacttttgaaatttggaaagcaagaatccaacttcaggcgagcctagctagacgcatcgaaggcatagtacggagtatgccagaagaataggttgcaaggtatctcctatgacgtattctcgtatgaaaatcatactacattcttttcaaaatgtatgatgtcattgacttttcacgtaacgtttgaccatttatcttatttataaatttaatataaatataaaagagtataagttaatattatagtttctttgataataaaataaatgatatttgtataattattttgaataagacggatagtcaaatgttatgtcaaaaattaacggcattatacattttaaaatagagggagtattattctattcgatttctttgaaccacaaactaaaagttccgccgagttatgctactgtctaacaatttagtacaccatatgccaatctctgtatttgccgcgcagttttctagtacatgtttaaattcaaatactacaaaaaaaatgacatgggaagtttccagaattgacatttctttttcaccggaggaaatttgaacaaagaaatatcccccagatatagtgaggactagtatatatattgggcatttctggtaattcctcccccatcgtctctcgaagcgcgaagccgttctatcgaaactcgaaagcagcgagagctcttggcgcgacccatcgatttcgccaagaaatcccccaatctctccgtgagttctcctcctcctccccttcaatcacctactccgatgtgtttcttgcgatcgaattcctttttcttggttgactttctctttgaacgcgtcacgatgtgttcattgtccatgtgcaggcgaactgttcgacggaatgcaccagggagcggcgggacctggcccatccggcggtggcggcgaccgtctcagcgccctcccggacgcggtgctgttccggatcgtgtcgcacctgaaggcgcgggaggcggtgcgcacgagcgggctctccaggcggtggcgccacgtgtgggcgtccgcgccgcgcgtcgacgtccgctacccgtgcgcctgcgacggccgcgccgtcgaccagaagagcttccgcgacttcgtcaccatcctgctcctcaggcgccgcccgctcgcccccttcaaggcgctccggctgagctggagccacgacgaggacgacgtgagcgcgtggatcgctcacgccgtcaggcgcggggccgaagaaatcgatctctccgcgaggcgtcaccatggctacccggtgccggattacaaacacttcatttctcccaagatcaagatcttgaagctgacgcatctcgggacgacgaggttcacggccgacaacaccctcgacctgctctgctctggctgcacttctttggaagaactggagctcaaggatatcaaatcactctgggggggaattcaatcagactcgctgaagcgcttgtcgatcatcaactgccatgtgacatccgatggcttcctggttgaagctcccaatcttatatcgctctgctgcatcagacctgcccgagctgttccttggttcagccacatggtgtcgctggtggaagccactgtcgtgcttgatgattctcgcttgagtgatgactatcagcagccagtgttggaggatgacaacgatgggtctgattatgatgataatttctttgcacctaaagctgagggccctgatgataagagagacaatgaagctgataatgactctggtgataagagaaatagggacggtagtaaatctgatcttgatgatcatgatggtgaatatgatcatgaggatggttctgagtctggtgataaagaggttgatgatcttgaaggtggcgatgatcgaactgtgacctatggtgagattgcagatgagtcttccagttatggtattcccattcccagtgatgaatatggcggaaactatgggaaccatgattatactattttcggtggtgatcatatgcttgaccacttgtcagatgttagaactttgggtctgttaggccatcaaggagaggtaatgttgtcaccttatcgatactactgccttctcttactagtatgctttttctaaagtgtgcacgctaattatgctcatttctttgcaagcaaatatggcaatgttggcaatgtgttgtatgggaaaggtactactattgagataacagaactcccttcaaaagtttaatgtagaagaaagtttggttatctctgttggtaatgagattctcaaatcagtatggctcagtttaaaaatacagagtactagcattgctgacgttacattacttgccttaagtagcatcctttcgaaatgcttccatcatagtttgttggtgaaaatattaagaagtaccttatactaattgatcagacaaatgaattggcgtcacccaggtgacattgtattgtagataggtactactgcaagttcaaatgttcctacctgatctactagtgcactagtattttcaatgccataataaagtctaagttacttctctccgtattgtactgagttttgaatctaacttccagtttgacgagttatgatatcttaaaagaactccctagaatcagcatttatgtttttttttatttgtcgaattttctgtttgcttttggccagaagaagttatccattttatcaaacaacaagcaagcatattagttacctcagcactagaataccaacatatcacaaatacctcagtttatattaattaggagaagttttaggttggtattctggaacattcgtcgggagccaatacgtgtactaactactaatcggggaactgaaaatgccagtaactgtccatggacatatcttattactctggtaggaccaatgttttgaatcattgaatcttttcaatagaataaacgatgcatttctgtgtaaatgtgcagatgcttctgaggaggcaactggaaaattgccccattttcaataacctgaacactctaacccttggtgaatggtgtatggctcctgacttcagtgctttgtcaaccatacttgagaactcacctcatgtagaaaggctttatcttaaccttgacatggtacgtttactcacacgtgcttgtaaattgttttcttagcatttaagcatgtggttaactacttaaatcatcattttacaggacatccacagaagcagagggggcatcaacccaacgggaggatcatttgcttgcaacaacctgaagaaggttaagatcacatgccgtaaagatgatgtaatggtccatatgctggcaaaattcctccaacgtaacggcatatcgcttcagaagatttttgttcgtcgcacttccagcactcataatggcgaggaaggcacgggcaaggactccagtgcaaaacggaaggcgcaagacgaagctgcgaggcgagcagtgaaacagctgaggagggcacgaaacagtagaagcccagagtgagggaaaggtgtttaaaatgctgaaaaccggtatggatgttgaggaatccagtgctgagtttacattgcagttaacagtaggattgtctactgaatgtgtaactatatgcacagtgttagtacagttacctggatatatgaaaaattttgcattcgttggtgttgcatgaaaaaaagatggttggtcacaatgttcagtgacttggagaatcttgtgaactgctgcatcatgtttgagttgcaatgtttgtatggagtaactcgctctgactgggcaaaatgtcgtcttagcgaaaattgaggagtgagctctgggttcgattctgattttattttgatggaatcgcactgcgtgaaatggcttcaggaataaattgagttttaggttgtgaagagcagcatcatacaatatgttttgttttctttttggttctcgaaactatgagatggacgaaagacatgcaattctgcatttttatttaagtaggttagtatatatctttcaaaaaaaagtagattagtatatacggtgagattgttcataattaaaaagaaattgatctggggaatttctagaatcggcaaaaaaaattcattccaatggagaaacattaatacacaaacaagagcaaatttcagcaaacaccatgtattatatgattgaagttgcataaaacccaggtattatggcttgtcacataaccccaactattgtggttctaaaatttttcaaaaccctacccctctacatatttggtatatatttacttaaaattgtaaaacatagaatgtgtatgaatctttttagttattgattgattgaggttgttggtttaaatcttcactactttaaaagatattgtctcaaatatgttgaaatcaattgaattttaaaacataaaatgtgtagttatatgccaccagtaatatatacatggtttactggaacttttgaccataaaacgtgtggttttacaaaatttactcaataaacaaaaaggtttggattaccccataaactactgcgatggtacaaattaccccctcgaataacaataccagacatcattcaccctcaaaattccttacaggatgaattaccccccactccattggctttggagcggttttcatcttacgtgacgcacaagtggtagtccattcagcataaaaaaattttaaatggtagggtccacatgtcagttttgcttcttcctctatatattggtctcttctttcctgactcatctcggtcgccgtggatctctgcccattcactcgcgaacaaataggtggagggagagaggaggtgaggtggagcgcatcaggagctcaatgagatggtggtggtggcgatggaggcaagaagcggggagtagacaagtacctctctcaaacacctcatggaattcgccaccgaactgagctctaggtggatctgtcaccaccccgatctccacgtggaacagacaccacct

SEQ ID NO: 20446 - DNA, 1149 bp, Oryza sativa
ctcggtacccgagaggaggtgaggtggagccgcatcaggagctcaatgagatggtggtggtggcaatggaggcaaaaaacggggagtagacaagtacctctctcaaacacctcatggagttcgccaccgaactgagctctagttggatctgtcaccaccccgatctccacgtggaaccgacaccacctcgagcttcgcatccaatcatctccacattgcgataggtctattaccctacatggccattcgactttgccacctcgccaaccccacccccaaagccaatcccttgccgctcgttgtcatcgccgtcgccaccaccacagaagaagagagccatgactaccaatctagctccgccatgctctccccccccccatctctctctttttcttccccatctcctggctacgtcgagctcaagtagcttttcacgacaacagcctcgtcatcgttggcgccaccgccattgtagcccaattcgccgatgtgttgattccgtctcggtcactgtcaccacttttaaaatttctttatgctaattagactaccctttagagcaagtcagggggttattcgtttggtacgaaaagttgaggatgaatgatgtctaattttataattaaggggataatttgtaccgtcatagtagttcagaggttaatttaggctgtcttcgctccatcgtgtttccaaccggaatagtgcgcatggaaaacagaacggtccattagcgcgtgattaattaagtattagctatttttttcaaaaatggatcaatatgattttttaagcaactttcgtgtataaactttttgaaaaaaacacaccgtttagcaatttgaaaagcatgcacgcggaaaacgaggaagatgagttgggaaacctgggataaaaagccctacaccttttctttttccataaacaatacactagttcttaggcctatatatactgggcattttcggtaattcctcgccccttgtgtctcgaagccgttctaccacctgctggtgctccaaagttgaaagtcgaaagcagcgagagctcttggcgcccatcgattcgccaagaaatccccaatctctccgtgagttcttctccccctcccctcgatcacctgctccgatgcttttcttgcgattcttg

SEQ ID NO: 20447 - DNA, 1299 bp, Oryza sativa
ggctctaatttacatccatgtcattcaaagcatcttgacaggaccattcttaggaaactattctaatccctcgaggggatgttccctcgtttgctcaaaaaccatttaaacggttatgaaaaattctgcaaaaatttgacaacattcatacaacacatatatacaacttcacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactctacattgtcatttttttcagattttttcacaactatttgcattgaatttggaagaaaaagatatacgaggggatatcccctcgagggattagaatacactccccattttcttatgtatgtgtgggaccaccaggtttgctccctttgggccatattggaatactgacatgcagcagttaacatattggggcattggcctatgcgcttgtgcttggccggctctcatgcaagcgtccgcttccctctctctccaacactttctcacttccacgtaggcgaaggttagctaagggcaagctcagtatatcctacccaactcggtaggagggtggacccaaacagtacatagcaatagtatatcacaggaagccacaaagcttatgtgcaatagggaggaataaggtggacccctcttgaaaaaggcaaattttgctacaggacacttgttatgtgtgcttttagcccaaggacactgcccaaactcacttttgggggaaaacactctataaatatggtaatttgccagtggacaccgtgccgattaaaataatactttctggttggggaggagatagaaatcgcgtgaaatgtcaaaaatgcccttgggcccacatgtcagttctatctcctatctctctcctcatctctctcttttctctctcttttctctctcagatggcgaggacagcggccggcggggtggagcggggcagcggcagcggtggacgagtgcgcagccggcggagccacccctcgccgctggcgccgtgcccatgcccgctccgccaggcgtggggcagcctcgacgtgctcgtcggccacctccgcgccgccttcgaggagcacggcggccaccccgaggccaacccattcagcgcccgcgccgtccgcctctacctccatgaggtccgcgacagctaggccaaggcgcgcggcatcgccgtccggcgtccgcccacct

SEQ ID NO: 20448 - DNA, 6317 bp, Oryza sativa
  unsure (1)..(6317): unsure at all n locations
ctgccgcgcgctcctcagcgccgctagctgttgcctaccgcgcgctcgctcgccgccgctgccactccgctcggccgacgctacctctccgcctgtcgcgcgctcgtccaccgccgccgccgccccgctacactccgccgcccgccatcctcgccatctccgccgctgtcgacgccaccccgtgcgagcacgctctgagagagaaaagagagaggggtgaggagagatataggagatagagctgacatgtgggcccaagggcatttttgatatttcacatgatttatctctcctccccaaccggaaagtattattttaatcggcgcggtgtccactgataaattaccacgtttatgaagtgttttcccccaaaagttagtttggacagtgttctagggctaaaaccacacataacaagtctcttgtagcaaaatttgcccttgaaaaaacatcatcgatgactcaattgtacacctgcacgtggcagccagttgctttcatttcattttttactccatgtgtcaggcatacagtgcttcttaccgggtattacctatatgaccagatagtagttatttatcaccctcacaatgcttcttatcaggtagtaaggatacattgaatgcctaatacttgatttctagcaacattatggatgcccttagccagttattgtacccactctgacaaactctccaggcacttttggcgttatcaaattgtttttaaatctgagttaaaaattttttaaatctaagttgaaagtttttaaatcttgacttaaaaatttgcaaagctaaccagaaagttttcacatataagtctaaacttttaaatctatacttgaaagttttcgaatctaaattgaaaagatttcaattcttgatttcaaaattttcaaatctaagttaaaagtatcttttagtcaaaaaaaaaaagaaaaaacacgcacgggaggaatgctttttaggaaaaaagaaaaggaaagaaaacagaaaactcgcacgggaggattttttttcttgatgcggaacgaaaaacttaacagaaaagagaactcaccgcttcctttgcatctggtgcacgctatgttgaatcctatatttttacaaatgctatattgtttataagttgcatgcgatatcgcaaaatgtgagattttggtagaactcttatttggtgcacttatcctccgtgactattgattaccttactgttggcacatctaggatgcgttgtgatactgtccaagtgccaacttgggtatattcgcgctactaatatagctattgcttagccatgcttagagtttcgtatgttacaaatgatggatcattcactcttcaaaatttgggctatttaaaaatattggacagaggtgttgcccctgatatttgtgaagttgaaaactaaaaagtggtgattttagacttgggcggcaaatgttgtgcatatggtggtagttacataccgatagggggagtgttcacccgagtcgattaaggaccaagctatgtgtcaccaactaaaatatatcgtgcaaccacatgtgttatttatggggtaaccttagcctactatattgcttattacttaaccttgcattggaaggtcaaagtagtagggactagtctgagcgatggttcataggagctaccattgtgcctctatggaaatggagtttgttccccatatgccttgggcgtctgagcatgtccaatataacgaatggtgcctcgttaagggaacggatgtgtttgcctcgcgatgttgggattaggatggggtccacctttcgtagcaacattggttcatggccaatgtggagaaacactctccgtgctcatgcaagttaatctttgagtaatgtagtggtttcgtcataggctagcaaaaacgggtaccggttggtatcgcatggcatggttaacatgattgctagtatatgtcatgtgggtatagtgtacaaactctgtagagtttaaactaatcgattagccgtgctcacggtcatgagcgacttggtgaaataatacaagtttagtgttggtcatttaatacatgttttgtgaaattggcatggtgggaaattggtgatgattttgttcggtgtgggttgagaataaaatggttacttgctgccatggagggcacaaggatgatattaatatggtgcttatgttactattactattttttatttattgctttataaatttcgttgcaatatattattacttactattgtgaatcaaaatttgctttatgctgaaatttggtccacaaacatagcctactttgatctcaacttgcaaaagacataggcttgccaatacgtttgtattaacccacctcttgttgttgtttttagacattgatgcaggaaatgatatgtctagtgacgcgtactttgcaccgggtatcggaggtttcgaggatggttatttctaggtcggttgcctgtggtggtttgatagatgggcataccgaagaacttatatattttgttactgttcccgctgcgtctaaactcttccatttggccggtcagccctatctatattgtatgacttgtgcactcgctaaattatgtgaaccatgctatctatttgtatgtgtattatgtgtggatgtgatgataaggttgtggatgcatgtactagccactgattctgggagtagtacgttgtacgctccgagtattcgggaattgcatccccgggtgccgacaatcaatatgactcacttaattagaatatactagtacgcgatgtgaagttggtacataaaggaggggggtgatgcatattatttcttgattttgtggatcgagagaagacaagaaggtagaaatgaacgaactctatcaaggagaaggtttgagaggttggttttgtccatctgtgtatcgatccatacattttttttatcagtcgatccttgcagattatctcccctacccattatcttcaggataattatctccaggattgggaggagataatctttagctaccatatcccaaacccaccagaaaagaaaagaaaagctatcacatcaatgaaggtatcgaccagggaactgaaaattaatactgaccaatataagtacctgaatattgtcttttaagccttaacgaaactaatatgagcttgaatatcgtcctcaagcaatatgaaaactactaccgagtaaaagactgccggtactttctgagaactggagtaccataggttcaaactatcaattgacagacatgggacatgcaacgcgagcttcagagagttgagcgaaaaaggcgagcatctaagcacttcacttcctggctccacacttggatggaattcacatcaggagcgcacgcaggccattgagcatcatcctggcttcatcatccagctcgtcctcgttgatatcatcatcaaagcattcattctcctccgagaacacgacgcagtgaaggccgggaaccatgtaaccgtcatccatgtcatcagaggaattgcctgaatctgcaaaaacagggctgaaaacctgcaagtcatagtcatcgattgagtcatcggggagcctcagtgctttgattctggcgcacttcgctcgcagggtgtcatccatgaagacattgaagcagtggcgtatgtcgagggattcaagatgggggcagttgtcaaggatggcttccaatccttcattggtgatggtattgccgaaaatctgaagggagcgtagctgagtcatagttgctatccccagggcttcatcatcatcgtgcgagtcttcgaaactgtgaaagccatgttgactcagtctgaagcgcttaagctgtggacatgattttccaacagtcctgaacacatctgtcccaaaaacatttggactgagtgaaagctccagctcctcaagcagagggaacttctttattgcttttccaaaccctttgttagagacatcataacaagagatgaggcgaaggctcttcagacctggtgctctgcaatggtagcagaagttggatattaattaacaacaaatgaatcagcgaatcaaataaccaacaagaattctgcaaaaaataaccagcatttatttagctgcacaaatgcaggcatcgtagagaagcggtgtacagaaaaaaattggcctgtcaatgattaaatttataaaactatcagattttgtccaaacatatttaagtggcaagaattggctggacgctggagcctgcagttgactggagagagtagcataaatactgaaatttggcatacattcaactgaattcattctgtttcaggattaaaatattttaatatcatctccaatatgtcgtttcaactggtaatgcttcaaatcccagaaatttactcacatctgcattctacttcgaatagaggaagagacatttcctttgtctctaagctaaaatgtcaggagcctattatcaatgcaatacataaatacaagtgtgccagtaagtttaagagacaacgatgcttttgtttttcagtgtggatgacttggcaagtggaacatattagaaagacaatcaaagatctgtattatctaattgcggtgtgaagggaaattcagcagcaaattttgaagaatgttacagtgatgggttattcctattgatttacccacatatttgtagaatacttcttttttttcttgaagtttctgggcctaggatctaatgaaagtgctcaatctggtgcaaccatgagaagccatcaccttctaactagtagtaaaacattgctaaaatttcgatgaatgcgcacaaaaaaacagccatatacaccaatggttaggacagcattgaaagatgtaacggtaccatgaggggattcggaataatcaatctactatagtatccatgtaaataaacaacatgctcctaatgacgaaaacatgtctaaatgtagtcaaatataatacaccaaaaatgaaggcgctaattaagcgtctaaatgtagtccaatagaatacaccaaaaatgaaggcgctaattaagcattagaccaggagcagaaatgcagatttgaacacggggtcttccggctagctccacaaggtggtgggctagacgacctgggttcgaagcctcaccccttctaattatttgatattaggtccttccctaatattcgtggttttttttcagatttgaacacataacacgcgtttgcataacgaatataaagcatgtaattaaaggcccgaaaatcaggggatccccccgcgacgcgaacacaatagcccaccaaataattcaaaccaaagcatcgcaatctgacgaaacgcaagcaatcacggaggacgaatcatgtaaatgccctaacaaaacaaaaaattaggggattgaggggatcgaggtctcacgcgcggccgaggaagaggaggaagcggtcgcttccggccgactcgccccagaacgcctcgcaccgccccgcgctgcgcttgacggcggcctgcgccatcccgtggaggttcaccccccgcttggcgtcggcgttggcgtggccgcgcatgtcgacgcggcgccacaggcccggatcgtcgcgggccgcgcggcgccaggagcggcacacctggccggcgcccgtgaggatgtcgacgtggtcgagccccccgaggacggccgagatcgcggccggcggcagctccgcccagttcctcgccgcctacgccttcggtgcccccgagccgcggccccggcggcgattgccgtgatggcctcggcggcggcgggaggaggacggcatcgcgtcgcgcgccgcggcggggattgggattgttagggtttggaggaggaatggaaggcgggaggggaggcggttttctgggcgagtgtggggtggagtgctgcgtttagtgttgagagataatatagcaactagcaaggcggtttctatatttccggtagtgtagaattagaaatggatattttaaatatagaatttcatgcactgttcctttctatatataattgaacttttgactttgggtattattgttcctttttcataaaggatcaaaatatccttccacaatttcacgtgcgcggatgacatgaaaaaaaggttggataataaataagggcatattgagaaaaaaatctacacaaatacagagggcaagtacgttttaaaagaaagaacgggattgctgtatggcattcgaatgaaatttggggaagaaatcttacggattttggaccattggatccatgccttctcgtgcatcgnnnnnnnnnnnnnnnnnnnnnnnnnnnnnnnnnnnnnnnnnnnnnnnnnnnnnnnnnnnnnnnn

SEQ ID NO: 20449 - DNA, 3089 bp, Oryza sativa
  unsure (1)..(3089): unsure at all n locations
ggtggcggcgtgcgatctgaatcgggggggaggaggagaggagttaggttaaaagggtttgcacgaatcttgaagcatatccaatggtctaaaattcgaatgatatggggttggattttctgtcacaagatgtatagacagccccaagaaagaaatgttcctctatttaattccctctattcactactgcattcatctatttccctccattcaccattgcagaacatcttaatggtgtcggttgtaaacttggcgtacgtgctggttccgcagtcggcaccaatttttccaggaccagcactaggtcacttgtgctggttgtagaatcaacactttcgtgctctctccaattcaagaagaaaagagagaagtcggctcgtagcatcagctcatcaagctaatgctttcgagcggcccctttcaagcagcccctaatctcatccatcacagctcaacaataacaatctccagacccattcatcatagatcaacacaagtaagatgaagaactaaacaagcaagatgaactcactcttccgggtcctagcaaagccactagcaccgtcatcgccaatttgtctctccattggaggagcgccatggaggacatcgactagcggaggtgtcgtcgttggcacgcaagctcaaggcgacggggcagcggcgcggggggaggagaggacgacaggtggtggcgtcggatatgaacacgagagagatagagcaagagagggtaaggatcggcggtgactacggagaggttaaaaggatgagttggatggtggctcggctcgactcagtttttttattaagaatcggcatctataatatattataggcgccggttgttttttaaaaaaactggcaatactgtacattataagtgtctgtttttatttaaaactggcacctataatcattcaaatatgccggttccatatttttccctcccgatgaacgtagggtaaataggttataggagccggttttaaataaactggcttctatgatcatgtacctatgaggattttttagtactggcttcaaatcataagttgggttaaagtcaaaatacttaaaatttgactaaattttaagataaatatatcaatattcacaaaaccaaattagttttttaaattaatagtcaaatatacttttatagtaccatgtattgaaaatgttacttataaattatagacttgatttagacctgaaatagtttgactttttctaaagtcaaaactattataatctgaaacaaagctaaagattatcgattgtttaaaaaggattgagtttacaaaacttctttgtttgaaacttatatcaaatgaaaaacaataggttaaggctccattcagagctgatgattgggctaaaattttaccatttttttcatgagctaaacggctaaacattgtgttttttactaaaattttatatccaatagtttctttagaaaaatatattaatattttttcgagtttacaacggctaatatttaattaatcacctgctaattatgtttctcattttacatggggctaatcgatcagtttagcatactagtactcgtagctccgaactcagcctaaagaccttaaacagtaaactcaatgcgccaaagatcatgtactcctatgcaatgcatggtggtatacaaatcagtgattgcttgcatatatacacatcgccactagttgatccattgattattaaatctaggtagctaccaacctgtccgaccattttcacgttactccatccgtctcataaaaaaccctaaccaagtaccggatgtcccatgcatatgcattcagatatctagctagatcaccccatatatgcatattcagtcttaaagtactactccattagagcttttgacttgaaactacttatggcggtacaccttaccaacaagccaccatgatcacagagaatagttagtagtcatggtagacagtggtcagtgaggatgttgtgaaagtcaggtataactataacaatccagaattttcttgatggccagctaattttattggcgtaaaaaagaagctgtcaagtttacatattttcttggcggctaaaactaacagccatgtaagccatattcttgttggctcagaccgacaaggttataactctggcgctctgaaaagctggatatgatcacaatttttttgtcagtctaaccgccaaaacttttactgaaagttagccagtaagaaatttagatttcccttgctctctaaacttggctttgattctgttcttgacggcttctggccaccaacaaaattcccagttctgatagtatatgcgctagaggagtctatgaggggatgatgatgaatgggtgatgagtggtcttccccggtagtggtcaccgtagaaaacatcctcttgctgctttcgcttgaagagcgataatcactgtccgaaccagaatggaaactgcacaacagcacaagtaatcagatagcatagctaggcttcacttgggtagactccttccgggcttccggctgccgctgccttgataattgacaagccaataattaactgtcatgacagaaagtttattactacatcattctgaattacaaactagttcataagatcgatcaaataatatgaatgcctctgttgctgacttgaatcagaatggggtttggaggtttaactatggaaggaatgtggacagtcaagagggctcagagctagctagtttaagagagatgcaagggtgatggaaattgaagattttaattatccgataaactgatctggcttcatgctaagggaggaattttctcaaccagatcactgtgcagactgataaagtttgatggggtggtcgataccaagctaagagaggtctggaaaggcaaaatgcttgccattgaaaatcaaacatttcctctacctggtaaatattttttcacgaacgcctacctggtaaattcaagggagagaatccaatgtgcagttcaattggttgaggaattggaggggtggaatggaggnnnnnnnnnnnnnnnnnnnnnnnnnnnnnnnnnnnnnnnnnnnnnnnnnnnnnnnnn

SEQ ID NO: 20450 - DNA, 1017 bp, Oryza sativa
gaattttgtcattgcattgaaaggaaacggacgaggttcattacatagagttaatagattgtaagggggaagagaaaatttctttccaaatttgaattacatagcgagcttcagacttgagattttcagcctacagagcagcttctcgcacacatcgctgtagacatgaggtgatggaaggaccttggcctctaaagacaacatcatgtctgtgattccacaatgcccagaaacaaaggagatagaaaacctgatagtgtagaatcggcattcgaaggcctggcttgggctgatgaaactggattcaacatcttgaatcaacggttgaacaccaatcttttcccagaaactctttgcaaaagggcaaaggaaactgtttcaatttcgtcattgcagatgtcgcaagtgtcattgggtacaattgtcttcttgtgtaagtttttctttgtggacaaacggtcttttactagtgcatgtggtttatatatagagctgtttctgtcttgcagcgatggaaactgctgcgcaacttgcttgatgaaatcctggccaggctgaggcagctaaagcctgaaggtcgatgtgcttgctgaaagatttatgatcccggaggccctagctgtttgttctggttgcagtgaaactggtgatcccagtgatgttatattagttacttcggtgttataggcgtagtttttctgtttgtctttccacatactttgggcctgttcattttgatgccattttcaactataccttttttgggtaaagttgtcaaaaaaaatatttacgtttagtttgttgctaaatttgatcaatacataagaaatcatgccaaaattttggtaattttgccatcttactaaaattttggcattgtcaaaacttggtaagatttattttggctacaatctgaacaggctctcggtttgtcatgttctcttaggcttttctcacaaagccgggcaataaaaagcacgctctctaaaaaaaataatatgaatgcagaatttacat

SEQ ID NO: 20451 - DNA, 1120 bp, Oryza sativa
  unsure (1)..(1120): unsure at all n locations
nnnnnnnnnnnnnnnnnnnnnnnnnnnnnnnnnnnnnnnnnnnnnnnnnnnnnnnnnnnnnncttttggacctggttggaacgggtgcccattgggcctaattcctctgattggaaaaaaggccttcctttactaaaggcaatctttggttctaaaaaacggaaggtttatggttttcagttccacgaaaaagtcaagatcaaactattttcttggtctcattgtacgaaaatctatgtaaaattctagagtccgtttggttggagagagtgattgggaatttagagggatgaggttattaattattttatttggtggggaacatgggagtttgggtgggacgggggatgggaattgagaaaggaactccatcctttttcaatacttgagtagggatggtaattgagagtgaattcatcctttattttgtctaaacaaatcttaaccatcaatatcaattttcatttaagatctaatctccaactaaactccatatcaattcccaccacctctaccaaacaagagattgggactaaaaatcaaatcctcatgttatggtgtgtttagttcacgtcaaaattggaagtttgattgaaattggaacgatgtgacgggaaagttggaagtttgtgtgtgtatgaaagttttgatgtgatggaaaagttggaaatttgaagaaaaagttgggaactaaaccaggccttaatcacaccattaattctctagtctaaacctccaatcctcttcacttgtatcaaacatgaagctacattttgaatgaggcctcgtttgaatggaaatttgaaaagaatttccggcccatataagtgggtgggccaggacttcagcccatccaaatgtggcgttgtagcctccgtgtactagcacggagtaattgccgcccaccgcccgcgtctgctcagctggtttaaatttgaatccggcgagcaaaccaataactcttccctcttcagtcttcgctcagactcctcgccatttgagccatcttccgttgagacgtgtaagctcgaatctttcatcttcccatctgatttcgccaagttgtttctacaaagatttgcttgcgatttcttttgtcttggcagattcgaatccgggg

SEQ ID NO: 20452 - DNA, 755 bp, Oryza sativa
tatagggcgaattcgagctcgtacctctttgctcacactttgtttaacccaaggaattaatacttttcacccttggggcaagttcatggaaattcatttcaaaaaaagctttcactttttttcggaatgcgctcagaggtacgttaatttttttttgctcttaaagtttgaaattctatgaattatcctcacttaatgtgaaaagcagatatttggagacgtaatgtgtatggattcacttgttagtaacccatctcattaactgtttgcagagtggatctaagagttcaggtgatggtggaccaactcagagggcatcagcattggctgctctttcatctgcattcaacccatcttcccaaaagaataaggtattgttaacactcccaatgcacagcagaaaaaatataaaatttgttgatcttacaaactataagcaatgttgtgttctttttagggtaatgataggcctaaaagctctgatggtggacccactcagcgcgcttcagcaatggctgccttaacatcagcgttcaatccatcagcaaaacccaaaacccaccacaacgtgcaggtcaaggttctcagcgagcagctgctgttgctgcgctgtctatgttttgactgctgagggttcatctcaaagcccacgcataggtaggtcttccccaatggcaggtatgacttgtggcctactatttccttcccctgcatatattttaagggtaacaatatcaatttccttcatgtggtgc

SEQ ID NO: 20453 - DNA, 1261 bp, Oryza sativa
cttttttttgggacggagggagtacaacccatatgagtggggtagtcgacccagaaactgcaggcaagtcaaatcagcaacgaacttggcgtcgcgggggaaccggcaactgggcaagtcaaatcggacccaggcgacgtacgaaagttgtggcaaaaacatctttaatttttacaatagtaaagataaagataaagaaaagatagagatatactagaaaaaatgccgtgcattgcaacgggtaaaaatatttttttattgatacattaactattaactattaggagctaagcaataaattgaaacgttaggatcggtatatattataatttaaaaagttaataaaaatccttcctttagttttaggcccaaattggtcattcattccttccttttaaacctaacctagtctgatacctcgtcagctcatgcctatgttcggcatgcggcttcaattgtggactgggcactcgcactcgcatagccactactattttcaacctctagcttgcatagccactaccattttcaatctccgaaagacaatctcgtgtccgtatgatgccggagccaatcctcccccattaaatccgatcgaatcttttttgatgtcctaaaattgatgggggcttttgatctactcgatcttctctgtccggttttcccaaaactgaagagaattcacataactcgggataataggctggagaagcttaccggttggtcatcttcaatgcagattaaattcgacaaattaaagctaaatcaaaagggaaaatcataggaaaaatgatgaggaaggagtgaggaatctttttttgcaatcaattagaggaggaaatacatgggagaagcagatcgacgtcgcgacaacgctagggtttggcacgggcggggcggaggcgcgctgcacacatgggatcgcgtgggaagagatatatggaaaaatattaggtatagatagatttagttatacataataactataactatttattacctaataacttactctatggcctatcacatttggaagattatggctagtcattacacaagttacttttctagtaaaagaaattatacattacttgggccggggccatgcaagcctcgatgatttcagcccgctcgttgtccgttatatgttaatctatccgatacttgtaatacttttatttcttctcggtaattaaccgaataagcaaactggaacagaatcggatcgggagacaagaaaaattgacgacgcacgaatatt

SEQ ID NO: 20454 - DNA, 1934 bp, Oryza sativa
  unsure (1)..(1934): unsure at all n locations
ccgaggtggaggattactccacgtgcgatgtcgatgcgtggatccgtgctgccatcgagcggagagcccaggtgatccatatttctcaccatccgaaggacgaggcatttagtaacttcgaccatgtccccatcatctcctgccacctcaaacacctgaagctgtctggctacttgtttcgacaaaggacactaatgcagctctcttctcagtgcccttcattggaagttctagagctcaaaggctgctatctggatggccatcagatatcatctgcctctctcaagatcttgaccattgtcgagtgcaggatcatggagggcttcaccatcgctgctccgaacctcgtatcgctgtgctgcgtcacgccataccaccgtgctcccttgtttgagaatgtggggtcactcacactggatgcagccactatcgtgcttgatgattcgtttctatatgctggttatgaatacgagtatgaagacatcgatgaggatgcgatcgaaggaaacggtagcgaagacggtgaaggttccttgaatgattctgactacgacagtgatgctgtcagtgatgcaagtacctgtgaatacagtgagattgcaaacaactatgatgatgaaaaacagcttgtagagcatgatgaggtacataatcgaagcaaaggcaactatcatggctatgatcacaggtataaagccagaccatataggggctatcgcaagaagaaattcaatggtggtaaagttctaggtggtgataatgttcttcacagcctatcgaatgctagaagtttggagctattagctgatgctggagaggtatagttacgaatcttctgctatgtggcaataccccttaatatggattcatcagttatttgcattgcagacacaaatacctttctcaacttcgtcaaacctccgtaggagtattgcacttgagtgtaatcaaattttacgaagtaaagttattgtataataaaaatgtgtaggctgctgacagtttttttttttgtcattttctttagaacgtatctactaactactaaagagttactaagttttaattttgcataatcacatatttaagcacaggtgttgttctgtgaaattcgtattagaaaggtggttttttttttcattgctgtgagctgaacttttgtgattgcaacagttggatacacatggaatttacatatgtgtatcttcacactattcctacacatttttataccagaaataaatttgcatttttactgaacggtgctggtccttggtagtatagcaccaagctattctttaccttttctaaacgctgaactaattcatctgtgtgtgccatatgaaggtgattctgaatagggagctgaaaacatgcccaacttttagtaacctgaagacattgtcccttggtgaatggtgtatgggtgctgacttcggtccattaatttccttcctgcagcattcaccaaatctggagaagcttttccttgaacttaaattggtacatatatttatatctgtcgaatttgcttgatgctttacacttttcatatttcgacaaatcaattatagcacatattcactaataattatcttcttctgcaatccaaaaaaaaggattatgacaacacacaggcaatgaaagaaggtaccaaaccaaagggatgctcatttgcttgcacacaccttaaaatggtaaagatcaaatgctctattgatgatgtgagagtccattggttggcacagttgttcaggactaacggcgtacccattgagaatatctttgtgcgtcagactagcagcacttgtgagtgatacttctcttgtaactctcatctctgatgaagttgcagtaccgtcatacattattactgtttttgttagatggaaannnnnnnnnnnnnnnnnnnnnnnnnnnnnnnnnnnnnnnnn

SEQ ID NO: 20455 - DNA, 612 bp, Oryza sativa
catgttctcactggataaccagatatctggtgaaagggaaaaggtttctttggaaaaagtcagaaaaatatcattatgttcaaaagggctggatattgaagaaaacaaaatacatatacaacataatgaaaagactatacctctccagcaccagctaagagttccaaacttctaacatttgaaaggctgtgaatcacattttggccaccaaatgtttcagcattgtcatattcgccatctttactggaattatgaccatcaccattgttaccatactgaagctcaccacactcatttgcaatctcactatattcataggtgttgtcatcactctcaatatcactaccatagccataaccatcctcgtttccaccaaacacaaatccttttttagcgtaattaatcctataccctgccttatcattcttctgataaccaaaatcatcatcatcagtggtttcatcaatgtcatcttcatcactaatgtgctgataatcatcacccaagaaaaggtcatcaagtatgatagagcatgtcaccagcgactccaagttcttgaacgatggaactcggatgtaaggtgtgactatgttcagaaaaacaaggtttgga

SEQ ID NO: 20456 - DNA, 662 bp, Oryza sativa
aaaacattgctaaaatttcgatgaatgcgcacaaaaaaacagccatatacaccaatggttaggacagcattgaaagatgtaacggtaccatgaggggattcggaataatcaatctactatagtatccatgtaaataaacaacatgctcctaatgacgaaaacatgtctaaatgtagtcaaatataatacaccaaaaatgaaggcgctaattaagcgtctaaatgtagtccaatagaatacaccaaaaatgaaggcgctaattaagcattagaccaggagcagaaatgcagatttgaacacggggtcttccggctagctccacaaggtggtgggctagacgacctgggttcgaagcctcaccccttctaattatttgatattaggtccttccctaatattcgtggttttttttcagatttgaacacataacacgcgtttgcataacgaatataaagcatgtaattaaaggcccgaaaatcaggggatccccccgcgacgcgaacacaatagcccaccaaataattcaaaccaaagcatcgcaatctgacgaaacgcaagcaatcacggaggacgaatcatgtaaatgccctaacaaaacaaaaaattaggggattgaggggatcgaagtctcacgcgcggccgaagaagaggaggaagcggtc

SEQ ID NO: 20457 - DNA, 632 bp, Oryza sativa
  unsure (1)..(632): unsure at all n locations
atttgattcgagctttctagaatgtaaagttcccttagatgagcgagagagagagagagagaagatcacgcatcctattggactgagccagcccaagtaacctattgggtaaggaaacagacgcagcttctgctaatttatatgcatggcccatcataagcaacatcactggttgctgtatgttaacaatttagactccaaaaagaatttgaaaatgtgcttcagagtttaaattgcgtctgtcatactaccttaaaaaccttttgccagatagcttcctgcccggtaaatgctaaaggcaaattaattccttgaagtgccatccagtcaatttctttctcccatcttttccaatcccaccagacaaatgagtctatagagatgctacatgaactttgtcagagataaacagttggaaaccaagtaaagaagagtaaaagtagccagattgggagatntnntttgaagactaaaaatgtgtggtttgatcttgaaaagaacaaaaggtagatctttgaaacaggtagaatacagaaattaaaaaaaaaacttttggcagaatcgcaggactgaaatgcttagaccaaataaaagaacttcaatttgacacgcacagcggcaataatagattt

SEQ ID NO: 20458 - DNA, 852 bp, Oryza sativa
cgaaacaagaaaggggaacgaacagaacacgagcaaacagcaaacaagctagcggagttcttctagcgtgcgcgcgacgcggagagggtgtccgccatgcgcagctgcgggcaacgccgccgtcgtccccgtgccggagcctctccgtcctcatgctgcactgctgcagcacaacccagcgctcggcgacaaccccagtggcttccttctcggacggccggcgagcttcttctgcgcgcggacggccggcgagctcctcccctgcgcgcggccagccggcgagctcctcccccgcgcgctgccggtcgacgagatcctcctcgcgtgaggacggccggcgagatcatccccacgtgcggacggccggcgagctcctcccccgtgcgcggcccccgacttggaggggctacctcgtcctccacgaccccttctcagacaatgccctggcgccctccggcctcctctgcgtgctcgagccgagccgctccccccgcgcgcgcggcgcggctagccgacgagctcgtcccccgtgcgccgtcgttgccgccctgctgatagaaggtgagaagaggaagatatgaaagagaaagaggggaagagatgagggagaagatgagatgaggtggagactgctgacatgtgggtcccgctggatgacttagcaagtcaactaccacataagcaagtcaattgccacgtaggacaaaaccgcttctaaaaccgccggggagttgatttgcaacggttttcagagttgggggatatacccggttttgcggttgagggatgctattcatgtacggccatgagttgagggaaggaaagtggacttattcctttttaatatgacgg

SEQ ID NO: 20459 - DNA, 291 bp, Oryza sativa
gctcaagtaatgttctcctcactaaatttaatatagtttcacacttgaacacgtagaggaccaagcaaaaaaaaggatatgctccttgttctaaatgctttatcatgtttaatgggcactagtttctgttcatattgaaactcagttgtgttctttgtttctcatttctttggtaccatttggtttgttccttcttcagccttacctacatgagtcccgccatctgcatgctttgaaaagggcaagggggtccggtggtcgatttctcaactctaaggctgtggaggggaa

SEQ ID NO: 20460 - DNA, 1149 bp, Oryza sativa
gatccggcggcgggctagggtttagggttttttggattttttttttgtttgccgaatttattttacggcggcgatggcgtccagcgccagctccacccagtccctcgcctcctccatctccatctccaccgctgagccacggccgccgcgacggcctccgcggcggcgagcggaggagggcattatgcggttggtggtgagattgagaggaggaaaagctacacgcacgggattggtgtccggctccgatggagtagtagaagtagcttcttgcagaagccaagctaaaaactggactagccaaactgtatagtcgactgtccagtttgatctagagcagtcaaaactgacgttagagcaaaggttaataaatgggcgcgcccacagtcaacactatagctaagccaatactagtgctccctcacggttttataattctcgaagttttggataatgacacagtttttaaaatatatctttgatcttattttttatatatataataaataaatgaatgtttacttttatcatagaattttaaagacaaattcatatacgttgttctagttattttaaactaaatacttttaaaattattgatagtcaagttataaaagtttgattacaaccttatccaaaacgtcaagaattataaaaccgggtgaagtaattatagaacttgagtagttttgtgagcggttttggtcctacatgacagtttagtcaacaattttcttttaagaaaatatgggacccacctttcagattctatctactgatctgtatctttttcccctctcacctctctctctatctctctatccctggctgaggagtcgcgacggctacgagcctactcttgcgcatgctagcggaggcccagtaggagcggcgatgactacggggctcctcgcgcaagtgccggcagagactgagaaggagaagtgtgagtcctcgcgcatgcgccggaggaggctgagaaggagtggcacaggctacggggcatcttgcgcacgcgctggcagaggccaaggaggagcggaggtggctacaagcatcctcacacacgacagtgtcggtgtgcgtggtggtggagatgacctggccacaagcagctctagtcatgaagctcggcgagacgtgctacgg

SEQ ID NO: 20461 - DNA, 3103 bp, Oryza sativa
  unsure (1)..(3103): unsure at all n locations
nnnnnnnnnnnnnnnnnnnnnnnnnnnnnnnnnnnnnnnnnnnnnnnnnnnnnnnnnnnnnnntagtcaacaattttcttttaagaaaatatgggacccacctttcagattctatctactgatctgtatctttttcccctctcacctctctctctatctctctatccctggctgaggagtcgcgacggctacgagcctactcttgcgcatgctagcggaggcccagtaggagcggcgatgactacggggctcctcgcgcaagtgccggcagagactgagaaggagaagtgtgagtcctcgcgcatgcgccggaggaggctgagaaggagtggcacaggctacggggcatcttgcgcacgcgctggcagaggccaaggaggagcggaggtggctacaagcatcctcacacacgacagtgtcggtgtgcgtggtggtggagatgacgtggccaaagcagctctagtcatgaagctcggcgagacgtgctacggcatcactactggggaggatgcgacggagagggtcgcattggtgcaagttcgctgctcccatgtcgacaagcagtcgtccgtccccgtgccgcccgccacccttttccttgctgcctgcttccttggagataggggaaccagaggtgtggcgggagacctggggcgcaaggtagtccaccagggaatcccactagggctgtaagtgggtcagccgcgaacccacttatagatcaaaataagcgggttcacggcttattttagcctataagtgggtttcgcgggttagccacttacacccctaaatcccaccacctattgcccttcccatccgctgcctgtagaccttctcgtgtcctccctcctgccttccgttgcgtcttctcttcgaatcaattcgttctttcccccgctgacctttctagtccttcacctgccaccgccgacggccagctcttgtcccggcagttgccttggtaattgcaatgtcaaatactccctccttccaaaaatatgagacctatttcttgttgcatcaatactaagaagcaattaactcacttgtcatatggcaaaaccaatgaacatgcaaccaataagtagtacttatggctacttggtttccgatccacaatttaatttagtatatagcgactacaaataggacttagatttttggaaaacccaaataatgaaatagatctcagactttaaagagaacatttattaattactttgaagagaatattccatgtactacatagtactagttcataaaattcatcaactaacatgagtgcagaacgaacttacatgaatctaaagggagaaaatattcccagaaaaaaatagttgaactccaacataaattccactcgcattgatcaaatcatgcagttcttcatttcagaaacgtcctcatgcacctgggaagcgcgttatcatacttgtcaagatcttcctcgtagcgggaaggaccggaataatcatcatcatcatcatcaaattcctcagacgtccattcatccgagtacatggaatattccggatcagaatacaccgaataataccgcacaaaaccgggggagatggggagcctcctgggagtgtacacatcgaagtcatagtcatcagttgagtcatcaggtggcctcagcatcttgatcctgctacattttgctcgcagggagtcggcgcccatgtcgatgttgaagcaatggcgaatgtcaagagactccaggttggggcagttatccaagatggttgagagaccttcatttgtgaggttattggcgaagagctgcagggagcgtagcccgtgcatctttgaaattccaccagcatcatcgttgtttttccagcggatacctcctgaatcatagaaggatcgtttgctaagcctgaagcgcttgagctgtgggcatgccgcgccgatagccgcatacgcctcatgagtaacattgtagcagaatgagagctcaagctcctcaagaagagggaattcctttgttgcctcctcaattccttcatttgagacacccaagcatgagatgagccgaaggctcttcaaacaggaggccctacaaagatagcacagggattttataactaccagcaatccaatcgcatcagaaaatatgctgataaaaactgtctgaataaataaactacccagctacaagttcacagttagataaataattggaagaggcgacaatgctcaatgtagaagagaacggattatgatgaaccaacttctcatatatcagttatttggacaatgactactgaagtactgatacggtaaatattcactttattgtcatttcatttctgtcctgtggaagatagcaggaataagaaatggccatacttgcaaaagaatgccagtgcaatattggcaacaaaagttcatcaataatatttttagatatgtgtatgaacacaaaacccagtccagtccagtccatgtcatgattaagaattattcaaacttcaaagcatagtctgatgaacagtttgtctgttagtttgagtgtatgaagtctgcacattcttctctggaataatttctgaactcctaatccttgtcagctaaaagtatcattcttttccttgtcagcaaagcataactgcataatctgacacagaaatttgttgtgactgctaatcctccgaatagattcaggtaccacttttcattctgtatgtcaataccctactagctaggtaggatttttcactatgtttatccaagatagagatatattcaatttctttcaacgaaccatccttatgatcttatcagttatcacccttttttttccaaggacatgatctgatcacattgttttcctgctaacaccttacaagtatatcctcctattccaaatattgattgttgcggtgtttgtcgttaactactcagaatgactggcggaagaacacattacatacgaattcatcatcgaaatttgatgcaactttgcaacgatataagctgacaaattatttgatctacaacttcaagcggtattaatttctacatagcatcaatgttcttctcttcagattaaattaaatatggcaaacttattgagagtgcctaagcaaat

SEQ ID NO: 20462 - DNA, 3518 bp, Oryza sativa
gcaacaatcaatatttggaacaaattctggaccaaatctacctgtaatgttgaatggaggcaacagagataaatcaaacagaagatccaaattcaacatgaagacaactaatcaagacagctaaaagagaaattctccaaataaaggcgacatggatcaaaacaatcaaatatacatattaaaatcagtgtgcttactgctcggtgaggtacacgaggaagccatcgtcgccggcgtactcgccgcagaaggcctcgcactggcccgcgctgcggcggacggcggcgcaggccaagccgccgcggttgatcctggcggagagcgcctcggtcccgcgcacggtgatgcgccgccacagcgcgggctcgtcccgcgcggcgcggcgccaggtggcacacacctggtcggcggccatgaggatgtcggcgtggccgagcttgtggaagatggccaggatcgcgtccagcggcaggccatcggcccagtccctcgcctcctcctccttcttcttgcggcggcggccgcggcggcggcggcggcgagaggaggaggaaggcatggcgtggcgctcgcggggtggggttgcgagggttagggtttggtggaggaaggcgcgcgcgaggtggaggggttcactgggttggagttgaacctgtgattttgtgaggatccataaactccgtcgagtttggtggaaactttgaaaagtccacaaagtcctacactacaccctttagcctccgccccagaataagtttatttatgggttattatatctaacatttgaccgtctgttttacttaaatttttttattattaatatttttattgtgaaatggtaaaacatgaataatattttgtgtgtgacttaagtttttaaaatagaatggacgatcaagcgtcggacatataaacccacaaataaacttattttgagacggagggtgcatatgggattttgtttgggtttgatgtttttatgggttcagatttattgattcatttttttcttggtaaaacactggttttttagcggttgttttagataatatgttttttttacaggattgtgtttataaatagtgggaaagtaggatggtgggggagtagtagagataaatctgaaaataaaatcacaaggatttctaaccttataatttactctgtggttcgtagagaagtagaagcttggtctttgtcaacagcgttgtgaaatagagtatggtcatcgaacggaaatagtatcattcaataattaataggaaaacagattattaactagaattttacggaactttgacgtttgcaaatatatatatgtatatattttgtaatattatttacgtctttggagatttaaatgtacaactatataaatgaaatatgttgatgcttttttaaggccgtgttctaaaatgggatcggcttggctacctccttaatttccattagtgcgcttttttaaatattgtttcgtttaaaaaattttcgttacagaagttgctttaaaaaattcaaataaacttatttttttatttttcacaaacactgctcgacagtagaccaatggccagtggccgtggactcgtggcagccagccccgtaggagagaggaggatggtgggcttgtatattatggtcgtggattcaacctttataatttctttctttcaagtaattcgacttcgatctctcttactatttccttttttacatgttgaggatcgtaaatggcaagcaaggataaaaaaacgcggcacacttagctttccacaacaacggtgatcatctataaatcagctctgtcatcatcagttcatcactctatgatgctttcatccgtactagccactcaaaatcgtacgtttgcgcgaccatatgagaagccatctttgttaaagatgaagattttttctcttgcaattaaaatgatctttgccctaaatattactatgaagttgcccatatataggtcacatatataaccaacattttttaatagatgacgtcgttaatatatagacacatggttgaccaatttttcttattaaaaaattacatatttgtaatttatttggtgtgagttgttttatcactaaaagtactttaaacatgatttatatcttatttatttgaaaaaaaattgaaaaagatgaatagtcaaacatatatctaaaagttaatatggcatcatataatacaaaaatggagatagtatttgcttcacttggtccatgtgttaaatttcataagtacccaacatatgaaattgtggaccattaagttcccaactgtgttgcttgcttacttttcatacttgccaagtgggtgacgagagacactagaaggctccagagggataatgcacgtacgtatttgatgattgatcagacggtcatcatttatccaatcatgtatccgatggtatttgtttttcagcttaagtggcctaatttgctcctgagaaagattagttttttcacgactttagttgatgtttctcaacttctgaagatgacagcaagctagaactcatctgaagatgttccatcaccaacatacatgtcattggctgtttatgtacatccggtaaccggaaattgtagaggctggatttatcccattttgtaaagaaaaaaattcactctacatatgtccatccttcggctttcaggtacctgcgatcacccttgtcgagcatcctgcaatcctgctcctcatcgaattcattcacatgaacgtcatggaggtagcgatgaggctccaggaaatactccgacttcaagaactcatccaggccgtcgtcgcggtcctgttcgaagcagatgctggaccacggagaaagatcgccagtgaactcgtcatcgccatagtcagtgtcggcttcttcgtccttgccattctgcgccctatcggcttcttcttcctcgccatgcgaccgtatctgaatacttagagccctattggtttccctaataaatcaaagccaatgctaaaatttgaatttttaaacttaactttcatatctatttttaagttattttcaatgtatttttttcagtatttgatttagaacgcacatataaaagtacttttattctataataaattgttttgacttattaagaaattagagtaaatttcacaaaactacatatacttatgtcaaattatcacaaaactatagatttaagaatgtctatcacaaaactacagatttagcgttaaacttttcacggaactacagatttaatgcaccatatcacaaaactacagatttagtgattaagttatcaaagaattacatattctagagcttagatcatagcactattatttatttaatttaaagttataaaaattatagttttgtgataaaatagttttttaatgtgtagttttgtaataaaatagttgttaaatcaatagttttgggatataatatcttaaatctgtagtgccatgataaatttaactctaaatctatagttttgtaaaatacattcttaaatatgtag

SEQ ID NO: 20463 - DNA, 1426 bp, Oryza sativa
  unsure (1)..(1426): unsure at all n locations
ctcggtacccaatctatatatatgtatgaaattattgatcatacgagttgggtttcaaccatgataatataaatgttttataatgaatgattttgggcatatatacatatgaaaatgacgtaactaagaaaatttttcatgggcatgtcaagttaatttgtgtttagttttcacttgtgtcaaggagccaaaatctgttccaagtatttttcatggtagtaaacttgtatatatattttcactcgtgtcaaagattcaagctagctgccaaattatgaatttatgttttttttacatttaatatgattgttagaaatatcattatatattttattctattcttttattaaccccatcttatcatgcacctaactgattattcatgccgatcatcactcatcaggatatataattaatctgttaaacgcacgaattaattaaatcaagctcctaattactaacaaccaaattatggatgaagaaacaagaactgaacaaataataaaaccccaaaaatttaaaatttgggaatacagatcgatcgaagcaacagataattaatccatgtaaactcactggtcggcgaggaactggagcacttcgtcgtcgccgccgaccttgctccagaactcctcgcaccgcccgtcgctgcggcgcaccgcctcgcgcgccatggcgcggacggtgtcgcgccggtggcgctgccagtaggggaggcaggcgaacccccgcatgtcgatgcggcgccacagcgccggctcgtcgcgtgcggcggcgcgccacgactggcacgccagcccggcgcccatcaggatgtcgacgtggtcgagccagcggaacacctggaggatcgcgtccaccggcagctccgcccagtccctcgccgccggcagggtcgtgtggtagaggaacacgccgagcgggaccgtccgggtcctcctcctctggcgccggcgccggcgccgccgccgccgcgacggggaagccatggcgatcgatctcgatcgctaggattctcggatcagtcgtatagccttctagtccataagtcatatgccttcagttggatgcggatactcatatgctgaacatatacggattcaggtgatttgaaataatacagattggaacatggttttgcattttgggataaaattaaataaaattccgatggatatttggtgatactttcgaacaaaattctcagacaaaattttaaataaatttatactgaatgcatgcatgcctgaattcaaacaagtattttttatatatatatcgcgttgaaaagtttaatacacctgtttttctttcttttgattacaatatatatatatatcccccaactcatgattgccagaaagnnnnnnnnnnnnnnnnnnnnnnnnnnnnnnnnnnnnnnnnnnnnnnnnnnnnnnnnnnnnnn

SEQ ID NO: 20464 - DNA, 4937 bp, Oryza sativa
  unsure (1)..(4937): unsure at all n locations
nnnnnnnnnnnnnnnnnnnnnnnnnnnnnnnnnnnnnnnnnnnnnnnnnnnnnttcattccagaccttttgtatttctattttctttgttcgcacgtatttctctcttgctcaatgcatcggggaggacaactagagatcgtcaacacattttataaggacttggtcgctcgatacacatgcacatttagttcctcccggtaagttcgtcgtcgactcgtcgtcggatcgtcgcccggagccataatgcaaacgctcgacaagccgacgatggcgtcggagctgagggcgatggcatggacggtgctgctcgtcccggcgtgcgcgtggtacgcgcgctcggcctgccgccgcctacggccaggactgccccgcctcgccgcgctcgccccgacgttccccgtcttcgtctacctgccgtgcctgttcaactccctccacttccgcctcttcagcaccttcttccacacctggctcgccatcaacaagctcgtcctcctcgcgctcggcatcggcccgctacacccgtccctccccctcgtcccgttcgtcctctgcgccagcctccccatcaagctccgcctcagccagcagccgcccgccgtcaagcgttctccttcgtcgccgccgccaccgcccctcgctgacttcctccgtccctgcgcccggagctttttcttcctcagctgcctcttcgtggcgtacccgcacacgggctggctacccgtgtacgccgtccacttcctatactgcgtccaggtcttcctcacgctcgacctcgtcctctcctccgtcgcgctcgcctcggcgaccgtcctggacgccggcctggagaggcagttcagcacgccgctcgccgtcgcgtcgctgaacgacttctgggggcggcagtggaacctgatggcggtggacctcctccgggcgtcggcgtacgagcccgtgcgcgcgcggtggggccgcgacgccggcgtgctggcggcgttcctcatgtcgggcctgctccacgagctcctctacctgtacctgacgctgcggcggcccaggggggagatggtgctcttcttcatgctccacggcgtgtcccagatcgccgagcgctgggccagggcggccgggctgtggcggccgcccaaggtggcggcgtacctcctcgtcagcgccttcatggtcgtcaccatatcggagctcttcttcgggccgttcatgagggccggggccgacgtgcggctgatggaggaggccgcggcgatgctgcagttgatcatgggcgtctcgaggcgtctgctccgaccgtttggggtggtttcgagcctctaatcatctacgggccggtgttatgtactctgtgtacgtgccactgtgccatctgggcctatatatgttcgagtgttaatttgtggcgctggatgcagaatgacgaaagtttcgttctcagttgagtaccaccaagatgttgtcatgtaacataataagaactcattccctttgcatgataattctgcccatatgtcagtttgtattgtagagcacactattgcttgcaacatcagtacatttttattctttgttccaaaacttgaacatttctcttcattcgagagggattctaatctccctggttaacgttcactcgtttacatgttaactaaattgttatatttttttaaaaaaaatgacaatataaatcaatgtgtaatagatttaaatttgatatatgcaaatttaaatcgacttctacaagttataccanaaatacaattttannctgtaaatatacgtataatagtagcgtcaaatttgttatttctgttacgacttatataaaagccaattttaaagtcatgtattacatattaatttatctttattttctaaaagaatcttataaccatctgggcgatatataataaacgagtcaacattcatcccgatgcttaagaaaatgtttcccctctccatcggttcaagtgttcaatagaggagttgtgtcatagcagcggccgcaggctcctccaactccatctcaggttctcaacacatagttagaacatgggaaactattctgaactctagagtaaacatcccctcgttatctgcatattgcctaaatggttatgaaaaaaattaaaaaaataatcaagaagatatataaatatgtgataaattactccacaaatatgtaaggtcaaattcaaattctactagttgcaacgaaaaaaacaaatttcattgtgcaatatgtgataaatcactccacaaacatgtaaggtcaaattcaacttctacaagttgcaacgaaaaaaacaaatttcattgtgaatatacgttaaccagtcatagtttaatttgtttattttgttgcaacttgtagaagttgaattttaactaatatgtttgtgaagtgatctatgtattaatctatctagttgaatgttttacatttttttcataacaattcaggtgacatgcaaataacgagatgatgtcctttgagagtttaaaatccacccccgtcagaacattttgtttggaaaagcctggtcgatacatggcatggcccacgttccctttgcaacccgtcacctaattagaacatcttgtttgaaaaggaaaaaagttcacttatctaccttgttttagttgcagaattaaactaactaacacgtttaaactctaaatttagaacttacactagagctaagaaaaattcctgatcttcgtgtgttgggcagattttgagccaacaccgttgtccccctgcttgagctggcagtggtgaacccgctatgcgatgtagagcagcggcagcgcccaacatccagctccgttgctaccgatgagtgtgccgcccactagtaaaaccggatttaattcatatccctatccgtaaaatcaagtataatgactcctccaaccggtaaaccaatgaaaaagactcccaaggcaatatctagggaagtattcgctaacatgataactacgtggcatctcaatcactaaataaaataaaacataaacataattccacatatcaagcatcgtcctttcttcttctctcctatgttttagttccctcttttttcccaaccacgtcagcagtgcggcacacgctcacgatcaaggttattagtaccgggatctaagatagtatcgttttgctgaaaatagtatcttatcgtaggatcatatcgtagtatcgggatactatgggattttcttttttaaaagtttaattaatatttgtattaattgcatatagtcattctatatcaaaaaaaatatgctaataatatgtcatgcaaatagagacaacatttatcaagagaaaccaaaccatattagttttgatatatttaactgatttttatataaacttgtgcatatatatttactttattttcaaaccatcatattttaaataatattctgtaggatcataaggttggtagaatcgggttactacctaagattttgtagaatcgtgtggtatgaatagtaagatcaagatactattaaaattaggatactaggtgggatcagtatcgtttcaatttggtagtatcatactacgatacagatcaagatactgataaacttgctcacgacttcacgagcccacctgctacaccgccgccttctcctcctcctccggcatggccgcatgggtaggggcggtggtggcgccggctgcgacgacgatgtccgctctcgcggcagccccaccccttctcttctaggccatgtcctctctttcggtgtgctagcttgctcgcctccggtggagccatgtcgccgcatccaagggcgtcccggccaaatcgggtccccgtgcgaaatattaaaatgggccctagtagcctagtaaatttttatagtaaaattaaaaacgggcgtggcgattagccgatcatcagcgatgaagtagaagcggaggccggagggaactggggagaggagacgaagcggctgcggcatcggaacttcggcgatacgcgacgacgcggacacctggacgggagtacgatggaagatggatcgattcaccttctgcagcgttttgggccatgtgtttgctactatttgaactgcaaattaacaaaaataaagcctctaatattattatatatagggcatacttaatattttaggggcccttaaaatttgggggccctgttcggtcgcacggcccgcactggcccccgggacgcccctgccgcatctcggatcgggcacagcctcagccagcgggtccaggtggggagctttgagcctttgagtgtcctcccctttgttcgcattttcgtcaccacgcctgaaccacaaaaaagaatcgagttaatccataaaatcccaaacgtactagagtaggcaggtacaaatatttggcgagacaggtttgaatgttaacccagattaatcaagtactgaattaccaatatttgtctttcagtttcagatcaattcccttttgtagtcgtctgattctgaaactcgtaatagagtttttttttaatgaactcataatggaagccttgatggtttcagttactcgtggcttgcacagaagatcatttctgcaacggatggatgaatgaacaaacaattctgcctggcaagacgagtacctcgggtggaatccgatgatccgatccatgcgtgaccggcaaaaccaccggcaaaaccagtccgtgttctacagtactccggcgtcaccgcactatgtcctcccgccatccagagcacggaatcagaaaaaatggaggaaaaactaaccgggagacacgaggacacggaatcggctggcgcgtaagccgcgacatcctgcggagccgagttgggagaatggagagaatggagggagaaacatggagagtagagcatcctatcagatgcactgtcccattattcatcgagaaaagcgcacgcggagataaaatc

SEQ ID NO: 20465 - DNA, 9294 bp, Oryza sativa
  unsure (1)..(9294): unsure at all n locations
tgcctgcaggtcgactctagaggatccccagatcaattcccttttgtagtcgtctgattctgaaactcgtaatagagtttttttttaatgaactcataatggaagccttgatggtttcagttactcgtggcttgcacagaagatcatttctgcaacggatggatgaatgaacaaacaattctgcctggcaagacgagtacctcgggtggaatccgatgatccgatccatgcgtgaccggcaaaaccaccggcaaaaccagtccgtgttctacagtactccggcgtcaccgcactatgtcctcccgccatccagagcacggaatcagaaaaaatggaggaaaaactaaccgggagacacgaggacacggaatcggctggcgcgtaagccgcgacatcctgcggagccgagttgggagaatggagagaagggagggagagacatggagagtagagcatcctagcagatgcactgtcccatcattcatcgagaaaagcgcacgcggagagaaaatcgcgctccagcaaatacgccatcattgcctccaaatttagcgcgtccgtcatccgggagagagaaacgttaaatttagagtttttctctcctcatgccatattacaaccacttgcgtccggaccgagctcccgcctctagccggatcagtggcgtgcagggtggagtagtgaaggtgaagactggaaaggtagaagcataccaaagaacgagatgtagatgatagagcgaggcctgagcccaccactagtgccgcccacaacttcatcgccccgctgttggtgccgaccacagcttcctcacccccgccgcttctccacccacgtcgccccggcattggctccgaccaccgcttccttgccccgttgcccagccgccggcaacgactgcttcctcgccccgctgacagttgcttcctcgcccccaccgtctgtcgtgctgcctcgaccgcacgtccgcaccttctctgccctatcacccgcgcggtgctgtcgcccgcgacttctcccctcgtgtctgctcccgcgctcacatccgctccgcccgtagcacctttggcccgtccctcctctgccgtcggccctttgccccttaccttcccctcatccttccccttttctctcatgacactctctcgttctctcctctcaataggtgcagataaagaaaagagagaagataaatatgtttgaacataaaaatgagattagagtattagttgtttcctagatttgatagatccgtaatacaataaatttggacttttcaggatgtttgtaaatatatacattataaagaaaacaatacaaatgtatggatagttgaaagatattactaaaacataggtggatatgatatagaggatgtaatatacatgatttgttagagtgaagaaaaatatagagtggaaatttttttggatgaccatccaaatagggatatagagaatcaaatttggatgagctgctagggatactcttagctggggatggtggtgttggtactcctccctttccgtagtaaggggaagggggagagaggtagtatggcggagaaaggaagaaggggagagaatgagatgatatgtggatttcattgaacataattaacattatgcatgattcaacatttcttttatcatagtcaacctgtcatgccagtcaataccaccatcaatattaccctagagtcattttgtaacagcttaagcagttgtgggagtcgttatacatgggtttttttttttttttacagttagggatataactcaaattcgacctgtactgagggagtcctaatggactttttccatttggtgaagcctacctctcgatctcggatttcccgggccggcctgcccagccgcgacgctccccacggtccaaacccagtagtccccacccaccgaccatccgatgggcgacgttccatggacctcacacgttctccataaattcaaaccggctggttgcgatcgcaggtcaggaatcgatcagaagttcagggcacccgtaacgtcgtgcacctacgcagtaggacaagagtgttgactcttgatgagcgcgcagtgatacagttcacacatacgagttcgctagacgtgctctgtgtagtgtgtgtagtgtgtagtcgcctcacaccgtcacacggtcacatgtctagtgtactggaagctgtcccctgttcagctggcccaccctaacatctagtggcatgcatgtgtgacatgatactgcaaaaatatgctcctcacgtgaagctagctaggtcctgtttctttttttcctaatgcacaaattgattgcacgtcaatatattaaaagaagtagagtttaattatacaccgcaatcagctaaagggacattatcgggataaggagtaaaggaaactgaaaaaaggagaaggaaaaaactgagctaaaactgggtgcgagggaggagagagacggagccccactacacttccaatagatccacaaaagacgcaatgccatcagaccatcggtggccttcatgtaaaatggactccagaaccaccaaaacctacgagagagagtaatcgaacaccctgaagttttgctccttccatagctaccgggagacgaggagaactaaggaatcgaagcccttctaacaatgcttatgcatgcaagccctagaagggtgtgtttggatgcctcttttcctaacccctctccctcgattttcgcgcccacgcttttcaaactgctaaacggtgtgttttttgcgaaaaaattctatacgaaagttgcttaaaaaatcaaattaatccattttttttaaaaaaatagctaatacttaattaatcacacgccaatggatcgttccattttccgtgcaggagggattagttcccatccgtgaaacctgaacacagcctaagtcggccaccaaacttgaagagaggaaccacgagccggagtaaggtcatgccagctaggtgcagacagaattcggtgccagacctgatgagcgaacacacagtcaaggaggatgtgattcgccattttgagttcttggacacaaaacggacaaggcgagtggttgtcaataccacgcttctccaggagatcgcctatccaacaacactgctggaacgcaagccagatgaaaaggttgtgtttagtagggcctttagcccacccaagcagatcggcacgcaaataaaggattgctacccaagaaagcaagcttggtaggccgagtgagccgagtaacgctggttgcttatccaacgccagacaggacggtcctccgtgcccggagagaactagacaagaagcatcgcatcccagaccatcaggtgttgggagaggacatacattgtgagagcgccgcggatgtcccttacccaagaattattgataagggtagaagcaactgaacgcaagggcacggtgaagtgaaggtcccgcactaaggaggccaccgagcgaccctcaatctacttatatgtccaaaagagagtcgacgcgccatcacctggcacgaagaaggtggacgccataaacatgtcggacgtgccgtcaactaggtcatgtttgtaacagattatttacttgatatgcactacaaattaaaatcttaaaaaaggtagattttacaaaactatatatttaaaatgtagtatcacaaaactacatatttactacagatttaaaatggcgtgtaaaataataatattaaggagcaaattttataaaaaaaaaatacaggtttagtgccaatttatcacaacactataatgtttgtagctccaacaaaatggtagtgataaggatttaaactatagaatctaatgttttgtgatgacttcaatattaaatatctagttttgtgatacttgatattaaatatgtattttatgataaatttactgttaaatatgtattttttatacaacaccttaaacctataattttacgtacaatagtttggttagattatgtgtagttttgtgagaaattttatttaaaaatgaaattgttatataccatataataagtggtataaaaatgcagtaaaaatatttttttaggaatgttgtattttgtagatcttaaatgttcaagtatgttaaattatactccatgctttagtgagctatatatataatctttctagttttcattggacgatgccattgactttgactatactccgtatatcttatcaagaaaattatgtaattaccatttgttttgatgttatttgttttattattaaacgtgtataattttagcatgagttatatttttcatatgtatgttcaaaagacaatgacgtgatacattaaaaacctagaggtagtattttaccctgttttcgttaaaaaaaaagccatgtaagtattactttttaattgtgacttgttgtatcatttaagatattttttaaaataatagatagaaattcggactatctatcacagccaaacgttaaaagaaaaaaagactaaacttcaaactcttgctaaccttacgcgcgcagcaacatccatcgtcatttaagatactttacatgtctaacgtaaaaggactcaatgacaaatccataagccttacgaaattcctaatgaaagcgtgctcacgagtgtaattttgacttgtgaccgtgagaattcaaatttagtaaatatatttatgcatataggaataggagtacactatcaccaccggtccaccacgagcaacactatagcaatacttgcggtgcatgctagtgagtagtgacgaagaatttactgtgtgacgtcaacaagcttacatgtggcaatacatgcaaaaaaaaacatgacatcctttgcctgcaaaattcatccgcatattccgaggaaggcccgtggctctcactttgagacatgtaattctctgtacgctcaaaatttattgcaacgattcgtcaggttcttcccttaaaattaagcgcattaatcattcgtttgttttgcttgcatggagttttggattaacactcttcttccatggtcttttctagataaggctctctaatgtagtgatatactacttcttaataactattgcttatttttagatatataatcattgatcttaattattgagtgtcagtagtacatattcctttcttgattctgtcccgtcgccccacaagtttatatctttcctccatctcttggttcaaaggccggtctttccctgcacgttcaggcagtgtgggatccatagtaacttgtacccatccatcccgtgaggccgtgatccaggctcttgtttctcctttctttcagttgcatgtacacaaagttgcacaaatgtgttgctttctgctggtctctgtactgctagccaccactctcaccgacgtagccagtgcacagagatggaggcagaccagcggcggcggcaaggacaggtgggacggcctcctcgacccactcgacgccgacctccggcgcgacatcatccgctacggcgagctggcgcaggcgacgtcggacgcgctcatcggcgacccggcgtcgccgttcgccggcgcgtcgcggtacgcgcccgacgcgttcctccgcaaggtgcgggcgttcgacccggacgcgtaccgcgtcacgaggttcgtctacgcgacgtcgagcgtccgcctccccgacgcgttcatgccgaggcccgcgccgtctgcgggcgcggcgtgaagcggggagtccaactggatggggtacgtggccgtggccgccgacggcgtcgccgcgaaggccgggaggcgggacatcgtggtggcgtggcgcgggacaaagcgcgcggtggagtgggccaacgacctggacatcacgctggtgccggcggacggcgtcgtcggtccgggcccgggctggacgcacccgtcggtgcacagggggttcctgtccgtctacacgtccaagagtttctcgtcgccgttcaacaaacttagcgcgcgagagcaggtataattagttgcgactccctcgcatttacgcccttaattaatctagacttggccaatacagtatatcattttcttaaaaaataattaataaaacagtatagtactatactgtttcattatttttttatagaaaaaatgtgatactgttttggccgtgctactttacgctcgccactgtggcccaatcattcacatatttgcacaaggattatagttcacggtttggactttcgtttcctccaacataaggtgtctccagtacagacagagctattaaaagaaggcatagaaaattgaagagtgcaagagacagtttcacactcattctggggaactgacgaataatttcgttcacacattagtctggaggaactaaccaataatttgacatctcatctgaactgcacatgttgttcttgatagggaatgctgtttttctctagagtaggaccgccctcggatattgtttggagcatctaataacctccatagaaaacaaagtagcaaaatttcggtaactttaacctgtacaatatggaatgaactataatggtcattgccatgggattctccataaggttttcaaatcaaagtgtactactacctccgtcccaaaataagtgcagccataagtttccgcgctcaactttaatcgtccgtcttatttaaaatttttttataattagcatttttgttgctatgagatgataaaacatgaatagtactttactcgtgacttatgtttttaattttttttaaaaaaatttcaaataagacgaacggtcaaagttggacgcggaaaaccatggctgaacttattttgggacggaggaagtaataataaaaaatccagatagaacatgtgtccaagacataattgtgcgttgaatcttttaaaaagagaagttgagggacatggtaacttccagattttttacgtcttgtcttgctccagagaatctgttgcgtttgaacatacgaagacagtggacttgtacatattttccagattttctgtacataaattgctttttttttcaaaatgcatttgtagcaattcgatgaggctcatgtagtcatgcatacaaatgcaatttcagaatatcctttgcatttattatttaagatctttcagttagagaaaataaactggttgagggggtaaaaggctcatttgttcatggaaatatcttgtacatctatcaacaatttttctctcaaaaattatcaaatgtaaatacattataattataatataattacatttagtttatatgaaagtataatataacttgtatgtaactttcaaaaagatccaggggaggtctcagaggagcaaatctaatgatacaaaattatgtgaaacttacatataaattatactgtagttaaaatgtaatcacagtatatttatatttaataatttttggaggaaaaatgtcgatagttcgatatatgtgtagcaaaatcgctcagtcggaggtgggatgtgatcatgtggagtccaacatcccttacttacgacagcccaaaacatagctatatatgtacacttccaagtccaaatcaagcagaaaagcccttttttttttctttttttgcggggacgaaaagcccaaattaaccttctagcaatttcattttttttaggaagaggtactcttcgatcgaaagagacggaatatatttagagctagtacgattgcttcaaattctgattggaacaacaaattcgatgctattttctgaaaaaaaattgcaacaaaatttatgcaggtgctagctgaaataactagacttctgcgcgcgtacaagaacgagaactgcagcatcaccataacgggccacagcctgggcgccgcgctctccacgctcaacgccatcgacatcgtcgccaacggctacaacgtccgcggctcgtcccgcgtcccggtccccgtcacggcaatcgccctcgccagcccgcgcgtcggcgacgatcagttcaagagggccttcgactcgacgtccaacctgagcctgctccgcgtccgcaacgcgccggacatcgtgccgaccatcctgccgtcggccttcttaaagaacgtcggcgcggagctgctcgtggacaggcgccggtcgccgtacctgaagaaccccgcgggcccggcccagtggcacaacctcgagtgctacctgcacgccgtcgcgggcacgcagggcgccggcaacggcgcggggttcagccttgtggtggaccgtgacctggcgctggtgaacaagaaagtggacgcgctcaaggacgagtaccaggtgccggcggcgtggtgggtggagaagaacaagggcatggtgcagaacgcgagcgggcgctgggtcttgcaagatcacgaggagggcaaccttgcaatgtgatggatttggggaattttgtggaatccaataaactgatgggtttattgcttggatggaagttttccaagaaaaacatgaatagtaagggccgtggaaatgcagatataaattatgtatgtacgtctgaaaattctgagttgtaactgaaaattcttacggcccctttgaaacgtatgattatcaaaacacgggaatagaaaaaacgtaaaaatagtatgacacatttattggattcctacgggattgaacacgcataaaagcttcaacactattgtttgatagttacatggaaaaaacataggaaattaagacacgggaagaagaaaacatgaggtatgaccccatgctatttttctctagaattcctctacaatagtccattccttagaaattttagagaaattggtagaaatcaatactttattttaaaggattattcccatagggtataaatcctttagaattcatgtttttcctttgttttaaaagggacccaactccccggaagagggggatgggagtttggtagtggtggtggtggtggtggtgtgtgtgtgaatatgtgagaagaggggaatatgttttaatcctggcgtgcgctttgctaacaagtactccattttatattataagtcgtttgacttttttcttagtcaaaattctttaagctcgactaagtttatagagaaatatattaatatttttaatacaaaataaaaatattttcataatatattcaatctaaatttaatgaaactaatttagtgttataaatgttgctaattttttctataaacttaatcaaacctaaagaattttaactaagaaaaagttatttgacttataatataaaacggatggagtaacagttttgnnnnnnnnnnnnnnnnnnnnnnnnnnnnnnnnnnnnnnnnnnnnnnnnnnnnnnn

SEQ ID NO: 20466 - DNA, 1541 bp, Oryza sativa
ataaacttaatcaaacctaaagatttttaactaagaaaaagttatttgacttataatataaacggatggagtaacagttttgccaaattggcatgccacgtgtgcattgtgccgcctaaaccgctcgaaataatgctcggggattatttgcccaatttaaatagctgggagtgcaaaacgatactcaagttcaaaggtaattcagtcaacctcaatgctttaggggtaatgtagactattctgtatttcttagctattctcactttcatatatatactcctgtgtaggcactgaatcttatgttgttacttttcccctctaataatacatatcttcatgctggacatctataaaattgagggtcaaaaagatatatacaaagtttttcatatttattccctacagaattgagtgcgttttggtgccactaagaggtccgcgaccatttatcagtcaaaagggttgggctaaaagtggcgttctgcttcattcatcattgggcccaaaatggactatgaagtatttacccaccgacttacaacccatcaatgcacacgtgtttccatagaggaaaaagtgcaccgaaggtccctcaacttgtcatcgagttacaaaatcgtccttgaaccacaaaaccagatataatacatccctcaacttataaaaccagtataatcctgaacggttttgactccggttttgtctgatgtgacagctgactcagagtgggacccacgtgggtcccacatgtcagccacttcttcccctcccctctccacggcggctgcagagagcagatgggcgttgcgggcgcgggcagcggccggcgagggaggagctgccaccggcggcggcggcggcggctctccgccggccgacctccagctgttgcatctgctcatcaccagtccgcggcgagacgacgacgccgcccgacgcactatggtcccggagcaaacacccgcacgcggagcccgacgccgctgacatgccgccgcccacgaccgcaaaccgcccgcagcagcgcggccctccgcccctcgtctgcctctttcgctggcgccggcggcgctctgcgtcttgcagagcctctcggcgatggtgtgccccatgtgcattgacaggtgacgagcagcctcgtcgcggcgacgtcgagcgcttccgttcgggagctccacgatggagtggccccggtggttctccctgacgaccgagaccacggcggcgagcgaattggtgtgcgcggtgagcgcgacaggacacggatgatgctgaggttgagcttgtcaggaatgaagcacttgagcatgtggatgaagtcgtagatggattacttggacgtgaggacgtggccttctttgttcaccacggtggtatccggatcaatgctagactcgacgacgttggcgaggacggcggcggccatggccttgtaagggagcgcctcgtcgtctacctttcggatgtagagctcctccaccatgaccgggacgacctcgacgagcgtcttgctgttggggcggtgtgagaaaagttcgatg

SEQ ID NO: 20467 - DNA, 6296 bp, Oryza sativa
tcgtctttattctcatcctcgcgtcgtcgcccgctccgcccaccgctcacctactctgccggccggccggccgctccccgcgccgtcgccgctcctccagctggccactccgcgcccgcatcgtgccctctccggcgatctgcttggaggggaggggagagaggctgagaggggatagagaaaagtggggaagaaaactaggtttcgttgacatggggcccacatgggtcccataccgactcagcagccacataggataaaactgagatcaaaaccgccgaaggacctattgtgactggttttgtgtagttgagggaccccgcatatctggttttgtggttggaggacgattttgtatcccgataataagttgagggaccttcggtgtactttttccttccatagatgcactctgctagccaaatgtttgagccttttcttgttttttcttaatccggtgcaactgtataatacacgcaaacaatcaatggcagtcgagtgccgaattggatagattcgtaagagctttaagaataaagtggctatgataacagtacgaaaagctctgaaaaagatttggatggatctccacaaccctatcaatttgagatagatccataatccgtttctgggactccacctagatccatggtaggcagttaaaggacctagcaccgctattgtacgtaatctcccggagaaaaaaataggaccctaaagtagaacatcgagatcgaagagcacgtagatccaagaccttaacctcccaaacggtggtgacatgaccatagagctcatcgactagcttgttactatttggagcacagtgcaagaaatacaactcactgatgaccaagcagatgaaattacatgaaagctcaaaaaaccataaagagtacatgttgggatttgcctacagagcgtaggttccttggttcaactaactacgaaataatcttttggaaaaccttagacccaaagaaatacaaactctttgcatagcattttgtgataaatatagtgtggacaacacatagagtggcaactcgaggttggccaaactactgtttttatcctccatgctagcacaccatcactagtacagatccttctatctgtgacgggctctaatatgcttagaaatagcgggccgtcataaggaagtcatctcaattgggccgaaaagtgcccgattgagatatggtcgcacagacatattagatgggcataaaacttaagctcgtcacggatgacacctatcagtgacgggccgtagtgtaagcccgattgagataacattccatatctcaaacgggcctaaagttgtggcccgtcacaaatgaccatcatctgtgatgggcaccaactttaggtccgattgagataacattccatatctcaaacgagcctcaagttctggcccgtcacagatgaccatcatccgtgacgtgcaccaacttgaggcccgtttaagataacaactaggcccgtcaaagatgactcatcagtgatgggctatatacttaatctctatcgggcattaactaaagctcgtcaccgatgactatttttccatttttcatatgaaatgtttatatttgtaagttgactatagcaaaataattgtcacgccccaaactagccccgaacgggactagcccgtgacgctccaaattaacctgttaatcgataccagtcccaggaaacagtgctggtatcataggaagacagaatatcacagccacaaaggtctctttattacagagtaggagtacagccatgttgggctgcggacaggtcccgagctcacaactgcattacaaaagagaaaacggaagccaagacttgggccaaacatcacaggcgcgacttgggaactaggccgaaaccctaaaactcatcgtagccgacttgctcctggaagaactcctcgtcagcgggatcctcatcatcttcttcagcgactggggggggaattatttatatagaacaagggtgagtacgggagtactcagcaagccatgggaattaagtgtttaatgcaggcttcaaaggaaaggctgttgtttttgcaattgattttatttaaactcctttttgaacaactaagtgtgtgcttctcaaacgacacggatgggacagtgcgtctcgtccggtcggagtatgtgcaatgtatcaatctttgaattgattcaaggttggcacctggccaacaaccttaaaacggccacccgggcctggctgatcccatcagccgcagatttaccaaacatcgaacccattccacaacagcaaattcacaaagcagtagttaaacaaaactacgctaggaatcacctcacatccgcccatgaccgtgggtacggctgtttgaacagtttaataacctctgcagagggggtacactttacccacacgacgttactagccttggtcacccagcccgtgcaaaacagccatgtttggtgactttggggctttcacgacaaggcatttcgaaagccgacacagggttaccatatgccaacgagacgggtcccagaccaacaacaggttaggtcccagaccatactgtgccaggaagcccgggggttctccccgacaccaccccgttgaatccacatgtctctttgcatcaaggctccccttattagcaatttactcagccaggggtgtcccatttcacccatgtggtcgcacatgtcttatgttcggatgaaattccaaggaaacggtccttaagtgcaagagcgggaaaccgtactcccggtacgtccctcggcctgcgattttggaaattcatttagttcgcaagcaccgacccaggtgtcgggttttccaagtcttttgtaaaacccaaattttacccatcgttggatgttttatatttgaggggaggtgttccgatgcgcgtgcccgaaggcccgtacatcgaagcaccacagtcgacgagggaaggttaagtgttcaataattcaaggagggtaattgcagcaattaggattgggggccgacgggctatctcgcaagctgcggccgaattactcgtgttaatcctattcatgcaatatttgtggaaaagaaataattagatttaaattataggtgcaagatgatcaaaggtgacttgccttgctcgagatcttgagcttgatcctcgtaatcctcgcactgcgggtcttcgggctctgaaactacaggcgaaacgggacaactcaacaaacggcgaaaataagctttattattgacctctaggcgtgccattagatagatcttgagatttgaggaattttggaagttggacagagtcaaacggacttacggttgggaagatattgaatttctaagattattggatttttggtctaaaggaaaaggatctatttaaatcgttttgaaaaagaaaagaaagagggaggggaattagacttcgcgggcggcttgagcgcggcccgagaggtgttggcgcggcccggccttgccattgggccggccggcctgagggacggcccaagggggctcgcggggaggggaggagagagggagccggtgggccgggtccaccttgcgtggtcccgggtgggacccgcttgtcggtggctcggctcaccgtgagcgaggtgccttggtttaataggaggcgatgtcggtttgggaactgacctagggtggtcaagggagcgagctagcactcggcggtcgcggccaaatcggcgacagggggggtgacgccggcgatgggaggaaaaagaagaaaggaagagggaaagggggcttgcctccttgcttctttgggaaaagaaggagggagagagagcgacccggcagagggaggaggggctctgcctccgtcccttggaagctagcgcgcggtggtggcgaggccaggttgatgacgacggcgatgacggcggaccggtttggagcggaacggcgacacgggcggcagacgcagggcaggcgcggcaggtgctgacgacggcggcgactggccggtcggccaccacggtgtgcgcgcgcgggaagcaacgggcggcgcggcgatttgggcggcgtcggcgggaagcggtagcgagggcggagggcactcggctcgcgcggctcacgcgcacgcgcgcgcggcgcatgggcagagcgagggatagaaagaaggagagagagagagggggagggagagagagagatgggccgagagggattcggcccatcgaacctaagggaggcaaaatagacttttgcggaggaattgaatttggaaggaaaattgagattagggtttggatttgacgatggatcggggattcgagatccggaatggcacggagactgactgcaagcgaaaaaacaattttcgcaattagggtttttagaatttaaattttcccgctaggcgccacgacggaacgggcgctacaataattaagtgtagtataataattcattttatgagtcaaaataattttatgggtagtaaatgatttcaaatggaaaaaatatcaacaacaaagttgtataacttatcaagatgtacaaattttagtttggtcatttttcaatataatatttttttgaacagtttgaatttgaatttaaaaatatgacaactttaaacaacattttcaaatactaaatgatttcaattgaaaaagtcattaccaacaaggttgaataactcatcaagatctaaaactttttttttgttatttcttcatccgacgaaatgttagtaatattattcacaaattttacatatatgtgttatagtttatagaacatgataagagatatgtcaattttatgaacaatgttactatcattttgtcgtatgaagaaatgaccaaaataaatgttttagatcttgatgagttattcaactttgttgttgatgactttttcagttgatgagttattccgtcacggtacgatccttttgcttaagtgcccggaactcacgcttcttcaaagcaacaacacctgcaggtatgtgtgtcttcttgaatgcttccgtgaactccgcctaagtgattggttgtccttctgctctgttcatccggaaatgatcccaccattctgatgcaggtccttgcaactgatgtgaagcgaaaacaactttctcctgatccgtgcactggagcaattccaacttcttctcaacagcgtgcaaccaatcacctgcttccactgggttggtagtgctagaaaaggtaggtggcctcacacgaagaaaatcagttaacttgttctgcggcgatggagcattgttgttcccttggttgagctggttctgcatctgctgtatcatcatgttcattaactgagtctgttgagccagaacttgagcaagagttgggttcccttcattgttattgtttccacttccattagcacgagtgttcaccatctgttgcagattagagaagataggaggagaggggttacactaaagacaagaccttaaccaggttaacactgatctgatgtgtgtagaccaatatattgttcaagttgattaagcaagcaacctagtatagttacacactcatcactgaactactccaatgatggaaatgcaaccatacctacacacaagcaaacaacaaacgttctatcctactaactattcttcaaagtcactttggtggtttaggttctaaggtaggatccaaacttcattccatcttgaccacttggcacttcagatcgaccatcaccttcttatttatcgatccacttgacttaacctccataagttgaccacatcagcattttctagtttcaacaactagtttcagaactactcaagttgaaagagagaggggagtagacaatgaaacaatttgcaaagaattctagataaggaagaaaggagaaattttcacaaatcatgttttcggaaaattagtccttaaggtttgaccatttggcttatcctacagtcaagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgcagcggaaaataaaatctagcgaagctccagctccactcccacaggcagctcaactggggtataagccaaacgtcttttccttcgcaacttgtcttcaactgaggttgattgattattgcaaggtgagcatatgacatactcagcaagccacacagcaaatatgc

SEQ ID NO: 20468 - DNA, 806 bp, Oryza sativa
gacaagcacacccatgttgcacaggcccaaccattttgaccaaccataccgggtagaacagatctaactccaacccaggagctaagcaaattattaccagttataacatctataattatggtgagaggtgtgagactaatcacgaaaaacattgctcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacagtaccccttgcataacacaatccaccgcagcgcaccattcctggatcataatcacccccttataaaacaaggcatggactccccagcgacccccatgggcttatctccgccacttctcagtctggtgccccgcaatgaaccatgctatacaaaagataaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgagctaccattaaatataaccataagtgatagtgaaacattagttatcccaaatgtgtgctaatgtttctaagcatggctaagcaatcatatctaatatctagttgaaccaatatatataaagctcaactagtcccattataatcaccccaggtatcaaggaataaagtaatcaa

SEQ ID NO: 20469 - DNA, 626 bp, Oryza sativa
agccgaccccagtcagcccctccccgtgcgtgcgttccaccgcgaaccgtgaggctgcgcgtgggcccgccgcatccacgtccaccgcgaaccgcgcgcgtgcaccgcgtccctcccccgcccgcgcgcgtgcgccgcgtgctcgctccgcacggtgaaccgtgtcaccgacaagcgggtcccaccaaggaccacgcaaggtgagcccggtccaccggctctctctctccttgcctcccgcgcgcgtgtgccttggaccgccttgggccggctggcccatttagctcgaccgagccgccccttttctctcgggccgcgccctagccgcccgaggaaagtctattttccctccctcttttcttttctttttttttcttttccaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcgccgtttgttgagttttcccgtttcgcgtgtagtttcggagcccgaagacccgcagtgcgaggatttcgaggat

SEQ ID NO: 20470 - DNA, 5668 bp, Oryza sativa
taaatagagaatttaaatataggatcaacatgctcaaaggattgtgtttaggatctgtgtgacttgccttgcaataatcggtcttcaattaatcttcttgaatacttccggcgcactcgcgaaccttcgcaacgacggaaacgacaagctatcacgcaaaacgaggaaaaagactaataaaaaccaaataaacaatacataaaaagtaaacaaacatgtagatcataattttagatgaattatgagacttgaacggcctcattctgacttcaaatgaatttattaagaattttacaagattaaatctatttaaagcccatttaaaaagaattaaataaatttaattcaatttatggacaattttaatatgtagatctttattttacacaacttttgcaacttgaaccacattaaactgagttaagatgaattagatatgaatttttaaagattaaatcggattaaaacctttaaactgattttaattgaattatgacgcaataatgaattatttttgaaaaggaaaagaaggattattgcgtcagcggctagggtttcggtggaccgggcgcacgggcgacggttcacgcgaacggacggccgagatcgaaccaatccaaaacggacggccgagatcgatcgggtccacggcggctcacggcggacgactccgatgacgtcagcgatgacgtcaccaccggcggcggtggctcggcggctcgggctcgcatgctcgccggcgaacgacggcgcggcgacgcgaacggagagcaccaggacgtagagcgcgacgcggcgaactcaccggtgaccaaagaagcggcggagaagcaacggacggcgacggcgacgaggaggaagcggcggaaaccttcgggttgacgacggcgatgaagctccggcggtctccggcgacggcgaaagggcggacgaggacggcgacgaccttgcgaacccgacggcggtcttcccgagcgacggcgacggctgaaacgacggcggcgcacggctggagcggcggcggcgacggcgaagctagggcacacggcgctagagctcttccgacgacgagaggcgaaggcgagggtggcgacgggtagaggagagctcgggggtccttaaataggtgcaaggaggcggcggcgaaggcccacggcggcggagacggcgaaggaaagctcggcttggagagaggaaaaccgatccgattcgaactcgaatccatcgatttccaaaccgatttaggcgaagcttccaaagaagaaaaggtagaggagatcccgaggatcattttccctcaaacgattcggccggataaggaaagacgcggccgaatttggaaggagacggcggcggcttgcgctagggtttcgggcggcggcggcgacgcgaggaagacggatccgacaagcggggcccacctgacagcggctgagagagagaggagagcggcggctcggcggactgggccagctgggccgagggaaagagagaagagaggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaaatcatttctaataattccttttaaacaacaatttataagttaaggatttttaaacaagaaaagctcttaataattatacttagatcattaatgatcaaataattactgaactgttctttgtattattaagagttgagctctgaaaaatccgagaaaatttcagagagttgacttaaccatggagaatttaataaaaattaaatccatccatgctttatatttaggaaattttatttcccacattttacttcacttgtaaattaaagaacatttaacaaaaattctattattaatttattaaataatttataaatcctgaaacaaaaaatcaggatgtgacagtgaccgaccgggaagtttgtatttcccgcgtgggtgcacacgagtgagggctagccaaaaaataaaatttatttatttatggattatactcatctgtgatgggggggacgggcattaacttaggctatagttaatgccccacccgagtgggggctagccaaaaaataaaatttatttatttttagattatactcatctgtgacgggcattaacttaggctatagttaatgcccgtcacagatgacaggcataaaagtttgaatttcccgcgtgggagcaatttcgggatgggtgaccgaccgggaagtttgaatttcccgcgtgggtgcacacgagtgagggctagccaaaaaataaaatttatttatttttggattatactcatctgtgacgggcattaacttaggctatagttaatgcctgtcacagatgactcatctgtgacgggctatagtttgactggtcgtctgggtcaaaactatcggtgacgggctttacttagagcccgattgagatagattcatccgtgaccgccgtttgcccgattgagataactcttcacattagtgacttctagcctgtgacggacgccatgcccgattgagatggggcttaccgcccaattgagatgagggtatccgttctagtgcataaaaacaacttaccaccatcttgtggaatgcatatacataaggagaatatggagcacactatcaacctagatagctcaggaacttaggttgcgctcttttttgatggttctttctggctaaattagttgtacgtaaaacaagaaacatgattaattgagtgttaattatttaaagagtaaagtgcataggcggtccttaaacttgtagggttgtgttatctatgtcacccaaactctcaaaatatagatataggtcccaaaactggttaaagtgtatcatttaagtcccaaatcgacacaacccctctagaatcctttgtggcgctgatgtggcatgccacatggacgtgacttgtccttttcctttttttcttcttttctttttttgttttcttctcatttttttcctttcatctgctcgggtcacatagaaaggagaagaaaggaaaaaagagaagaaggagaagaaaaggagaaaaaggaaaatttttaaatggatccatttgtcaatcaaaatgatgttacgttatatacgtgtggcatgccacatcaatgccacgtaggatccttaaagggttgtggcgatttgggacctagatgacacgctatgataagttatgggacttgaatatgtatttttaaagtttagggacttagatgatacactcctatgagtttaaggaccgtctatatactttactcttatttaaaaaagaagaatggatctgtttgatttttaaagaaccttttctatggaaaattttcacacataacatattgttttgtagtttgaaaaatgtgttaacagaaaataggaagtagctatgctcaattagctatttagaacacacccttagatcggataggtagcctgtgtctacgtaggtacatgcttgatggacagtgctagcaaccgccataggtctatcaaagaaaggagcatgctcgctcattctcctgacgacatggaaggtgtgtggaaggaaaggaaccaaagagttttccagcataaagagctccacatatgtttgccagcataaagaactacgtgtaactcattatctactctggtagcaaaaatcaaaggaggaagccaacacatgggctttagcatgagcgaaacgcctcacagagcttatcctttagttttaagttttttaagttctcgtttttacctctagaaactttttactctgtttcaattaatgaaattggcatagctggttcattaaaaaaaagaaaaattctgaattaccccctgaactataaggatagcacgaattacacccataaaccgcaaaatcagacatccttcactctcaacttttcataccggacgaattaacccccctaactctctatgaagcggttttatcctacatagcgtacacgtggcagtccaattagcataaaaaattaaaagatgatggggccagcatgtcagttcttttttttattttttttaaaataattgtttgaatccacaaaacagaactgacatatacgtcccactgatttcaatttttttgtgctgactggattgcaatgcaagcaccatataggaccaaaaccgctctagatcgagtccgagggttgggggggggggttaattcgttcagtatgaaaagtagagagtgaaggatgttttattttgtgggtgagggcctaattcgtattgttctttgtagtataggaatgtaattcggattttttttccctataaaaaatatataaggcatttaaggcatacaggatgggctgtataaattgagccagttggtttctgtttcaaaaggaatttaaattttgggccgttgggccttcggctcagcaagtcctatttgaccgcccggcgttcgtctctgtccccttccttctcagtttctcctgtcatcccgccggggtcagatacgacaagataaccaataaaccagagtacaaatcttaataagttctccaactatggtctctgattttcgtacgcttacttttccaggctaaataatggacacggccacacggcaccagtttgaacgtcgtaccatccctgtgcacaataatgtattactaacaagcaccacccgatacggaaatctggtggagcggacagccggacacattagcattagaatcggtggctaccggctgcctgatgacctgattcgttcggaccgatcttgctcaagtttggctaccttaccaaaactttgttccccttcccatagtttcgattctacattcgtcatggtctccaacaagtatgtgtgctgcatagcagaagatcatttgcttccgggttacgtgcctgtttgttttgggtattactaattaaggtcgtcacgtaccgatattctagagggaaaggaatgattggcggcattggcactcctagtacacgccagcttaattaggattgtcatttgtcaatccgatggaagagcatgcatcagtatcgcgtgatgtgaaatgcagctgttctccgtggtgaaatgcattgagtgaaagtttccagaaaagatcctctgttccgtccttttttttttaataatgaaatagtcatcccggcctttgctcaaagagagctacagcccatctattatataattaaaggaatagaaaaaggagcctccacgttcgctctcatggcctagaaattctcacattaatcggagaaaaagaaaaagcagagtccatatagaaatacaatttagaaatagctgaaattcggaattaaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagaggagactagagtccatatagaaatacaatt

SEQ ID NO: 20471 - DNA, 722 bp, Oryza sativa
ttatttaattctttttaaatgggctttaaatagatttaatcttgtaaaattcttaataaattcatttgaagtcagaatgaggccgttcaagtctcataattcatctaaaattatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtgaaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcacttatggttatatttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacatta

SEQ ID NO: 20472 - DNA, 536 bp, Oryza sativa
  unsure (1)..(536): unsure at all n locations
nnnnnnnnnnnnnnnnnnnnnnnnnnnnnnnnnnnnnnnnnnnnnnnnnnnnnnnnnnnctatgatattaatgattactagatgttaaatagcattgtctgtgcatggaaaggaattttgatcgatcaaactaacatatttgtatcaggtcttgaatgagatcaaacggctccaggatatgtacgagcatgaggagactagcatcaccataacaggccacagccttggggctgcacttgccaccatcaatgccactgacattgtctccaatggttacaacaagagctgtccagtgtctgccttcgtcttcggtagcccaagagtgggcaaccctgattttcagaaagcgttcgacagtgctccagatttgagattgctccgcattcgaaactctcctgatgtggttccaaactggccaaaactaggatacagcgatgctggcacagagctgatgatcgatacagggaagtcaccatacctgaaggcccctgggaatcccctaacgtggcatgacatggagtgctacatgcatgggg

SEQ ID NO: 20473 - DNA, 382 bp, Oryza sativa
cgcacgccgggacgagcagcaccgtccatgccatcgccctcagctccgacgccatcgtcggcttgtcgagcgtttgcattatggctccgggcgacgatccgacgacgagtcgacgacgaacttaccgggaggaactaaatgtgcatgtgtatcgagcgaccaagtccttataaaatgtgttgacgatctctagttgtcctccccgatgcattgagaaagagagaaatacgtgcgaacaaagaaaatagaaatacaaaaggtctggaatgaatcgtgatggtatgtacatacatggattaaggagcggaaaatcgctcacgaaaacactgtgatcacaaggagaaacggaactcctcaacgagccgtagcctgtagcaacgac

SEQ ID NO: 20474 - DNA, 1747 bp, Oryza sativa
  unsure (1)..(1747): unsure at all n locations
cacctctccaatcctacatgccaaatcatcaggttaaaccctatcgtccattcgcaaattaggtatatctccaccacatgatttctccacgtcaccacgtgaagactactctctaagcgtgaggactacgcatctccgcgcaacacgctactctccacctccacgcgactcactactatagatggccaaaaggcccacccggcccggcccggcccaggcacggcccaccagccatcgggccggcacggcccaatcggcacttcgtgccggaccgtgccagcccatgggctgcgcctcctgcccaggcacggcccacaagtagtcgggccatgccgggctggccgaaggtacgggtggcccatcgtgtcttttttttaaataagtctattttccctccctcttctttgggttgtgacctatatatagctaaaataagtctattgtccctccctctctttgggatgtgacctatatatagctaaaatagtctattttacgtccctatgctttcgaccgtggcatataatatgtttatttttactccctattgcttatgtatcgggcctagcctacggcccatcgtgccgtgccgtgccgagccggcccaacgtgccggtggaggggcctaggcacgacacgattgtcgggccgggccagcacgagctcgacccccgtcgggccaggccgtgcttgggccgagccaaaatactgtgtcgtgggccgggccgtcgggcctcgggccttttcgccatgtatgctcgctactcctcctcgctcctccccgcatgtattggcaccgcgccgcaccgccgcatcctcgccggagccgacttctccagccgctgccggatcctacttcttccccatctgccgctcctcagcggccggagccgaggacaaccccttccgccgccaccgccgccaccgcgcactccaccgctggccaccgaggtcgtccccagccggtcttccccatcgactgcggctggagccgaggtcgtccccatccgccgccgccgccacattccaccgctgcccccgccgaagacggagccatggtcttccccaacgccatgctcgctcttctggtcttccaacactgttgagctcccgtcaacaccaccactgcgtccaccgcgctcgctcttcccttgccaccaccgacgccggcgctggtccggtcttgcgaggggaatccatggaactcggccacatacccacatcgtggcctccactacaccactatcacggtgctcgctggccgctctaccgccgagcccttcgctgtgaagcagatctggccagttccaccaagaggccgttatctgccccacggccgaggccgttgccccaggcccatccatgtctgcctgacgaccatctccatcatcagcactccatggaatgtatgaatgtatctatgtgagcttgtgcgtgctgtaaatcttaattttaatttaggttaaaatatatttgttctatcaggcaagagtgaagctgggttcaatcttgaacatctggaagtttgatttagagaatgccatgtaatgtgacatcgaggaaagagtgaagcaatttagcttaggtaaattaggtcatccagtgcataagagatttacacagctaagtagtacagtagtggtagcttgacatgcatgaatgcttggtccattgattgaattcacagctaagnnnnnnnnnnnnnnnnnnnnnnnnnnnnnnnnnnnnnnnnnnnnnnnnnnnnnnn

SEQ ID NO: 20475 - DNA, 3222 bp, Oryza sativa
  unsure (1)..(3222): unsure at all n locations
ccagttccaccaagaggcggttatctgccccacgaccgaggccgttgccccaggcccatccatgtctgcttgacgaccatctccatcatcagcactccatggaatgtatgaatgtatctatgtgagcttgtgcgtgctgtaaatcttaattttaatttaggttaaaatatatttgttctatcaggcaagagtgaagctgggttcaatcttgaacatctggaagtttgatttagagaatgccatgtaatgtgacatcgaggaaagagtgaagcaatttagcttaggtaaattaggtcatccagtgcataagagatttacacagctaagtagtacagtagtggtagcttgacatgcatgaatgcttggtccattgattgaattcacagctaagtagtacagtagtggtagcttgacatgcatgaatgcttggtccccgatccaaattttatattatctccttccattgcatgtaataattttagaaggttatactaatgtaacagcattaggccaaacgtacatgttgccgatttggtggtaacttccgacaaatcaatcttcccttaatttgactcattttgtcctacattccaatcaatgcatattatctatgaagaaataatatacattcagtttcaggtaaaacacaaagaaagctgctcctcatttgggtcaaagctataaagtaattccctggttgtgattgtgatccagcaccaattcagcagttccctatcctggctaacatgaatgttttactctttagttatgtatatgttgatataatgcgcgctgattaaaattaagtcaaacctacccccaatcatttattttgcttcccttattccttactttggttgacgaaatggacctgaatgtgtcagatttattcttcttaaaatttatttgcgatgaaatggatggagtaccaatggctgttgcaacagggtaatttattcaataaacaatatatttgccctcaatcctgtgtactatcttttcacagtaaaccatgtacttttcaaactagaatcatgtctaattatttctttatatctatgaatcatttttccttaaagacacagaaccacaaggagatgtttacactgatgtaccatgttatcatgggggatgatccagacctgaagactggcaagccatctcctgatttatttctagcttgctgctatgaggaggtttgaggtgtttccgtatgtgttatttcctttagaatgttcttaatttggactaaaatacagtactataatttcatcttatgcaagtgcactgcatgttgttcagggcaatgtataaccaggtaattgccttctatttcaagatgctggaatgttggtacatgtatttgttgtagcagcagtaaaaaaatgctggaatacaagtgccttgttacatgtgtgtgaagtgtgaacaatcatgacaacaagaaaacacttcttccactataaaaaaggtaaagggaaattcagccaatgtccaggtatgtaggaacaaatgggcacgtgctttttttaaattgagaaacaccatttcttgtgaacagagttttacatgatcagactctccagtgccaccctcttatttgggtacaagattattttggaacagaaaaaaaaatatatttacttattactattttttgcacttcttgcgtaggaatatatctaagcaatcaacgtgaggaatagagtttgtgaagactggagacatacaaaaacctttattggcactgatgttgtacatcctgttgattgaaaattttcataccactgcaatgttttagctctttttccatcagttcagttgttataaaacatagaaaattgtaagcctttatttatgacctgttatctactaggttgttttatgaaatagccttcccattgtgaactgaagtaggcttataaaagttcattattagtttatttgacataccacagtgactctgtatcatcaattgagtttactaaaacttcttttttgatggagtcattaagatgatcattgcaatttgcttgctagcttgaagagtgtcgtattcaaattcttctatctccatttaatgtagaggcttaccttgcctatttgctcgatgaccagggagcatgaccagactatcgtattttgtttagatggtctataagattgctagactatatatgttcaatgatctttgtaggatacataggcagtgttcgttcggggagattggagatagattgcacatcgttttccgcgtgcatgttttccaaactattaaacggtgcgttttttgcaaaaaaaattctataggaaagatgctttaaaaaatcatattagttcatttttgaaatttaaaataattaatactcaattaattatgcactaatagctcacctcgttttgcgtatcttcccaatcttctctatctcccctttctcaaacacagcctatagtgtattgatgcagattcgggattccgcacttggttttgtcttgacaaacaatagatgagctgtcacttgtaggagaagctttgtttaaattgctgtgtttatcttagataatataaaataaatgagctgccactatttcaatagagattttgtgttcttatttgcatgatacatgggtttgaaatgtatgtatagttcctttgtttttgtttcatgtgatgaaaatttcattcacatacaattgtcattgttgtattacaaatagtgtgtgttgggattatatattaattggtggagacgtgcgttgcacgtgcatgcacaattactagtagaccacaaacgcacaggttagccacgtctggccgcaccactcggtcagtcactccgtgacttaatcacccactaatcacgtctctatgcatgcaggtcatatctccttgcgtgtagagcactaacacacacatgcaacagagctaactgatccactatccacgccactactgcagctacttgacatgcaagcaccttcatgcaggtcatggactttcttgatcaagctaactcatgcacacactaatcacaactcacactaaagtaaaggtgaatagctaatatggtatttgaagtttcgcttcgggctcagtttaaatcgaccaaacaagtcatccaaattaatcatttgggttaatatagtccttagacccacaaaaagtgccacgtaagcatgccaagtnnnnnnnnnnnnnnnnnnnnnnnnnnnnnnnnnnnn

SEQ ID NO: 20476 - DNA, 2372 bp, Oryza sativa
aaaaaacacaaacagaaaaaaataacaggccagcaacaatcgtaagtgacaattctaaaacgaacatacacgtgtgaaaacatttatcttcttttttttctttcttttctaggtggtatataagggtagaatggtcatttcattcataccgctgcatgtgaggatgacttggcatgctcacgtggcacttttttggatccaagaactatattaacccaaataattaatttggaggacttgtttggacgatttgaaacttcaagaactaaactgagcctaaagagaaacttcagggaccatattagctattcaccctaaagtaaataacaagattaagtctaacaaatagacgaacataccggcaagatcgtctgggcagagcaggccgagcagatcgcggaaccagttcatctccatgtcgaggtgcacggtgtcgcgcacgtgcacgcctctctcccagaagaagtccgggctgagcgccgtggcgccgcccaccgcgaagttggccccgctggcgaagtcccccgtggtccgcccgccccagtacggccgcaggaacggcagccccagcgcgtcagctgaggccggcgccacgcgcgcgatttccaaatctcaagtgattagtactatgttgggttaagcaaatacaggtggaggggctggattggttgcgagtagcgtaccgatgaagtcgatgatgaggcggccgttggaggcccggccggtggcgcggtggaagaaggtctcgccgtagggtggccacagcggtggccggcgggactcgttgccgtagaggaaagggccgttgcccgtgtcagctagcgagttccccgaagctgaacacgcgcgggtagcacggcgccgccagtgcctgtgacgccgacagcagcacagccacggccgccagcacaaccgccgcaggcgagaggagtcgtcctcgtcctcttctcccggaggtggaggaagccattcttcctgtctgctcgagtcgagattctcgcattctcgagtgagtcgagtcgataattaatgcgaagcgtcagttaagcacttaagcggctagggaaggtgttgcgtcgttgtgttactagaggcctttttttttctcttttttgatactccatccgtagaatataagaaactttagaattggacacaattattaaaaaaataggtagaagtgagtggtgaaagattgtgattggataagtagtggaggtatatgggaaaagtgaatggtggaggattatgatcggttgggaaaagaatattggtagagaagttgttatattttggaacaaatcctgagggctaaaacttattatattttgggacggagggagtaaatgataacttgccgagattgtgaacagttgctgtccatttccagtggacaagtggtccgttgcgtcgctgtgtagtacactgtttttaaaaacatactttgactaatattttattgcattctatggtcctaataaatataaaattagcatcacattgtgaacagttgctgtccatatccactggacaagtggacacgggacaatgaacggtgagaggctcacacaccctttgaagttttccttttttctttttccgaagaaacccacactttgaatttttgaactacacgtggaatttaacatttttgcacacaaaagatttggtcagttcttaaagtaaagatttgggtattatgcggcactctatttaccggtggcaatcagccggttaccactttcgatatcgcttccacacaagtaaccggttgatgcctaaatttgtgtatgcgagtagtgagcaatttcttgttttcaaagatgctgtcacaacatgattggtgttttttcaattgatgaaataaatcctgatctttgcttaaaaaactacagctacttattacttggttcgctcaacataaagcaaactaaaaatccaacaaccaaggatactaagagcatcccaacagctcctctatctggtcctccatccctaatttggcgcataggagcgaaaaaaaccacttctagtggatgcgccatccagtcatccaaaactagcgcatgcgctaaaacgggagagagaaagggtaaatatagcatatctctctcctcacgttatatcacaacaaccgcgctccccacccccatccggagttccgcgacctctcctccgccgcgacctcccctccatcatcatcgtcgctagcccgttttttattttttttacaacggatggttgagagggagggtgtagccatggagtgagggtggagagggagaagcatgccagatctggaaggagagaggggagagcggtgaggcagccgacggggagataggagcggcggtgccgtcctcgatccgcag

SEQ ID NO: 20477 - DNA, 10871 bp, Oryza sativa
ttttttttattaatttaatttagaaattatgaattactaagtatcaacagagagtcttaactatattttgtttcaccatttaatattttttttgagaattacacggtacaacacagatactcacaatgcacgcacactcacccctatgaaagtacgcacgtaaaccctacccctataagcatctttgaagactgggccggcaatctatcctgaagattgacgaagtcaccataggtgcatcgctgtcgacgggtacgtctcctaccatttaataattttgaattcaacaacaaatcagtagtgagaatagtgagttgtgtttgataattggcatggagtcacaagtaattatagctttttatataatctaataaataaaatcgacgataaaaatttcttattgatggctttgggcacatatttgcatgtgttatcaatatatgttcatataattttttttaatatctatatactttttcatcacatagaacatgcaaatgcacaaacgcagtcacgcacacaacacttacacattcaaggtgtgccctaactcatgattaagggcatgtttagtagagctccaattcctaaattcagctacaggagttggtttggagtggagttgtggagctgcctaaacccaactccacctctattttaggtggagctgaaactgtttggctgagctccagctccaaaagagatggagctgaagttaaagctgtgccaaagaggcgctaaagagtcttaatttctgacataactaaaattttattaaaagcgtaggtgtgtatataatcaaataaaaatatattaaaatactactggatagagatgtgatcaaacttgatttgctaacctcaatgcattgacccttccatgaatccataatcaccttgtcattaagttctgcttatctacacaaacagggatgatggtacgttctcattgagaacatggaatttataaaatcattgtcatgattaatatttgtgatgaataattggctatacaaatgatttaattaaagaattggtttgagagtttatgtaaatgttggtgtgagtgcgtgtgactaatgtgggttagcttgtgatatctgtgtccagaaacggttgttttgtctgattgtgtgcaggtgacttgaggtcagccttggtcaatggtgagggccgggactatattcagggaggaacaaaggtctagtgcggtcgggataccatgtgagaaggtgactagagtccggattcttagaggtcaacttcggtcaacggtggggatcgggactaaactcatagaggagttgaggttcagacggttaaggataccgggtgacgaagttggatacgagatggcacatggtggatggacaccgtgtgggagagatcttcgcaacgggtttcacgaggtgtgcgtgcaagtgccagggttcgcgaaggagattggaagaaattagagagaagtatatggtgctacagtgcttcgagttactgtagcagtcgtgtatgcatatatgtgtgtatgctggtcgtagcatatgcatgtatgtatggtgattgatgcatgcatgttgtgccatgcatgtgtgatggctcggtgggcttcggtggcagctggctggaggccgagccggtccaggagcagcagcacgtcagcccacatgcgataggcccaagcaggagcaagcgcaggagatcgagtccgatgcggttggctgcggctgtgcgagttttggtaaattgtaaaaggtttggaaattgagagattgagtcctattgtgaataggagttttacacctactttgagtagggggttttttggtataaatagagagggagcgtgaggttttccggtatcgctttgagagcaattgagttgatagtttagttagggtttcgagtttagtcgagattttttgtaaggaatgctgtagttgcactttgtaaacacagagagaagcaataaagttgtcatctactttgagcgttctttgatttgtgtttcgtcgggttcaggcggcagcaaggtggttcaactggcagcgtgtgagcaatccgaccggcagcaacaggactacgtcgagatttccatcgatttgagggtaacttttatttccgctaaaagtttttgggtttttggttttccctaccattcaccctcctctggtaggcttgattgcttgtgttcgatcctacagaattaacgatggtaaaaacaggatccttaaatcagtaaaattagcagtaagttatgcaaagtgagatcagcatataaaaaaaagctacatatatacgtgtatttgtagatgagacgatacattaaatgtgcaacatttcttgtcaatcatcatgtcaacccctcaaggatgtgatgatggtgtcactactaaagaagaggatattgttgccggttgagaacccggtataggtgccggattttccaactgtcactacggaggtggtatagatgtgaaaccacataggtgccagcggtttagaaccggcacctataaagatgaatgagaaaaaaaaaagctggctcagctcgaatgaagccgaacacatcaagaacttcaagaacatgtcaagaacatcatgaacacatcacagaacacatctaagaacacattaacaacacagaacacttcgcgtcgcaggcggtcacatcaccctccgcgccggccttctccaccaccgccaatgtcgtcggatgttaacaaggaggagggcgtcgctgccttcagcaccaccgccgcctttacctccctttagaaatggcagagggaggacgtcgccaccgggtcgctaggctgccgccaccgcccttcccgtcgtcagatctggtggaggggagggcgtgccaccgggccgtcactgccaccactgggccgccaccacctccgtcgggccgctgagaaagtgagagagagagagaggtggggagggcgttgccgctgtgtcgtcgggctgccgccgtctcccctcccgctggatctggtggagggaagggtgcgccaccaggcccccgccgccacctccgccgggccgctgagagagagagagagaggtggggagggcaccgccgccagagcttgcgggtgggcagggctcgcgggtggggggagggagagagagaagcacgggtggataagggcgacgcagtcgtcgggataagcggtcagctcggctcgatttttttcgatgtcggttttttaaaaactgatatctattataaattaaaggtgctggtttttttactatgaaccgatacctttctctgacacaggttttagaaataaaaccagcacctatttagaaataaaggtgtcggttttttgtgatttcaacccacggaggtgggaaaatggtctataggtgccggttttagtatttttggaacctatcgtgccgatatctatttgatgttttatagtagtttgtatatgcatattctgatcggtgtcgtctctgaccgaaaatcaatgttgatcaacgaaaaatagttcaagtgagttgcagatggtggagtccatcttgttccgcttctggcctgatattcccatatgtcaattgtctggtctggttaattaatacggagtactctctaccctaggattagatagacgatcaataagtgtggcgattggagataagattaggtagcctaattgacgttgaccggattattagatcgatctgaagaaatctgtgcaagaaaaaaaaaagataattcccccggtgccggtgcatgcatggtctatatttaaagaaaattaaaaaaaaagaaaagataattattaacgtgacttgcgacttctccgggtgtatcatccatggatttcacaatcagcactcaattaggagttggacttgagcagtaccccctctgtcaaaaaaaaagacaacctagttataggatgtgacacatcctattacaatgaatttgagagatgtgtcacatcctagtacaaggttaattttttttgggacggagagagtacatgccgaactttttgattaatgtgagagctcctgaaaaatggccaattagtattggtatagatagatatgcatgattatcgactcaggttatggcatgagtgtacatatgtactactctctaaagaaatttagcataatgatacttacagaataaatgatgaatagtcccgttctttcttaaagaaatggatttattgtcaccattctaattcattcatactaaattatgcttagttagaattactcctttgaatccattccatataaaatcataattttaatccctaaaaaaataattttaaggggcatttttagtttttatataatcttgttactctcaacatgccaattagtgattagagctaagtacataggatgaaccgaaaattgaccactttaataaagattctatctaaatatgccatttcatcatttgaatgaacatgcataattgaagtgacaaagttgtgccaattaggttctaacttaccaacgcttttttaaaggaaacattaaatctggtaaggtaacggcagtaattcgtatttcaagcccttccaaggataggagtagccgattacgttaaagatgacgttttaaagtgattcaattttgtttccgaataatgataatagcccaatatactcaggcgtaaatgcaaagattatttaccattgttgttcttactgctttttggaaaaaggcaaaagctttctcacttttgtattaatagagaggagtacattcataacgcggaaatacatacagggtctatcacaagagagctattctccagggtgaatgatctctgtgattcgtgtggctaccgccttgatccacgctcacgcctccttttgatcttagcgataattgtagccggtatggtagctatgtgcctaaagattctgacattttgctcacaccaaagctcccagaacacaaggatgatgttaatgtcaaaatttggtaagccccgaagtcatcatcggcctagagtcagtatcggcatcagagttcaggaccggccgatgggcattatcagttgccagtagcccgattcttgatgggttcagctagggaaattaattacttaaaagaagcttatccagaagagaccgagttcgaggaggatgtggcttggcagtttatctattaattaggaatctgttcaataaggacttaatgtttttccttttatttctttaggaaagtttgtatcgtgtccaataaggataaggactagtatctacccatgggtataaatatatacaccggagtccttataaaccatctccacaaatcaatacaactacttttggcacattgccaccctcttgttcgaggttttacttatcaaccggcagaacttggcacctgatgcggggctgcatcggcttttgatctcctacgaaggggtgttgttcaaggctgtatcgcttcgacctcttggatctctcttgttcggttgatatatttgcatacctattttttatatatcttagttaatctatgtcgatgattcaatttatctgtatcggccgaattttttcagggtttagccggtatcgactaaattgttttgtcgatctagattggctaaggtatctatcacctaaaaattagtcaaatggttggtgtttagaatttatgcttcttttcataattagttctgcatcaattgggtttgacctactaagtcgtgcttagaatcataaaagctaacctatctttgattgccaataagtgtttcatcgtggtttcagccgataagttatctggacgttgcatcggctttacatataagttagttttagctaatcgcaataaatgtttcattgattatctaatcatttggatttatgaacatcgtatctccagctgatgtatgctttaatcaatagttattttatcgtatcgttattggccgattggtttctattggattatatttttttatatagtattatcagtcgattgtgtttatatcattatttactcaagtattagagtctatattggatatatagccgatttctcgaaaccctatcgacatcggttagtatcgacattgactggaattactatattggcttgctggccgatcggctctttgatgttcaatttatatatcttgttagttgcaggatccaactgactagcatgcccacatctcatcaatattttgtacctgcactggaattaagcagatctcctaggccttcgtgtgtttgtcgacacggttcgcgtcaatgcagatttgacaccattggtcggacgcagaattttttttttgttcgcactttttttttttggattttggctcctctgggcacgtttcactttttttttgccgtttctttccgattttttttcaatatttcgcatacctcttgacaaatgtagaattgaaagtttttaattttgacttgaagtttttaaatcttgacttgaaagttttcaaattttgtgttgaaagttttaaaattttgagttgaaagtttttaaatttgagttgaaagttttcaaatctaggttgaaaattttcaaatttgggttgaaagtttcaaatttgggattaaagtttttcaaatttgagatgaaaagttgaaatttttcaaaatttgacttcaaaaaaaattcaaatttcgagttgaaatttttcaaatttgagttaaaaacttttcaaaatctgacttggaagttttcaaaatctgacttgaatgttttcaaattgacataaaaatttaaattgtagttgaaagtttttaaaattcaagttgataggtttcaaatctttagtaaaaaaggaaaacaatgttatgtgaaaaaagaaagtataacttgattgaccgtaattatcagatctaattacctaacagttctgctaatcacgtttttatcccggttcttgtgcacgtgcggcagctttgtgacacgaaaaagaaaaaggaagaccattgccacgtgcgaggttagaggctaaaaaaaaaaggaaaaagtaaactgatgggctgcgcgtgagggcgtgggccgcatgcggagcaatgggccaaaatgcgcgacttaagttgatggcacgtacgcgctaattagcaattctgggcgcaagaagcactctctagctatcccgggccctctgctcagcatcttcgaggcacacatacgagtccgagtgacagtaatcattacattttggctaatgtgatagggggacaaggacaagactaagcatagtaccttccttccctaggaaagagcggccactatggactccccatagatataaaaggaggacccgtgccacttagaaaggggttggaagaaaaaagctggagtagaacctagttcacatcactctaagcaagaaatcacatacaaaccacatagtcccaaacacaggagtagggttttacgcatctgtgcggcctatacctatataaaccatcgtgttcatctccttgttaagaggagctcgggctcaactcaccctctagccgaatcatcttcaaaagagggagtgttcactttaccgttgtcggggtaccaaactctgacacttgtatatatgtatattagcttgatgataatgacatgtacatattttcatcaaaatactcaaagtactaaccactacatgcatatccttagttctatagtttacaaaatgtcaaaagaaaaagggcaaattgcaaaaccaccttaaatatcactatgaatttgagattccccctataatacggtttgttgcaaatacctctctcataattcacctttgtttgaaaatccccccaatagtcgttgcctgcccattcttgtgcccacaaaccccatatgcactcatcacatgaatacaagcaagtgaggagccgtggtggtcactcatgttggtcatgctctatatgatatgacaatgacattcctagtgatggctccaagcatgtcattggacaatggcagtcacaaatcttcgcacttggctcctgaggttcggtgcaggctggtttttattcagtagatttaagatgagaacgatgagctcggtgcaacactctgtcgctgagaaagaagatgtgtgctcggtgtgacaccatgtcactgagatagaatatgcgtttgcgaacatgtagatgaggagatacgctaagttgtataacacatgcagaaagagaaaaaaaatatgtgaacaacctaggtgaattaaaggggggtatttgcaataaaccgtcttataggggggtgaaatcaaaacctaggtgaattagaagggggtattttggggtgttttttttgcaattttcccaaagaaaaaacatgaaaatagatatgaaaatcgatgcttatgcacctggttctgatgaagcaacacttggaatacagaactaccattaattattgcaattatactttgcttattttagctagtagtggagcggaatacattaagctatatcaaaagcatggtagattgacatgttcttccaatggaaacaaacgaggagctcctaattcgcacatgcgccccctgaagcgtgcggcgcccctgctagcttcccccttcctctctcattgccctccccttgttctctctccaccaacaccggacaccaacggtgagcgagcaagcaatggccctttgtcgagctcctccgatggaagaacctgagcatgcagcggtgcagcaagaaacaaagcgcctcgctcaatccctccggcggaatccttctaccctcttccgacgatgccatagccaggtcagctccaatccctctcctcttttgcgtcggtgcctctcttcttttgcgtccaccggcgccgcccggcctcgccggtgtggacttgcctggtcggcctacccctctccttcacctagctttgtcctcatcacaaacaccggcccatcaccttctgcccactccgcgggttcgacaatgctgccgccacctcaccgccctcccttgtccaccacccaccaccgggtagccacctcccaggcaatccctctaagctaatcccaatttccccctcccagtgccacctttcctcacccatcccgaatcccaaaccctaaccctatcccgagcttgttgtcacgcggtcggaaactgcacgcgctcccccccccccccccggcccccgccacgcgtgcatggattaggattcctgaacaaacgagtactacaagaacaagataaatgcaatctaaatattatgaatggggaattaaacacaagataaattgttgaatagagaatgggtacatggtcgaatatatttagattacatcaacccagataatcaaacaaacaaactattgggatatatgaatgattagtcttcaactaagccattgagaactaaagacaagatgaaccgtacatgtcaaattattaactaaataaaacacaacttacgatggaaaatataaaaaaatgaagtgctttgattcatggaggtggcacacttgaggtggaagtcatagacctaatcctttacaagatcgatggcctaagtttaactcgatttcagcacaataccagcttattttgacaatttcacgtgaaccttttatccacacatacactctatgaaaataacaaaaatatagtcacaactacaaatcatagaggaccttgtattcaacagaagaaccgagctctgtaatttgtgggcacgcgagtggagcttgtgtgtatgaaccccgtagcaggccaattgcaatggccttaaacacagcttctgatggatgatagtcatcccatgacccatacagttgagggtcatcgcaccccttgtattcaccatgtccacatcttgcagtttcagatacaccataaggtcctcctccaccacagcaagctgccaaaggattctcaattcctgaaacacaatcagaaaatttttatttaagctatcaacgacaacaaaaaccgtgatttgtcaatgcagaaattagcatgggagtgcatgacatgggtgctgaaaaataaagtagccaacttgataataaatttgtggagcagaaatcctatttagctgttgtggctaagataaaagcatagataaagatttgctttggtttgagaagcactagggaaatcaaatttagatgcctattgcttttcagctcttgaatatcatgacatcttttcctattgcttttcagctcatctcctctagacactttgctgtctactacgaatagttgaagcaagaacaaatatagtatttgtcatcaagcgattcattatcaacatagaaagtagagtaggggtcccttacatgacatgatgaaaataaactagtggacctggcaaataaatgaagggggagaaatcgtatttagctattgtgactatgaaacgagcatacaaaaagatttgcttcgatttgtttgagaagccgtaaggaaatcgaatttaagcgaacacatatatagagtatttttgtgtaaaataaatactaaaattaatagtgttaagctttacaaaagaaatcagagtagcactggtggagaaaccatctttgatcggtcaacccaaatctacaatagtcccggttctattaaaaaccgggactaaaaacgattttttgtcccggtttataagaagaacatgactagatgatctttattcccggtttgtgttaccaactgggactaaaaatcatctttagtcccagttggtaatatgtcagaccgtgtcaggcgcctaggatctttagtcccggtttgtaacaccaaccgggactaaagatctaactttagtcccagttgttgttactaaccgggaataaaaatcaacgcgtactatataatccctattacttatcctcttctctcgtccacacaacaaactctatctctttctttct

SEQ ID NO: 20478 - DNA, 5606 bp, Oryza sativa
gttgcagcctatttgctatatttcccacgccttgtgcctctaaaacgtcctcatgctcactaaaatgttgttgcgacatgtgatatattagtacaagtaactatgtaactatttgtaactattactgaaatatcattttattttacttactataggaacccttgcagttcttcacaattattgagcacgtaccaacacagggaattatattgatcttgtgttaggattacgtcatccttgtgaccaaaagcacagaatctagataaaaatattgagtagcgatcagcgaattgcctctctccatcatagtttctctcttccctattgaaccttgtctcaattccattgagatacatagagcaaaatgttgagcactccttcataatataggcttccgcgattgaaccctctggatgtgccctattgctcaccatgcctttcaaagtaccaaggaacctacataccaataatatacacttactacagtacaacgacaaaattatagaacaaagagaaggatcctaatcaacacatacctttcaataaaaaacatccatctatactgtacaggtccaccaagtcttgcttgttgtggtaaatggactgctaagtgtaccacaatatcaaaaaatgcaggtggaaaaatcatttccaattttcacaacacaaatattatttgttcttctaacttttccagcacatcaagcttcaatgacttagagcatagttgacgaaaaaagctacctaactgtaatagtgcatcacaaatgtcattctgcaaataccctcgaattccaattggaagtattcgctgcaaaagcagatggaagtcatgtgtcttcaacccagttattttcccctctttatagcttagaccttttgatatatttgcaccaaaaccatcaggaaagcggacagattctataaattgaaaaaaatcttgtctctcctcttgggatagtgtataacaagcaggaggctttatgacattgctgcccctttgttgcaagtgtagctctttccggatgtttatgtcttgcaagtccatgcgagccttaagtgtgtctttagtcttaccatttatgttcaaaagagttccaagcacgctctcacaaatatttttctcaatatgcatgacatctaggttgtgtggcaacttgagttccttccagtacggcaactcatacaaaatgctgatcttagtaaaattctttcctgggatgtccctttctgaggtctttcttttcttatttccatcatgctttccatacttgaagccttgtagatgatctaatttttgtagcattgcaaaattttcatctcctgatagctgtcttggcctcaatgatgtttcattcttgccattaaagttcttacttcttcgccatctatactgaataggcaagtatcttctatgacccaaaaaaccaatcttgcttcttagcgaacacgaatcagtccaatctaaacatatcgggcaagccttatagcccattgccacatacccagatagtgaatctaatgcacgaaggtcactaatagtgcctagcactactgctcgtagattgaaagtatctcctacaaaggcatcatatgtactgactccagtgttaaagagtagattcaattcttcaatcaagggcctcatgtacacatcaatatcccttccaggtgctttcttccctggaatcagcaagggcattaatatgaagggttccttcatgcacttccatggtggcaggttgtatacaactaatataataggccacacactataagagctactcaaagttccaaatgggttgaacccatctgtagcaagtccaaagcgcaaatggcgaggatcgtgcgcaagccattggtattttccatccaaatccttccaagcttcgccatcagctggatgtctcaagacattttcctcaattacacgcttatcacgatgatatcttaagtctgaggctatgtccttgttcataaatagtctctgtaacctagggatcaaaggaaaatatcgcaaaactttgtgaggtacacgtttctttcccttgtgaattttccatcttgattcattacaaacagggcacttatcatagtcttcaagttccttccagaacaatacacaatcattgatgcatgcatgtatgctttcatagcccagccctagatctcttaacatcttttttgcttcataatatgaggctggaagtgtgtcacctgttggcaaagcttctttcaataatttgagtagcatctcaaatgatttgttagtccaatggtttaaatcttttaagtggactaacttcaacaagaaggataacagtgaatgacctctgcatcctgggtacaactctctttgtgcatttcttagcaagttatcaaaacggactgcctcttgattagattagaggacattatctccattattaccactttggttctcctgctctgcaaccccaattgtggccctatggatatcacctaatagatcttgaatagtatcaaatccatcaaactcatccccattatcttcatcctctaaaagttcatcgtcctgatcataattgttggccacttctccatggaatacccattttgtatatgataattgtataccatacaacaccaaatgtgttcgagcatcattggcacccatctgacttatattcaaacacctttcgcatgggaaaaatataaaactgttctctccattgtgttcacaagcaaattcaataaatgcgtttaccccagcaatatactccctagagaacctatcgggcaatctcatccaactcttgtccatattctaatcctctgcataaatgcaagtttccttagaattaatcaccaatgtggtaatgcaagtattacagattatttaatctaaaactatttaatctcctcacaaatggcaataaaacttctaaagccatggcactcacaaaccaacatgctaacccaatgtcatggaaatcaattcatttctaaaaccctaaaattcgaaatactgtgtgctaatcaaattagtgcagtcaaccagatttgtaagtcacactcatgttatactcatgttatagcagatcaaatctcacacaaaaaccattgaataatagtgcatacaaacattcatttgggttatagatcaggttcaaggcacatccagttaaacaaattgtttgtgtgcaaacatagaatatcaggagaatttaaccacttaccttgaatcaaagtggagactcctcctgctgcctgcaatgaatcaactgcttgccccgacgacgttgtagctaaaccaccagcgatccctcgggcgctgccatcgcagagaccaccgattcctgggcgctagcacaggggccgcgaaggactcctccaccgagcgccggcggcggcggcggcgtcgtcgccgcaaaactccgtcgacggtgccgccgccggccgcagatctcgcctcgccgccgccgccgccgccgcaggagacctttcccttgcctctcgatttgtttctggatggggatcgggaggaagtgtgttttgcactccagtactccacatattcaaatatcaggtacatgccttggttgctatatgttgtcacgtgactagtgaccaagtactggccagtaacttggtaactgtagaggtaattggtattgtttaactcaagtaacgtgctgacagctacagaaaccaaggtattagcatgttggttactattgattaatatctaggcaccaaacttcttggtaactaaatatacggtagctaattgtatgttttcttgtagtgagaacggtgtctactcaaccaaattagcatacattacaattcattggggcagcgggctcgatcttcaaccagacaatctcaaaatgttgggtgccactaagtgcgcgcaagttcttttcttggctcataatccaaaacagagtctggataatagacaggctccaaaagagagacaggacaaaccaacacaattgcccaatgtgccgagcttctacagaatcggtcctacacctcctagccaactgcagactgtcgagaaggatatggacaaaacttcaaagatggataaatatcgacctccaaataaatgagtgggcaaactgcgccaatgtagaagaatggtggtacaaactgtcacgtataccccatgtgccgagaaagacactaaaattggtgatcatccttgtggcctcgaagctttggtgcgagcgaaataccaggatctttatacacatagctaccacaatggctacaattatcaccaagatcaaagagaatgcgcgagcgtggatcaaggcgggaggcacatgaatcatagagatcatcccctcgaagaatagccctattctagttcttttgcgggtctattgtttgtgatagaccctgtatatatttccgtgctgtgaatttactcctctataatctattactagtacaaaagtgagaaaagcttttgcctttttcaaaaagaaaaaaacagatattagttcttatgatttgtgaacaatatgtacaaatgcagtaagaacagggacggtaaataatctttgcatttatgagtatattgggctattatcattattcggaaacaaaattgaatcactttaaaacgttccatatttaacgtgctacttctatccttggaagggcttgaaatatgaattgctgccgttaccttaccaggagatttaatttggtgccacaatcgggttccgacgccaccaggccgatcttggaaagcattgacacattttgatccgcgttcgatcacacggaggtttataaaagggggtctgcatatgcaagcaatgcagaacgatcgcgacaagtatatatctctctctagcaatcatctcgatctgtacattcttggcgatggagagcttgatcaggcgccatggggggcgccgtgccgtttccccgtcatcgtcggcggcggcggcatcgttcatcctcctcctctgcgccgtcgtccttctcaacactcacgtggcgctgtgcggctgctacaagcgcatcttcagcttcggtgactccatcatcgacaccggcaacttcgtgtaccttaccggcaacggcccgtcccagttcaaggagctcccctatggcatgacctacttcaaccgcccctccggccgcatctgcgacggccgcgtcctcgtcgacttctacggtgagttgcatctgcagatgtagcatgtatataattttatatacacgtgccatttcttgatttcgcgcgtggcaatctatatttgctcgtgtgtgtgtttcagcgcaagcgctcaacctgtcgctgctaccaccgagcataccggaggaggggtcagggcagttcgagaacggcgccaacttcgccgtgctggcgtcgacggcgctggggccggactacttcaagaccaagtacaacttcagcctgcccgtgccttactgcctcgacaaccagctcgcctcgttcaagaaagtgctcggtcggatagctcctggagtcggtaaacaatcaatcacgcgaacacgttgttaatttgatcgattaacgtgcatgcgtgcagtgcatggaagagcgtgttcagatcatgtcggatatatatataaat

SEQ ID NO: 20479 - DNA, 3805 bp, Oryza sativa
  unsure (1)..(3805): unsure at all n locations
nnnnnnnnnnnnnnnnnnnnnnnnnnnnnnnnnnnnnnnctcgcctcgttcaagaaagtgctcggtcggatagctcctggagtcggtaaacaatcaatcacgcgaacacgttgttaatttgatcgattaacgtgcatgcgtgcagtgcatggaagagcgtgttcagatcatgtcggatatatatataaatctttgtctctgtttcagatgccaccaagagcctgctaggcgagtcgctgatcgtgatgggcgagatcggcggcaacgactacaacttctggttcaccgcgcggcagccacgcgagacggcgaggcagtacctccccgacgtcatcggccgcatcggcgccgccgtccaggaggtgatcaacctcggcgcgaagaccgtgctggtcccgggcaacttcccgttcgggtgcgccccggagtacctccagggcttccagagcagcaacacctccgactacgacgccaccgggtgcatcgcgtggttcaacgacttctcaaggcagcacaaccaggcgctggtgcaggaggtcgcccgcctcaggtcgcagaaccccggcgtgaggctcatctacgccgactactacggcgccgccttggagttcttcaagaaccccaagaactacggtgagcacgccataaatcctatatattgtgttcgatatatatgatgcttcattgctttgtttgactaataatgttttatcgatccgttcttggttttggaaggtatcggtgaccctctgctggagtgctgcggcggcgacggcccgtaccacaccggcatgacgtgcaacaagacagccaaggtttgggggtccccggccaacttcgccagctgggacggcgtccacatgacggagaaggcctacagcatcatcgccgacggggtgttgagcaagcgttacgccgacgctccgttgctctgctagaggatttagctggaattcgtgcgtggctttaattctgggatagagattcttgggaactcttacgcatatatatttgtatcaaccagtgaactagtaatgcaaataacaataatctgattacgcaacgcacgcattccttcctccggagtccggagtataacatttggtaagcgtaaacccgtagcaagatatactgcttatgtaagatatgaccacacatttatttttctaaatgtcgtctatctcattcggtttggtctttgacccaaatagtttcaaacctacatccatcctatagtgtttcacatatgttcgggacgggagtttggcttttgtgtttatctaaagttttgagacctttactcctaatatgagctgttgctatatgttgatcggtatggttatgtaggaatggtgtagcttttaaagattgattctcctttgcagggtaatctggcttcgtttttgggctacttcataagccaagtttacggaatttaattgcttttactacatgttagcaattggaaagtggccaagaagttttttacctacgagcgtgggtggcgacttaatctacgaattgataacccttaattcttcatgtttaattctttcaaaacaagtgtgggtatggtgtgcgtttaggttatgtgctgagtatctgtttaggctatgtgcattttaggtatgtagaggctacgaatgtttttagcatggttgtatcatcttgaataaaaacttatgttatctaaaagaaaaatcattaatattttaattgatcaagtcaaggagagtaggaccgacgagtaatgtagatgaggctagctatcgagctcttgagtttgtgagtgacaaaatgctcggttccttacatggtagaccggggcccatataagaatacctacttgttgaatttcccgcgcaattgcatgggactaatcgaattttccccataattgcaggagggatattgaaatagaattatatttgctaaataaatcttctcattttccgagttaacgcttaatatttaggtcttagctaggagagtgttaagaattagggtaaccaatagtttcaaaggtaccaaccctatgatggaaaattttcttcttttggtagaactctaaggccccctttgaatcacaggaatgaaaaaacgggggaatgggaaaaacataggattctgataggaatacaagtgtaaaacagaggattgcaaaacacaggaaaaacatagaaatgaccgtttgattgagccgcaggaaaaacacaggaatttgaggagagagaaagactcgaaggattcttaacatgaggtagaacctcatgttaaatttccttcaaaatttgcatgggaagaggcattccataggaattttataggattccataggattcattcctttgattcaaagggctatataggaaaaattcctatagaaattaaatcctttaaaattcctatgaatttcctttgaatcaaagggggcctaaaaagaataaagatttttaaacacacgggcataggaaaaaaatgtaggattcaaacgcctcgacatctcaaatcctatggattgggaagcacagaaaaactaaatgaatgattatttggataaaacgtaggaaaaacacaggaattaaaacagagatatagacatacaaaggtttttttttccaggagattgatcctcatgtaggaaatcctccaaaatttccatgattgagacaatcctaaggaatttcaaaagatttgaaagagccattcccttgttctaaatgaccatataggatagatgtctttccataggaattcaatccttgaaaattcctccagaattgctttgatttaaaggcccaaatttagatatggttttatacaattatatttgtaaaactagaagaaagagttgtatctcaaatacaattatgagaaaagaaaattatcttgaatcaacatttatacgatccattgatgctacagctacaatgtggcgtcactatgggtatacacatatctttagaatactatatctacacggcttcccatcaatctgcatttgaccacagggaaggaactgtccaaaatactttaagaagcactttaatagtattcggatgtattgcatatgttgtgatatggtaccataataataccataattggactacatctccatttataacaggggattcgaatgagccatttaaaatgcaggcgataaattgaagccaacaacattgtgtccattgtcttcgatccctctgtcgatctctgctgttccagcctagaggcagagcagcagcagccgttgtcagatatgggaagtttcagtcaccagaaacattccatttccgtatacctcgtcctcgtgtccgccgtcctgctgctgaactcaaccctgggtttgtgtggctgctacaagcgcatctttagcttcggcgactccatcatcgacagcggcaacttcgtccacatcgccggcgaccatccgtgtccgttcaaggaaccaccgtttggcatgacctacttcaagcaccccagcggccgcatctctgatggccgtgtcgttattgatttctacggtgagttcataggcccatcaactcctccctgactgttccaaaatttattttcccatgtatggtcaaaattgatttttcttttgtttacagtcagggcggatcacacagctaggatagccaatattttcgtaattcaacaacattgaaaatcatttgtccatgtttttgtccaggtttttgaaaatttctagatccgttattgtttacatagatagtaccctctttaatcatgaaaatatatcattttgattttttttaattatcaaactacatgcataa

SEQ ID NO: 20480 - DNA, 4087 bp, Oryza sativa
aaccctgggtttgtgtggctgctacaagcgcatctttagtttcggggactccatcatcgacagcggcaacttcgtccacatcgccggcgaccatccgtgtccgttcaaggaaccaccgtttggcatgacctacttcaagcaccccagcggccgcatctctgatggccgtgtcgttattgatttctacggtgagttcataggcccatcaactcctccctgactgttccaaaatttattttcccatgtatggtcaaaattgatttttcttttgtttacagtcagggcggatcacacagctaggatagccaatattttcgtaattcaacaacattgaaaatcatttgtccatgtttttgtccaggtttttgaaaatttctagatccgttattgtttacatagatagtaccctctttaatcatgaaaatatatcattttgattttttttaattatcaaacctacatgcataatttgtatattttcaataaaagattatttgatggaaaaaattaaaagcttgactttatgtttagtaactgaagagaatatacagtagagcaccattaattcgagtagtagtgcacatacccaatacagtagtacattttttagatgatgatactgtgtgtagtacatgttttttttttttttgacatgcccaccatgtgcttgcgtatatatgttgcagcgcaagcactccagcttccgtttgtaccaccgagtttgcccgagaaggacagggggcagttcccgcacggcgccaacttcgccgtgttggcctccacggcgctgccgccggagtacttcagaaggcggaaccacaccgtgccgatgcccttctccctcgccacgcagctggagtggttcaagcaaacgctgcagcggatcgctcccggggacggtaagtagtacgtggtacttgtaaaattaacaaccaaaaaaaaaaaaaaccgtgtgcacgggcaacagtgcacactgcacatacacagctgatcaatttgtccgtttcaagtttctaaaatgttgctcctgagtcctgattttaaatttcagctgctaggagagcactgctcggtgagtctcttatcttgatgggtgagatcggcggcaacgactacaacttttggttcttagatcataaacctcgcgaggttgcttaccagttcatcccggatgtcgtcgccagcatcagctccactgtccaggtcggcacaaaccatcatatcctgatcgaaccattgcatatgtacatgaaaaacatgaaccatcccactgacgtagcatgcaccatgtacatatacaatcgcatacacgcaggagctcatcggtctgggcgcgaggacgatcatgatcccggggaacttcccgaccgggtgcgtgccggcgtacctgagcgcctaccggagcggcaacccggcggactacgacgagttccgttgcctccggtggttcaacgccttctccgccgcgcacaaccaggcgctgctcaacgaggtcagccggctcaaggcgcagcacccgggcgtcaggctcatctacgccgactacttcggcgccgccctgcaactcttccgtaatccacgcagattcggtgagctgccgcttgtttcgatcgcatcgcatcgttaaaaaccgcaagatgcgtacgcacgccacaccacagtactgatatatggaatatcgatctgtttgcgattggcgtgcgtgcaggtatcaatgatcctctgctcgcgtgctgcggcggccatggcccgtaccacaccggcgcgacgtgcgacaggacggcgacagtctggggtgatccgggcagtttcgccaactgggacggtgtccatatgacggagaaggcgtaccatgtcatcgccgacggggtgctcaacgggccgttcgcggatcctccgttgctgcatagttgctagaattgtgctatggctgttccagaatccagctgactactgtagctgagatctccggagatcttttgctggttttattgatgaatttgaaatggaggaaattatttcagtttacttagatgatttcgaggagaaataagttcaagtaatgtcatgctcgatgctattatcgctttttttttaaagaaaaatagtacaaacgtaagcgctcacaatgcgtgcacattcaccatgacgaatacaaacgcacagccctaaccctataagcatctccgaaaaattggaccgacatgtattgagaatgacgaagtcaactcaggcatctgctttgaaagactaggatgacatatcttgagaatgactaagtcgttataggtgtatcactgatgacaggtacttctcctaccaccaaaagaaaaaagctgtaaatacgaacacccatgtcaaatctagaatttgaatccgagtatggtggttctaccgtaagaaacctaaccaccagttgagctattctcactttggtattatctcttgatttcaagcgttgatgctgcactttacacacaaaatgacaaagaaatggtgatctaaggtcccgtttaagttgttaactatgaacacgcaaaatgagaaaactattaatgcatgattaattaatttttaattattttaaacttttaaagaatttgtatatgatattttaaagaaacttctataaaaatagttttacacgaaatacaatgtctaaaaagcgtgttaaaaaaccaagatagaattggtatcttcatcaccaaaataatggggcgtacagattgatcagacccttcaattaagcccacaatgggcctactccttcgaagagcccattatgggcctacacaactaagcccattaaaattaagcagggccgagacccatcgtacacgcaaaaccgaacgagaaagctttgaaaccgtgcgaccctgaagcccgcggccacgatgcccccgccgtggccgccggccgcgccgccgccggcctgcgcgcgctcgctcgctgacctcctcgtcgcgctctccgccgcccgcgcgctccccaaggggcagcagctccacgggcatctcctcaaggcaggccacttctctgccacggcctcttcccacgcgcccatcgcccaccacctcctcaccttctacgcccggtgcgcgctccccggagactccttttgcgcattcctcgacctccccgcgccgccatccccggccgagtggtcctccctcatatcctccttctcacagaacggcctccccgccgccgcgttagacgccttccgccgcatgctcgcggctggcgtccccgccaccgaccgcaacattccctccgccgccaaggcggtcgcagccgcggaagactcctcgaaaaagcatcttgccccgcacgcgctccatggactctccgccaagacaccgttcgccggaaacgtgtttgtcgggtcgtcggtgcttgacatgtatgccaagtgcgggcaccttgccgacgcccgccggctattcgatgaaatgccgaagcggaatgtcgtctcctggtctgctctcatatgtgggtacgctgatgctgggatgcattccgcggcgatggagatcttccgcttagcacttgaggaggcagtgccggttaatgacttcacagtttcgtgcattcttcgcgtgtgtgctgcagcaacactctttgagcttggtgctcaggtgcacgcccgatctataaagacagctctaaatgcatcaccgtttgtgggtagctcgcttgtttctctttactcaaaatgtggccttgtggagtgtgcataccaggtgtttggtgaagcacctgagagaaaccttggaatttggaatgcggggctcaatgcatctgctcagcatggtcatactactgcagcatttcaacggtttatggatatgcaaaatgctggatttcgtcccaactccatcacgttcctgtctttgatcactgcttgtagccatgctggtcttgttgatgagggaaagagatatttttccctcatgaaagagtacagaattgagccgcaggctgagcattatgctgcaatggttgacctacttggccgtgtaggacgtataagtgaagcactaggccttattgagtcaaggggatcctctagagtcgacctgcaggc

SEQ ID NO: 20481 - DNA, 2564 bp, Oryza sativa
ttttagtgaggctgacaaagaacctttgtatgagcttctgaaggtatataatattattatttttattcctttatgtaatatctttgacttctctggagtgatcttgcaaatactaacatctgaattctatcttttgcagatgaaattcaacttagatctatctgaacctcatgttaaaggctgtctggagctactattttcgtcaagctataaaacatttcaccatagatgctatactcattatctcaagtctggtggtggggacagtgctcgtaacagtccatatgaaccccttcgtgacagacctggttattggacttggctttgtgatcatttcgaaacagaagaatttcaggtatatgattctttgcatgctttatcttatatctgaatgcatgcctcttaacaactagctaaatttatttcttcttcatattaactaaggcattttctatgtgttcctttggctattcttgccatatgcagaaaaaatcagttatagggaaagctaatcggatgaaactggcatatgttcataaaaagggaaccaaaccatttgtggcacttcagcatgaattagtaagctaaatttcatctattttccttatgatttatttttcgtaagcatctgtttaagtaaatattatgtcttggcagagttgtgatcaaatctcattgtacaaggaatgctattgtagtgacaaaggatgggcgtcaagagatgctagacagaactatgtaagtatcattctaacgagtcattttcactatagttaagtgtcttcttgtgctaacaaaaacttttgatttttttctatataaaggaaacaatgttacagatgcagcatgaaaatgagcaagaaggtgcaatccagctgacagagcaacaaatttgtgagaaggtgcttgggaaggcatatggatatattagagggagaggtcatggtccgaaacctaatagaagagcttcatcaacttcagcaaacacctatcaacaaatggaagaagaattggcttctacagaacaaactgtggcagttcaacaaaaccagcttgcagtataacaaaatcagcttgaatctcaacaaaagcaacttgattggttgcgcagtgtcgtgtccaaacttgctggtattccacctcctgctatggatgataatgatgcctcaggaccatcccacacaaccacaacttcaattgatggatccggtatgcaacatttttttttcttctaaaagaaaagaagaatatagtgttataatacatagaaatgacaattaacttttgttaaatttatttgataggttcactggtttcggatggaatgtcaaggagatcatgattttgaagatctttgattaggaggtattactactagaaattgattgcccaaaccatatggaaacttgagcatgcatgtagtactgcttctataaattcatgtttgaattgaatctctaatgtatacgctagaattctataaattttccaatcgactttttatgtcctgtttctattaaaactccactgtagtcatagcactgttttgaatttttttcaattaaattttagcaatatttcccatactccatgcatcttaaagttgcaactaaattgaaacttcgttcctatgaaataagttcatcattaacaattttgaagaagacaggattagaggatcgaccagatcagcatagtagtgaatacgaacattttatatatgtgatccagtccatgacattttctaatttccctgagattagctttttttcaggaacaccgcaacgtaatctcctaggctattacatcatcttgacaatactcatcatggtgtttcaaaacaagcatcaggttgcgatgctccaagagacttgtataaactcaaccatagtactacagaaattttgtttactttgtggtatagtgattcgtagttctgttcagatagaagtgattcatatttttcttcaaatagattactcatttagaagttgacttttgggtataatgatttccttgtaagactgcacatcagttttaatgtgttaccgtgtcaagcatgtactctaaggtgaagcttgagatgagtttattgtagcactattctgcagttgatgctatggtaacctagttgattcatatatgaattgcacatcaaattgccatagtactgtagtttctattaattgctctgtctgaattgaattatgcagtgggtgaacaaacctttagtcaccaaggtaattaatgttctaggtggcaggatgtatgtacttaccaaggagggttggacacaacatacttttagttgccaattacttggtggcaaattataaatagtcaccaagcaaccttggttattagatatttttagttaccaagtaccacttggttctaaaaaatatatagttaccaacattttcttggtgactattgcttttacatattgttaccaactatggttggtaagtaattatattatgtttagcaaccgaggagatcacacgttggttacaaaatacatttagcaaccgggttgtagccaccaagatgcgcccacggtt

SEQ ID NO: 20482 - DNA, 768 bp, Oryza sativa
  unsure (1)..(768): unsure at all n locations
ttatgttcggatgaaattccaaggaaacggtccttaggtacaagagcgggaaaccgtacacccagtacattccccggtccgcggttttggaaattcatttagttcgcaagcaccgacccaggtgtcgggttttccaagtcttttgtaaaacccaagttttacccaagaagttactcagattttaagtttgaaggcgaccgtcggtactcgcacagagtgcacgaatatcgaggcgcaactagatggttacaagggaacatggtataacaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcggactccgaaactacacgcaaaacgggacaactcaacaaacggtgaaaataaagccctattaatgacctctaagcgtgccattagatagatctcgagatttgagaaattttggaatttgaacggagtcaaacggatttacggttgggaagatattgaatttctaagattattggatttttggtctaaaggaaaaggatttaattaaatcctttttggaaaagaaaagaaaagannnnnnnnnnnnnnnnnnnnnnnnnnnnnnnnnnnnnnnnnnnnnnnnnnnnnn

SEQ ID NO: 20483 - DNA, 2715 bp, Oryza sativa
ccatttgaaaacgaagctttctctctcctaaagcaagcaccaattagggggggaggttttcaactcgaaatttttacttgaactctatacgaaaggtgaagaactctctatcttgcttcatttggctccatttttggtatatttcggttgggggaaagtggagtttttttaatattttgacaaggtttggtccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatgattgtcgatgtttccaccgatagtgatgatttcgatggtggttttgatttagaggatatgctacgccatgttgaaccagaggtgctagcgggcaggtcacgaggattggagaattggcaagcattagagaaggcatcgaaggatcttctttacgatgaaacgaagggatatgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacgggaaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcaatcatattcgttaccatcaatgacctacctgcaaacttttcattatctggccagattaaagggaagactggatgtctaatatgtctggagaaaacttcatacaaatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgagaacggtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaataaaggatttgtccatttcgggatacaatgcgcatgactgtcataggttgctaacagtgttcctaccaattgctataagggcagtcaaaccagtccatacaaaggtggttataacaaagttgtgctactttttcaatcgaatttcgcaaaaagtatttgatcctttggaattaggcccgcttcagacatttgccgtcgagactgtatgccagcttgagatgtatttcccaccatcatttttagatatgatggagcatttgatccgtcacatcgtccctcaaaatattgaacttggtgcatgatacttacat

SEQ ID NO: 20484 - DNA, 3056 bp, Oryza sativa
atatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacctcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagaacgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagaggaaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgcggccggattatgtcgaccgcatggaaagatatttttccatgcggacccttaagccgtccgcatgcgatgatctgcgcctatatatagggagcgcggggagccaaaatttctaagtcccggctcccgcgaaaccctagccgccaggctgccaaaatttcccaagtcgccatcgccgtcgtccccgccaccgccggctcctccccaaagtcgccccgccccacgccgccgccgccgccgccgtcaggacctctcccccctcgccgttgccgtcgccgtcgccaggacctctcccccctcgccgttgccgtcgctgccgccaggacctctcccccctcgccgtcgccgtcgccgccggcaggtcgccgtcgccaccgcacggaactctcccccctcgccgttgccatcgccgccgccaggtcgtccccgccgccaagtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacctaatggtgtatagagttacctattctgtgcagatggtagtccgacgccgctcaaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaacgaaacttacaacgtgattgctctcgatcagga

SEQ ID NO: 20485 - DNA, 1463 bp, Oryza sativa
acgtacggatacatctacaagtgcaggcgggagtgggaaaaaaagacgtggtgagataagcaagaataatttacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcttgaaccaccgtcacctcgacatccgccgt

SEQ ID NO: 20486 - DNA, 1964 bp, Oryza sativa
ctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctttggtagaagaagtgcacataccagatggtactacatccgactctagaggatccccactttggaacctcgtcgtataattccaaagttgatatcgacatacgacccaaaggagattgacaaggacaaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcactttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgt

SEQ ID NO: 20487 - DNA, 957 bp, Oryza sativa
cagttcacttggtaacagtcatgatgtgtataatagtactacagttctataatgagaacaataccacagtccttacatattttaattgcatatattgtgtataataataacaaaatataattacagaactacatgtcatagatgaccttgcgttcagcagaagaaccgaggccaatgatctgtagacaagaatcggtgatgctagcgattggaggttgagtgtatgggccctgtagcaggccaattgcaatgcccttgtatgcagcttctgatggatgaaagccatcccacgatgcatactttgatgggtcatcacacactttgtattcaccatatccacagcctgcagatgcagatacaccataaggtcctcctccaccacagcaagcgaccaaaggatcctcaattcctgaatcgcagtttgggagtgttaaacaagctaccaacaagaaaaaatgttctttatcaatgtagaaagtagttgaggagtgcattccatgacatgatgaaaatagaatagccaacctggtaaatatatggagggagagaaaccctaattagatgttatgattgtggtacaagcatatttacagaaagatttcctttgttcaagaaatgctatggaagtcgaatttaacaggtcaacagaaagctagtattttatttcttgtagtaacctacaaactagaattaattaatagtataaagcttacaaacagtaatgaactagctgcactcaccaaattgttcaggggaaagaaaaatttccatggcagctccatagtaatcagtatagatgatggccacatcggggtgaagcttgcgcaagttttccaattcatctataagaagtttgttgtggtattgcgagaactcattcatccacctaagacaacctatctctggctcataatcttccttcttatcacgggtaccgagctcgaattcgccctatag

SEQ ID NO: 20488 - DNA, 6985 bp, Oryza sativa
  unsure (1)..(6985): unsure at all n locations
nnnnnnnnnnnnnnnnnnnnnnnnnnnnnnnnnnnnnnnnnnnnnatatactccaaactagcatggtggctcgcgcagattacgcggctagtaccattatattttctcttatataatagcatatatattttctcactatattattaaaatatattacaatgacaatataattttaaattttacaataactttacgaaactactcatgcgtaatatttatattgtattttatatacgtgttagttattaattatttttaatatcaaactttagttatttgtaaattatatatattcctatatggactctggacttgtcttttaatatatttttttaattctgaacttttattatttttaattgtatttctatgtggattctaaattcatctttcaaaattctttaatttttaatttcaaatttcagttacttctaaattgtattcctatattgactttaaactcttcttcccatgtttttcttaatttctaattttagttatttgtaaattgtatttttatacggactctacacactacttttcattttattatgtttattctaaattttagttagttttaaattcctatatggactctatactctacttctaatattccttatttttaattcctaatttctattttttttttcttaattgtatttctatatggactctatactctacttctaatattccttattttttaattccaagtttctattattttctaattgtatttccgtatggactctatactctacttctaatattccttatttttaattccaaatttcagttatttcctaattgtatttttatatggattctagtctactcttctaatattccttatttttttaattccgaatttcaactatttctaaattgtatttctatatggactctagtctcctcttctattattccttattttttaattccgaatttcagctatttctaaattgtatttctatataaattcatctttcagtattctttaattttaatttcaaatttcagttacttctaaattgtattcctatattaatttaaactcttcttcccatatttttcttaattttgaattttagttatttagaaattgtatttttatacggactctaaactctacttttaattttattatgtttattctgaattttagttagttttaaattcctatatggactctattctctacttctaacattccttattttttaattctgaattttttttcttaattgtatttctatatggactctatactctacttctaatattccttatttttaattccgaatttctattatttcctaattgtatttctatatgtactctatactctacttctaatattccttttttttattccgaatttcagttattttctaattgtatttctatatggactctagtctcctcttctaatattctttattttttaatttcgaatttcaactatttctaaattgtatttctaatatggactctgattttccatatggactctatactctacttctaatattccttatttttaattctgaatttctattatttcctaattgtatttctatatggactctatactctacttctaatattccttatttttaattcagaatttcagttattttctaattgtatttctatatgtactctagtctcctcttctaatattccttattttttaattccgaatttcaactatttctaaattgtatttctatatggactttgtttttttctttttctccgattaatgcgagaatttctaagccatgagagcgaacgtggaggctcctttttctaatcctttaataatataataggtagatagataatagatagatagatagatagatagatagatagatattgttaatgattgtggtatctctagacacgcacctttctagacaataaagccccaccaactaatagcaaactgctatgactagtgcttagaaaatgagaactgccacgatctcgttccaaacgtcattgtcgaagcctcaaaggttggtggtgcaaggcgaaagccgaaagccgaaagccgaaaggtgttggttgattcaaacataccgtccatgtcgccggcgcagagcatgtcgagcagatcgcggaaccaccccatctccatctcgaggtgcacgacaccgtcgtccgtgggcacccctctctcccggaagaagtccgggccgagcgccgtggcgccgcccaccgcgaagttggccccgctggcgaagtcctccgcggtctgccctccccagtacggccgcaggaacggcagccccattgcttcagctgcggcgcggcgtacccacacgcgcgcgcgcgaattacacgtctcatattagcaaacggatcgagcgatcaatcgatgcagacgaggcctgcaggatggatggatgatgaggcgtaccgatgaagtcgatgatgaggcggccgtcggagcaccggccggtggcgcggtggaagaaggtctcgccgtagggtggccacagctgcgaggtcgttgccggagaggaaagcgacgttgcccgtgtccgccagcgagtccccgaagctgaacacgcgcaggtagcacggcgccgccagcgcctgtgccgccgccgccgccgccgacagcacaactgccaccgccagcactaccgccggcggcgagaggaggcctgctcctcctccggaagtggaggagaccattcttcctacactttcgtttgcttctgctcgacgtcgggcccgaaggcgaagcggccactgggattggctctgcggtgttttttcgcgttggcccaaaaaaggcaaatactccaagaaacgtaagcgtggctcgttaatgttaagtgggctcgagtgacgaatgcccacaggtcagtagggcctctggtcgctgttagcctattacacatgagacggtgacaggtacgctccatcctccactaaatgcactgtgaaatgcgttagtataattcttaagcgatcataacaagtacacattgatccctatatatatcactcatcgctaaaataataattacccgtaaatgcaaatgctcatgtcaagtataggatttgaatcaaggggacttcgttctaccacgagaaagctaaccagttgagttgcgtttacaagtacgtttatttcgtaagtcgtaaggtaacacttttagatacacagattgttgtatatcattactttggaccaaaagatttgatacatccatatattgattttttttcggcgatgtatatttaaccaagcgtaagtgaaaatatttttccccgtcgttcgcattctgccatggtgaaacaacttatcgaacgataatgaggcttgcagcaacaaatcacaaaatggttcaggtgataagactcgaggagatagaaatgggaaaataagtgtagtccaacgacaatgacaatattttttttacttcctctataaaatatactcaaccttgtatgaaataggataatctagtacaattatccatatattcgttgtactagattattttattccttactagcttacgttttttgtgacggagggagtattaagtaaataatcgcttctcttaagagtgttaggtgcaaggagagtaggtagtgaattaatgatgttgcaacataattgacctgattgatatatactgggagttgtgctttttatattatctaatatttgaagtgttttcgntatttcgatttctttaaacaatatcccgcacatgtttgacactgacagtttttttatttaagctatatggcacttctgatgattgtggatacaaataagagtcatggaactcactaaaaattagataaagcgatcggattgcatgatctttatacaatatcgctcataagaaatgcctctacgagaagcgacatcacggccacatcagccacgcagccaaggtgaccaaagaatgtagttgtctccctgtaacccctaaccctttcactatacacagaagaaaaacaatggagctaaattataataatactacacataccctataagaaataataaatcttaaaaatttacgaagaatcaaacgatccacaaataaaaccttgtggtcgtgactaaaaacagagaaggaataacaagagccagccaatcacttgggcaacagccattctgtgtagaacagttctgcagttctgtaatgaggcaaaaataccacaatcgttacatcttttaatcacacgtattgtctatataataaaaaaaatatagttacagaattacaaatcgtagaggaccttgtattcaacagaagaactgagctcagtaatttgcgggcacgaattagtggtggtagcaaatgaaggttgtgtatatgaacctcgtagcagtccaattgcaatggccttgtatgcagcttctgatggatggaagccatcccatgacccaaacttttgtgggtcatcgcaaaccttgtattcaccatatccacatcttgcagttccagatacaccatacggtcctcctccaccacaacaagctgtcaaaggatctttgattcctgaaccgaggttagggaaatgttaaacaagctatactcagaagaaaaaaatgatctttttcttgataatatgcgctttcctccatattaaggcttctagacagtttttctagtgtaaccgactagttagttcagtcttaaactcggtacaagtgatgtcatgttaatttgtaatacacataatgtatctataccatggtaagaatgcaataatttgtaatacacataatatatctataccatgataagaatgcagatatctgaacagaggtctggcgtgggggtgcattacgtgacatgatgaaaataaacttctgaaccttacaaacatatgaaggatacagacagatttgcttcgtttgagaagcactaaggtaatcaaatttaagagaacacatatagagtatttttcttgtaacctaaaaactaaaattagtagtgttaagctttcgaaaagaaatcatagtagaaacagtaatgaattaactgaactcaccaaattgttcaggggaaaggaaaacttccatggcagctccatagtaatcagcatagatgatggccacatcaggatgaagcttgcgtaacttttccaattcatctataagaagtttgttgtggtattgcgagaactcgttcatccacctgaggcaacctgtctctggctcataatcttccttcttaccactcttgaatatcatgaggtaatttggaacacatccaatggggaggttaccaggaacaaccagcgtcttggctccaagcccaatcaattcctgcaaactcaacgctgttgcattacaagccatgtaattttgtattgcttcttgatacagggtctcaaggtacacagaaaagatgtaacataggcacgttactcacggtgattgtagaagaaattttggcaatgacactcggagtgaagctgcgaatctttgtaatggacaccccgctgagaagaggtaggttgtaatcattgcccccaatttctccgaccaggaaaagagattgattcatcatgcctgtgcaacctgtgcaataactagtgtttagaatcagtatgtaaatatgatattatagctgaaaatggaattttaagcatatcacaattgcttatttattatatcatagttaaacatttaaaggatcacaggaagcttactacttgtcatttctactaaaaaccagatttgtagcagcatgatcttccccttggcgtattaattgatttctgatttatgttgtatgccatcaattcaagggcaaagttcatatgtagcagtgacatggtgtccatttataaaatattttttataatttttaatttcaactaatgatgatgtattctttggaaaacaatgtgttatggattcgcggtgtgattttatatatatatatatatatatatatatatatatatatatatatatataaactgcagaaagttttaggactccttttacaatatttcctttttatagaaaatacagtatcagttatggacttaaggtgtttgacaatgacggttatggattttgaaatggaccatctgcctagcagcaatcaacaaaagctgtcaatcttcaagccacaaataaaccccactatttctggtaatgatgaattgcttttcttattttccttgtgctgttattttctttggatgcacatttttttgtgtctaaaccaagtaaccacaggtgacatataatatgtgaaaatgacattagtagtgtatcgtggaaaatacttcgatgcagttatattctttagaaaccatgtcaacgtcctaaagcacaagtaaaaactaaaaaggaatcaaggaatatatattgtataccattgcaccaattctgaaatggcatagaaggtactaggataagttccacaccataaggaaaatgctatagcatacttttcctttttttttttctcttcaactttctagccaactcccaccttccatgtcttctgagagccacaaaaggttgagacagtgccttagtacctgtcagtctgcgtgcttatactctactaatcagtttgtggcatgtttgggatttgcttctccaatctccatgtgtcacattcagaccattctatttatcaccagatgcgcatcatcatcaagacattaacccccaccaaactactagtctactgctacgatttcatatcgctagttgaaaatgtcatcgtcaaaggtgggtagagagagaggagggattatatcaacataccggccaggtcgccggggcagagcagtttcagcagatcacgaaaccacttcatctccatgtcgaggtgcacgatgtcagccatgggcaccccctcttgcccggaagaaagccgggctgagcgccgtggcgccgcccaccgcgaagttggccccgcatgcgaagtcccccgcggtccgcccgctcaagtacgggcgtacgaac

SEQ ID NO: 20489 - DNA, 3534 bp, Oryza sativa
gttcgatcggtcgaccaatcgatgcaggggaggagggggcttaaaatcgccgcgagcagagtaccgatgaaatcgacgacgaggcggccgtcggagaatcttccggtggcgcggtggaagaaggtctcgccgtagggcgggcggagcgccggctcgcgggagtcgttgccgtagatgaaggcgaagttgcccgtgtccgtcagcgagtccccaaagctgaacagccgcgggtagcacggctcctccgtcgccgcctctgccgccgacaggagcaccgccaccgccacaactaccgccgccggcggcggcgagaggaggagtcctcctcccttcctcccggaggtggaggaggaatccattcctctcctctgctcgagatgaacggagaaaaggagagaaagtcgtcgcggcgatgctttgcgttggtccaagtctaacgtggcttttataaacgctgcggtagtcactgacatgtggggtcgcggtgacagaggcccacgggtcagtggggccagtggtcgctctcacgtgtgacaagtgtgctttctaaccttcgagaatgatgagatgtgctcagttaagaggccctctttgaagtacacgtcgaatccattattttttgcacacaaacatatgttctttttagtattacttccgtcccaaaataaatgcattcgtggatatccgtgccccacgtttgaccgtccatcttatttgaaaaatttaaaaatatttagtcacacataaagtaatattcatgttttatcatctaatagcaataaaaatattaatcataaaaaaattttaaataagacgaatggtcaaacgttgaacgtgaatagtacaaaactatatttattttaggacgaaggaagtattaattaaggcaaaggttttggatactctacgtctacgtgacctggtgaaaccggtaaaacgcaacaaggacgtacgaaaattacgtattccgaatggtgaggcacttccgtatgatgaaaaccgtgtgtgagtgaaaatatgttttcgtcatctcgcttctcccatgggcaaacggcccaaagaacaataatacgaagctcagcacgcagaacggctcggaggggcaatccttataaaccaaaattaaaatcttacaactttaatctagcgttgtttctttgaatctttggttttctcatcgtagtttattttacaacattattttaaaaagttcaaaatttgaaatatactcctaacttttaagaataacaaacttagagcatgtcaatggattgtctatactacttctaatataaatattttgcaggttttttcaaaaaaattaacctcccacaatagccctaaacaagctgaaaacatcatccccatcaccataaatgtctctccataagtcgagggagggcctcaccccggatagccatcaccgaccgattcacacgcttaggagtcaaccgtgggagtacaagaaaataggtctagttttgtctgaagtttttttatgtagacacatttttattttgagaagttaaattgggctatctcttagagggaaaggatatttttatcccttaaattccattagagattaaaaaaagatttaaggagattgaattttggcaaaaatgttagtcatgctctttagcataataactcactaggttaaattacttgtaataaaacctattcacatgggttcaaaccgtacacttgacatcacacggatgcttgtatttaggtttattattctttatgtgacatggtgctcgtatttaggttatgatgactttgtcaatccacattcatatataatatgtggactgcttctaagtttaataaattcctggttctcaaaaaaaaatccacattcataatgtgacaaaagtgggggaacacatgttagaagaaacgacaagtatagttcaacgagaaatgtgtttttttatatgagtaatagtttgtcatatactcctatatatgtaagaaaagtataaaatgttgtaaagttgatgttgcaatgatttgacttaattgattgatataatttgctcgtgactgtactatttatccaacacttccaaaattttgaagtgttctaatctttttcatttcttaaaacaacattctcgtgcattctttgagaggatattatttatgggctatgccacttgtcaggattttgtggatacaaacaagagcagtcatactcacccaaaaaggagaaagcaaatttgcatgaccatggtttaattttttcaatctcatatatacacaagaaatatcggcttctcataaaatctctaaagcgttaccacgcagtgcggtgatatcatactaccaacgtctaaacgtgcactcaaatgtacacaaaaatatgaaaaagatttaaggcgtacggagctcaacgatatgtacactactcctaagtactaacacagcaggactagcaggatccttgccaagcaatgtgttcttggaggtagagagttcacgaaagtatatatatgcggtgttgaggcacaaggtaacaagttagcaagtactagcaacaactatggtgttattttgtgtactaatctcctctttgtcttactcgctccgtcccactaaataaaacacttaaatttatcagtctccaaaactaatttttcatatatattttttgtcaaaaaaatttactatgtttataagaataaaatcataatcatatgaaagtaaatttaaatatcaatctagtaatattatttttaacaaataaaattttatttataataaaatagttactgatcaaatatttaaaaagttgaatctttaaaatatgtgtgtgccttattcttcagtgggacgaagggagtattagttttggtcggcagatcgccaccatgagacggaaaaaaagatctgtaccaacaaaaaaatcaactcaaaattatgtatacacggtaaaaaaggacaaattcaaggaccaaacagtacacaaataatacgtcccatcattattggtagttacagaatgcactgtttttcatactcatatccccatgtataaaacattttttttgttatttttgcatataaattatcatgttgcacatcttgatttttttttctttacacattagacacacatgcacatatcatcacatacgcaagaccgcaagaccgcaattacacacccacaaatgcatccactgacacacttttgaaaagaaaaaagaaatagtaacttgttcctgatcttagtatattcttgtagagtgatgcatttttagtgtactttggtgtaccagacatccagcttctaaatttagtttcaggagtttattttgtgagagaggtttacctagctccgctctcagtttaattagatggagctgaaactgtttggctgagttccagcttacgagagatggaggtggagctgaagctatgccaaacaggctagtagtacataaagattctcttctccatcgcaccaaacattgtgaaagagaaaagagcaccattttgagattcgtttatgcactattactattt

SEQ ID NO: 20490 - DNA, 790 bp, Oryza sativa
  unsure (1)..(790): unsure at all n locations
tcacccaggggatttgacacttgcaagccacattgaattgttccccgacgggttgccgctcaccgagaatattccatcgctggaaatctcctatctaaatttgctttcaacttgagtagatgaacaattattccaagtgggaaccacgaatcgcatatactagtctccacatttgatggctggtgagtggtgtgacttgttaacagcaatagtctctcttttcactcgtcaaattcaaatgagtagtttgtatttccagaaattatagttttaaaactggctaaagcagaacattaggccagtgtcaacaaatgctaaggcaaaaggtgcataatccaatgtttgtccaatgtaacaactcaaaacttgacacaaatagttcctctcgtacaagttttgttctgtttggcattaggccgccggattcttattgtaaagctcaaatcctcggtatcccaacacaaggggtagaaaaaagcataaatcaaatcaagagaagcctcatctacaggtatgagttgctagtctgcaaaatggcctaactacgcatttgcaaatttgatacccttctcaattgaagccttgagctcgcccttaagattctccagtccttccttctcaaagtctgacagctggcccaacccaagaacttcctcaactccattcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccgagctcgaattcgccctatag

SEQ ID NO: 20491 - DNA, 5666 bp, Oryza sativa
tgtcgccgctttggccgcgaccgccgagcgctagccctctcctttgaccgccttaggtcggttcccaaaccgacattgcccccctataaacccaagcttccccctttcctttcctctcccattcgcctccacgccattgccgccgcctcccgtgctctgttcgccgtcgccgttcgtcgttgcgcgtgtcgaaggagccggcacgagcaaggacgcggaaggggacttcgggcgcgccctctccttcctcttccccggcccgagaccggagagattactcccgcgccgtcggcctctcgtcacagcgcccacccgcacggtagtgcatctctccgttcttcctcctcgccccatctcctccccccttagacttgggtagtagcacgagtagactccccgtagctagccggcgccgccccgaccggtgccgtcgctcgccgcgtgctcgccgccatcgccgctcgagctccgtagcacccgcacgtcgccagcctcgctcggcgtagctccgcccaatccgacgctagcatcggattcccatagccgcgtggatgctctcaccgccgggaatcggtccctcatgacctcgtcgacgtttccctcttccctccccgccggttgtcgccgccgcgattcgccgccgtcgaactccctctggcgaatccgagccgttggctcgtctcccctcatcacgaacaaccgcccggtgtgctagcttttgcccgtatcgccgtggttcgctccgccgctcgccgccgccgcccgccgtccattcgcggccgggtcgtcgtctacctcccgccggcccgcatggcagccacgtaggcgccacgtcggcgcccgctcagcctagaccgggtcgagccgaccccagccagtccctccccgtgcgcgcgttccaccgcgagccgtgaggctgcgcgtgggcccgccgcatccgcgtccaccgcgaaccgcgcgcgcacctcgtccctcccccgcccgcgcgcatgagccgcgtactccctccgcacggtgagccgagctgctgacaagcgggtcccacccgggaccgcgcatggtgagcccggtccaccggctctctctctcctccctccagcgcgcgcgcgtcttgggccgccttgggccaccttcttgggccggccggcccgttaagctcggccgagccgccctttctctcgggccgcgccctagccgcccgagggaagtctatattccctccctctccctttttcttttcttttcttttccaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcaccgtttgttgagttgtcccgttttgcgtgtagtttcggagtccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgctagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccgggaaacgtaccgggtgtacggtttcccgctctcgcacttaaagaccgattccttggaatttcatccaaacataagtcaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcatgtgggtaaagtgtaccccctctgcagaggttaacaaactgttcgaacagccgtgcccacggtcatgggcggatgtgaggtgattcctagcgtagtttagtttgactactgcttgtgaaattgctgtgtgaaaagggggttcggtgtttgaaaaatctgcagctgatgggatcagctaggcccggatggccgtttgaaaagttgttggcccgggtggccgtttgaaaagttgttggcccgggtggccgttgaaaaagctgttggccgggtgccaaccttgtttaaattctaaagactgatacattgcacatactccgaccagacgagacgcactgtctcatccgtgtcgtttgagaagcactcacttagttgtttcagaaaagagttcaaataaaattaattgcaaaaacaccagcctttccttgaagcctgcattaaacacttacttcccatggcttgctgagtactcccgtactcacccttgctctatataaataatcccccccagttgctgaagaagatgaagcgaatcctggtgatgaggagttcttccaagagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctatctccctgtgataccagcactgtttcctgggactggtatcgattaacaggttaatttggagcgtcacgggctagttccggtcgggactagtttggggcgtgacatggcgtggggcgcaaggcgacgtgacgggcgagcggcgacggcgcggcagcggggcagggttaggctaggggacctcgtcgaacacctggcggccgatgaatagtgccgttttccatttacccgatttaagcctatttatttatttaaaattgattctataaaccttaatttttgtaccaatgaagttcactcaatatttgtgttattccaaccaatgggtccacccttgattaattttacccatattttatttttatataatttccttgaatttaattagagttaattcttattccgacacttttcaatttaattgatacaaatatagtcgtaataatattttactcatttctatactcactaaatattattttaaattgtactttaattatttacttagtcaatttactttttagggtttattcctaactaattatccattattcgcgatttataaactctgaaatcaaaattcaataaaataatcgaacaaaattggcatgatgcaactttatttaaaaagtttttgaagatccgtatttttagagtttagattttgtcgtcgaatttttagggtgttacacgataccagcaaatgtcgatagggttttgagcaatcagctatatgtccaatgtagattctgacacttgagtaaataataatataaagataatcatgacacttgagtaaataatgatataaagataatcagctgatgataatgtaatagaacaataatataatccaatagaaaccaatcagtcaataatgatatgatagaataattgcttgatacgaaggttaaattcacaagattaaataatcaatgaaacctttgttgtaatcggctaaaaccaacttgtatgtaatccttgtaagccgatgcaacgtctaaataacttatcggctaaaaccccgatgaaacccttaatggcaatcaaaggcaggttagttttatgattataagcacagcttagtaggtcaaacccattgatgcaacactaaatatgaaaagaagcataaagtctaaacaatcaagcctttgtctgattttcagggtggtagataccttagctaatctagatcgatgaagcaatttaactgataccaacaaaaccctagaaatggtatggcctagacaacgactttgattaactgagatatatgataaatatgtattacaacgacaagattagagtgtcgagaccctagcctcgccgatacaaatagccataacaagccttacccctcatcggtgatcgaagctgaagcagcccaactcgaaacaagagctcgtcgagaaagatgaaaaataaaaagggtggcgatgcgccgaagttgtattgatcgagagataatttatagggaccttgggtgtacatatttatacctataggctgttaacagtcctgatcgaacactaaacacactttcctaaaaataaaaggaaaatgacaagtcctgatcaaacactaaacacactttcctaaagataaaagggaagttattaaatcttgcctaattaatagatagaattaaactgtcatgccatggtcttcactattcctccttgaacttggtttcttttgcataggttcccatcagctgatcgacttctttccttaactgaatccactaaagaatcttactaaattttggcgttaacaaatggccgcttcgtcctctcgccagccaatctacttgtagaagcagtatcaccgttggatctacttgggtggcggaattggcggctgatctgctggcggcccgacggccttcagcgacagcgaccccggcggccctcggcgatgaagaccacaacgacaacccgacggccctcagcgacgatgatcacgacgcgcagcgccgccgcttccccttcttccctccacatagctctgtgggccatgcggcagatgcttgcaggcaaggctctcgtagcaaaagtaagacatgagaagcaaactaaaactatgggccccacctactttttcttccacgacagctagtgttctacatggctagatgagtccacactccatgcaggagcactgtgaatggcctaacttgggtcatgcggactttagttttgtgggcccacccaaaaacgtggcaccaaatcgaatctctcctactcgtatacatggagggcgcgggccaaataacagcacaccgcgctgtgaattagagcaagtttaatagtatcgtccgttgatgggttgcaaatttgtatacgtcagtgatagatggtaccaacagatgttacatacctatgatttgtatgacgtggatgcttgtattgccagcttataggcctctattatacctgctcaagagtcaatagtgttggcccaaacactcacttgcacacacacctctctctttctcacttgatgaaagacacacacaaagaagatgcactgaagagacactagaaaatttttgtcactgcacaccagcgaaccaccacacatgcacttatatttcacccttggcaccccaatcaaatgctgatcacattggttaaatctatactaatataaaaaggagaagttagcagggtaccgagctcgaattcgcc

SEQ ID NO: 20492 - DNA, 236 bp, Oryza sativa
cggagggattgagcgaggcgctttgtttcttgctgcaccgctgcatgctcaggttcttccatcggaggagctcgacaaagggccattgcttgctcgctcaccgttggtgtccggtgttggtggagagagaacaaggggaggggcaatgaagtaagaaggtataaggggggggggggcggggcccaacgttgagggggccgacgcttagggggcgcatgtgcgaattaggagctcct

SEQ ID NO: 20493 - DNA, 682 bp, Oryza sativa
agctcggtaccctgttgcatctgatccttcctttgttaattgttataccatgttcccttgtaaccatctagttgcgcctcgatattcgtgcactctgtgcgagtaccgacggtcgccttcaaacttaaaatctgagtaacttcttgggtaaaacttgggttttacaaaagacttggaaaacccgacacctgggtcggtgcttgcgaactaaatgaatttccaaaaccgcggaccggggaatgtactgggtgtacggtttcccgctcttgtacctaaggaccgtttccttggaatttcatccgaacataagacaagtacgaccacatgggtggaatgggacacccctggctgagtaactagcttatcaggggagccttgatgccgagagacatgtggattcgtcggggtggtgtcggggaggacccctgggcttcctggcacagtatggtctgggacctaacctgttgtcggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgtagaggttaacaaactgttcgaacagccgtgcccacggtcatgggcggatgtgaggtgat

SEQ ID NO: 20494 - DNA, 5219 bp, Oryza sativa
  unsure (1)..(5219): unsure at all n locations
ttatcaggggagccttgatgccgagagacatgtggattccccggggtggtgtaggggaggacccctgggcttcctggcacagtatggtctgggacctaacctgttgttggtctgggacccctctagtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgtagaggttaacaaactgttcgaacagccgtgcccacggtcatgggcggatgtgaggtgattcctagcgtagttttgtttgactactgcttgtgaaattgctgttgtggaaaggggttcgatgtttgaaaaatctgcagctgatgggatcagcaggcccgggtggccgtttgaaagttgttggcccgggtggccgtttgaaagctattggccgggtgccaaccttgaatcaattcaaaaagactgatacattgcacatactccgaccggacgagacgcactgtctcatccgtgtcgtttgagaagcactcacttaattgtttacagaaaagagttcaaataaaatcacttgcaaaaaaaaacaacagcccttttctttgaagcctgcgttaaacacttatttcccatggcttgctgagtacttccgtactcacccttgctctatataaataatctccccagttgctgaagaagatgaagcggatcctgctgatgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtccgcagcccaacatggctgtacctctactctataataaagagacctctgttgctgtgataatctgtcttcctgtgataccagcactgtttcctgggactggtatcgattaacaggttaatttggagcgtcacgggctagttccgatcggtactagttcggggcgtgacacacgtgtacttcaaaattcaaagcgcgtgtttcttcgaaaaaaagaaaacttcaaagagtgtgtgtctcagggtttacgattccgacaggcccttccgtttcgggtactggcggaatttggaatttcgcgaaatccggtggaaaaccagtaaattccgaacaaatttcataaaccaaaatttgaatacaaaatccctaagttgccaacaagttctcgaaaaccggtcggttttagcgaaattccgatcgaaatcatcgaaattttgatcagtaatttgtaatagaggtaatttgctgaaattcttttttttcatgatgtaagttttagtagatacacacaatacatcatttttttgaaaatttatatcctaataagttctatggatatcataatatttgtaagattttattttattttttctttttttatcaatttaaatttaaatctgaataaaatttctcaaaatttactttcgagtctgatcggaacgtcgaaattttacgaaatccgaccggaatcatgagccctggtgtctctctcagcttgtccagatacttccccgcttgtccagtggaggatggagggtagctgtgcctgtgacaactgacaactgacaaccaacaaccacaggccccagtgccccactgctccttgtactcggccccagttgacagtgccgcagtgacaagccaaacagcgacgaaaaaacaactccccgagccgcttgaccgacgcttcgcctttatttgctgctccatctcgaattctggactggagcagagagaaagaatggcttcctctacctccgggagaagaagagagctgcggcggtggtgctggcggccgtggctgtgctgctctccgcgtcacaggcactggcggggccgtgctatccgcgcgtgttcagcttcggggactcgcttacagacaccggcaacatcgctttcctctacggcaacgactcccgcggcccacgctgtggccaccctacggcgagaccttcttccaccgcgccaccggccgcgcctccaacggccgcctcatcatcgacttcattggtacgctactcgcaaccaatccagcccctcctccctgtatttgcttgatccaacacaggagtactactaattacttgagatttggaaatcgcgcgcgttgcgctggccgcagctgacgcgctggggctgccattcgtgcggccgtactggagcgggcggaccgcgggggacttcgcccacggggccaacttcgcggtgggcggcgccacggcgctcagcccggatttctaccgggagagaggcgtgcacgtgcgcgacaccgtgcacctcgacatggagatgaactggttccgcgatctgctcggcctgctctgcccagacgatcttgccggtatatatgttcgtctattgaactctttctccttccacgcaccttgccacctctgacgatgacgctccaaagtaacagtttggtaggaggtgagggtagctagcagtcgcggtctcccgtatccaaatcttctgttgtactatagtggcatcgattctatacacggtagtaattccagtgaggctgtgagggtaaacggtgaccttacttactgtagcagctgttactgcagaagaagatcgcgatgttttgctttcgatccaacggttaatggaatgatggatgcctctaatgcaaacacactacactttgtaggttatccgcattttatcctccactgccgatgatccgtttccagcagccgccagtaggtgaggctttaatgccatgaaggtggtgggagagaccagagactatattttggacttttttttttgtttaggccttgtttagttcctaaattttttttctcaaaaacatcacatcaaatatttgtacacatacatggtgtattaaatatagataaaaataaaaaactaattgcacagtttgcatggaaatcacgagatgaatcttttaagactaattagtccatgattagccataagtgctatagtacccacatgtgctaatgacggattaattgggcttaataaatttgtctcgcggtttccaggcgagttatgaaattagttttttcatttgtgtccgaaaaccccttccgatatccgttcaaacgtccgatgtgacacccaaaaattttcttttcgcgaactaaagcaggtgttaggggttggatggtggtgatattgggcacacttccaagcttaagatttcgctcagaggtaagtttgagctaactactgctataagcccatataaaaataatgttgaagtaaatatatttgcagatattagttataaggttgtctatacttctcttcttctctctatctatccattgctaatgctgggtggatcttgctctatttatgcccatcgccaccggatcctgctgcacgtcactaattctatgcacctattactgactagatcccaccgtccatcaccaacactatggcaacacactctagctaggaagcagatagcggccagaggggtgtgcattctgatggtacgccgcctattgtccgctctagcccagtcgtgtggttgctggttgtgcgcctctcccatcacacctccatccgggaagcatagtaaaaaaaaaacccagaccggtgatcaacccagtgacctcgtcggttcactggttcaccggtcggaccgccgggtcagccggttcaggtgctgaaccggatgtatatagttactatatctttttattagacaagatgagctagctagtaaaatggtaaggctgacaagttctcaacccacatgtcatgggttcaagtcacttcccagtttcccacatatgttttattttgcataaaatgtaaatgggccatagagtaagatgatgggccttacaaggccagctgaactgacaatgaaccactagttcttactagcccggttcaccggttttcaccaaaacctgcccggttcacagggttcttaccggtcaaatgcatgagcggtctttctactagaccaaaccggtgagaggcatggttccggttttttatactaagccgagaagtgaatgccactatactggattggttattctattcgtaaaaataggaaagagataggttggcgaacgcatgggcaaaggaggcttgtgcaccccttacggctgcatgacacatttaaccactggctagtgcatcggtttgatagattgtgatgacttactgttaatggtacggtggtcttgggctcatgtgtgcttgagcaaacaaattcactaatccaaggcaagcgcggagcagccccatggcgtcatgtgtgtgtacgctgcggccaactagtcccaggcaagcaacacggcaaaaagcatataacattaaagataaagttgcatcaaaatatttttcatgataatatattgatacagtccctacatttctttacttgttagggtatttacattgtatcagcatgttgtatcactatctcttatcatacgaaacattaaatatatatatagttgcatcaaaatattttccatgaaaatataataatgtcattttaacatatcaaatcttaatatgtttatatatattagtgacttaagatttgatggtttgtactgcactcattctaggacataatctatttgagaatgaagagaatttcataaatcctaatagaacaattcatggcactagatcatccagtgagagttgtggttaaaccatcatctactattagttcaaaagttcggcatcagtgccgtggatggtagaaacattgtacctcactttttttagtttaccttccttaactttccatgttcattttctgtttaagaagtgggaatattggattgtctggaataaagtcggaaagataaactcttatgtgttgtggttacttagtcaaatgtggttacttagtttatggcacaacaataaattgtgcttccaaagaggagaactgcaccaacaaaaatatggaaagcaattcatcattaccaagaaatagtggaatttatttatggattgaagattggtggcttctggttgtactaaggaatactgtccattccaacatccggggggatattcgatgagaacccgtgagaaaactggatgtnnnnnnnnnnnnnnnnnnnnnnnnnnnnnnnnnnnnnnnnnn

SEQ ID NO: 20495 - DNA, 1692 bp, Oryza sativa
gaacgtttaactaccatataaagcatcaattttgatacttaaaggcccttttcaacaatactacatatttacatgctaattctaaccatgtttatatcacagattgcaacgacatgatgaatcaatctctgttcttagtcggagaaattggtggcaacgattacaaccatcctcttatctgtggggtatccattagaaagattcgcagcttcactccgagtgtcattgccgaaatttcttccacaatcactgtaagtaatatgcctatggacatacatacatacatatatataaggtgcctgggcctcaaggtttgaaatacactaattggctcaattttgttgaatgttttcaacttatggtttttatatacctagatgcaagaatttgattcatacccattactagcaataacacaactcaattcaaggatgggagacaacctttttttttacatgggaaaaaaacatcttgttatttatactttattgatgtcttattctatattttatggaattcctcttttgtagctgtgacacaacttcttatttactccctccatcccaaaaaaagccaacctaggaggggttgtgacccctcgtagtacaaggagtctagacaaccctctgttcagattctttgtactaggaggggttggttttttccgggacggagggagtatgtgtgagaactataaatgtcttgatcatatttgttgtaatatttgtaaatggatcagaatggtccaaagataagactttttggattgttagagatggactcacttcactcgtttgtataactagtcctttttcaccataacaagctaatgtatcacaacacggaacaagtgtatatggctataatgcaatagagttgagtttgtaggaattgatcaggcttggagccaagacgttagttgttcctggtaatctcccaattggatgaattccatactatctcatgatattcaagagtggtaagaaggaagattatgagccagagacaggttgcctcaggtggatgaacgggttctcgcaataccacaacaaactatccccggatgaactggaaaatttacggaagcttcatcctgatgtggccatcatctatgccgattactatggagctgctatgggaatcttcttttcccctgaacaatttggtgagttctgttaattcattactgtatctacactggtggagaagtgctttttggtcccggtttataacccccctttagtcccggttgtccaaccgggactacgaatccgggactaaagatcactatctttagtcccgggtgaaataaccgggactaaagatcgatccttagtctcggttggtaacaccaaccgggactaaagagggaataacagcagtacaggtggtcctctttccttttttttttcttttttattttctctcaaatcaagtgggatgcatatccccaaatcccaaatcaaagtaacatcccaaatctacatcacaaatctttaagttacttatacacataaatcaaatacatcgcaaatcctaaaaaaaattacacaaatcaaattacatcacaagttctacaaaattcatcgcaaatacatcacaagttcacatcgcacataaatcaaatacatcacagaatcatgcaataaatcacaaattctaaaaaaaaaagggtaccgagctcgaattcgc

SEQ ID NO: 20496 - DNA, 867 bp, Oryza sativa
cttcagagttaagcgtgcttggcctggagcaatttgggatgggtgaccgaccgggaagaattcccgggtgcacacgagtgaggacaaagtgtgcagaaataacatgtgttggtctgtgagggcagtctatgacctatgaaagctgccagatgtaagtgggcccggcctgggggaggcgggacgttacaccatcgctgccgccctgtcaccacccgtcccgtcgcgcgcgcgtcccatcgcccgccgctgcgccgcgcaccgtcgccgtcgcgccgcgcgcgtcccgtcgccacgcgcgtcttatcgccgcctcgcgccccgcgctgccgcgccgccgtcgcctcaccccccttcaccggcccctctctctcctctctcacaccctataaaacccccagcccttctcttctcccccacacccattcccctccatcacctccctttttaccccgccgtagtgccgccgcaccgccgccttcgtgctgccgcgccgccattcccgtgccgccgcgccgccgttcccgtgcccccgcaccgccgttctcgtgcgccgtgccgccactcccgcgccgccgtgcgccaccatcgctgccgccgtcgtcgccgctgccgccgccggtgagccgccctccgttcccctcgcgtccaccgccgccaccgctcgggtgggagagagagccgagagagagagggagaggaaaagagaggccggcagagagagagaaaaagaaagagaggaaaataaaaagaaaaaaaaagaaaagaaaaagaaagggagaaaaagaaaaaggaaataaataggaaattagagggagattagggaagtttagaaaatttaaaataattggaattttataggttaattat

SEQ ID NO: 20497 - DNA, 1790 bp, Oryza sativa
  unsure (1)..(1790): unsure at all n locations
nnnnnnnnnnnnnnnnnnnnnnnnnnnnnnnnnnnnnnnnnnnnnnnnnnnnnnnatttaattatagtcatagaattgcaaaatttaatataaattatggattattcttggcaatttctataagaaatcaattcgcggtaataatttagatgtagttaataactaaacaaatagatgaattcttatggattattatagattatttttttgggtaatccctataagtaatcaattcacggtagaaattcggatttaattcctagggattttagccgtgtattatatttaatcatctagtcatagactaaattaaatcatataatatttctaggatttcgtccgatatttagctcgcgatagaaatctctaacctattatatggatataatgctcgggtagattaaattaaaaacttatgacaacaaaacatttatacccgcaaaatagtttgaatcgaaattgggtttgccttagttcgcgaataataaagttaaaataaaggaatcgactttcgcattcgactttcatttggatttatttggattttgtttgaattctaatcgaattcaaattgttctttcgcacataattatagagaccgagggagccacggatccgggtgaaggccaagacccgcaagaccttgagcaaggcaagtcatcactattccttgaacatgttgatcccaattgcgaaattgttttgtttacaaataaaattgcatgcaattatgaacatcctacttgtaattatgccatgccttgattattgtttactccttattccttcggaaccatgtttacgtatgagtctctagtcaattatgacaattgcttagaaatgctattctagaatcatgcatactcatatttatcaaatgctatatgcttgggcaattacctttgggaaggtagttgagatgcggcatgtggagacatgagcgccacattgccatgatattgatgacatgatttgtgaaaggaaaataaagttaaacaactgttttcgactggggcggctggaggatttgggtggtgtccggaaaaggctagtgccatccctggtcaattaaggaccgagccatgaagttaagcatgaaacgaccccccgtacaaccgcacttctcgtatgggtatagacctagcggagtagatagctgagcggaggcagtatccatgcgtagtggtcttcttttaggtgtgtgatgtggcaagcagtctgctggcggatgcccggttcggatgaccaggtgaatggcggatgcccgttccggatggtcagaggctggcttggcaatactacatgaggatacccataagagaacaatcatgatggactgggttcaacgacaagaagcaacgtaggagtgtgtgtttttcccttcccgggagcgccagaactcctctcactgctagaaacgtatgacgcctagagtgcatgaggatgtaaagttcatggagcgggtactgccaatgcaaggttatcgaaaagctttgccgtgacgcgtctcatgtgttgggatgaggctcatgtgttgggcagtcgcggagtgcgggtaaagtgtacatccactgcagtgtgagtaaactaaatctattcgaatagccgtgctcgcggttaatgagcaccgggacatgtattacacttggctagactctaaattctttaacttgagtgggatggaatattgcatgataatttttatgctgatggagccacttcctgagaggcggaaacgtggacgtcctcagaaaatcataacgactcaatgacgggaagctatccttggg

SEQ ID NO: 20498 - DNA, 5290 bp, Oryza sativa
gcacatctgtggctctcgccatcattgtgaactgaggtaagttgcgttaaaccctaaccctagcaatgtcacctcaccctctctgcggagatagtagcccatggccaagtcctttcgtacatgaagccactaaggagctgcatcattggcactcttgtcggcgaagtccgcagtcacacggagagcacgagaggaggataggaaggggatgagtctcgggaggagggatggaggcgaggaatcgcggagagatgggggtgacgagtcgtgggatagaggcgagaaaatcctaagcaaagggtaggactgccatttcactccacctgcagtattgggctacgaggccacgacgtgggctgagtagcatccatgtggttctccagattttatggatccagtttgaggccacattgcactgtggatcatgtgtcctttgaagttcctcagcctatttggtagccctagaaatagcaaattcaaggatgtattgctaatccctaaaacctctcctttcacgcaccttgccacctttgatcatgacgctatgaagtaacagtttgtaggaggtgagggtagctagcagtcgcagtctcccggatccaaatttctgttgtacagcggcatcgattctacacggtagtaattccagtgagagcaagtttaatagtaggctatgaaccaactataaacttacttggatgagagagaattttaaaaatgaagaggtttgactcacatgaaagagctagctattcacatacttcacaattgatacattaaatgcacaggtgagagccaaagaataaaaccaaatagagataaccttatagctcatctgctatacatgttaactctaatatgagctataagcttatagttggctctactattaaacttgcactgaggctgtgagagtaaacagtgaccttactgtagcggttgttactgcataagacgatcccagggttttgattttgattcaacagttaatgcaaacacactacacactgtagcttatctgcattctgtcctcgagagtggattttaaactctcgaggggacatcccctcgttgtttgtatgtcacttatatagtcatgaaaaaaattgagaagatgtattaacatgtgatatatcactccacaaacatacaagttaaaattcaacttctacatatcacaacaaaaatacaaatttgactatgaatatacgttagctagctgtagtttatttttttggttgcgagatgtagaagttgattgaacttgtatgtttgtggagtgatatatcacatattaatacatctttttaatgtttttcataaccatttaagtgacatacaaataacgaggggacatcccctcgggagtttagaatagtttcccttttatcctccactgccgacgatccgtttccagcagccgccaataggtgaggttttaatgccatgaaggtgggagagaccacagactattttggccttttgtttggtttaggggttggatggtgatgatattgggcacacttccaaatttaagatttcgctcagaggagtttgagctaactactactagctataaacccatataataataatgttgaagttaacatgtttacatagattagttataaggttgtctccacttctcttctctctctctctccctctttctctcatttatatatttaatgcatttatgcgtgttttgtttgagttggttttcggatctagtttagagaagaggacttacctaagcacctacccgagggtagtttagactggagcgagattgtccaggccataaagtagagataaaaggattaccataggctcattcatcgaaaattatatatacaggaaaacaaaaacgaatttctacttgaagcatgtgtaaagctatttcttgcattagagctaatccttattatttttctttgtctctttcctctatatatatgcttatagctgactatagtctcctattaaatttgctcttagtaactttcttcatcagtatattatcttaaaatgctttttctaaacgtttttttaactttgtaaacatttaactcatttgtatgtgtccttgaataatggtgataaattttaaataaatgtcataaacactaaattgtccatcaaatttataacatttaacttcatatgggcaattgagcacttattcaattctatctatccatggcccatgctgggtggatcttgctttcagcatcagtacgcacgtctttagcatggagcccatgctggcctgtggtaagtacgattatatcttccagggattcccgagaaccggtccttaattgtcatgggcacgacttccaaaatcatgcatgtatccacaacccaccattaaagcatattttagtttaattaaaccataaccatggtggtacatcataatataattaaggactaaattataatgaatcccattgtgagctaattgatctaagcatggctaagcatccctaaaccaatcatccagtcaattataacccaagttatcaatggcataaggtattcaacaggctgagcatgataggcatccatcccacatgacattctaaaacaatgcaatttaatggaaagcaggggattttataaaacaagttcaacatgattaatgttgtatgtatgacttgccttgctcttgagctgacggaacctcgcaaccactacgaaataaactggatcaccagaactgatggaatctaaatgacaaacaaagcacacaagaaatacaagcactaaggctactgaaacagcaaaagaaaccaattttagtggattctatacattttaacaaattcactgcaacttgaataggttaaaacggagctcggattatttagttatgaattttacaatatgagctacgttattactaataaccgaaaaaacttaatcatttgttacatattattgcccgtatataaaatagatcaatggaaatatatctccggtaagcaagcctcacgaattaacaactgaacgagccaatacttcgtgacacgggaccatccaaacggtcaaccgatccggcgaacggaaccggcggcaagtggctgcggctcgcggcagcagcgcagcagcggcggcagtagccggcaagcggtagcggcggggacggctagggcggcggcgctggtggcggctagggcttaggaaaataaaattgaataggagaataggggggtgttacaacttatataggggagtgaaaatagagagaggtggggccggctaggaggcggcaacagggggagaggggggaaaccgactcgggcaaggggaggggcgcgcgtggccgagagggagaggaggggcacggccgagagggagagggggaggaaaaataggaatatgattaggacaatgactttcccaaataggaaaagaaatccggtgccgttttaggaaaagaacggaaacagaaccgcgaacggattcggactcggctcgttatgcaaaactaaaccgtggacgaagaggggagtgaatcaggcacaattcatgaccaaatgcgggagagaaaatttattattaattcaaatcctgtcaattgaaattaacaacattaattccagtgctctgaatattccgctttaaatcctgttaatgattttagagcaaagagaattcgaaaaaaattctgcctgacattttcgattattgaatacattgttaattaagattttctcctggttagccaaagtaatttctatagacaatttattggtgaattagaaactacggaaaagggaaaacgctaggtgtgacatctaggcacctatcattgactagatcccactgcccgtcaccaacactgtggaagaacactctagctaggaagcagatgttagctttggcccaagaaaatcacaaactcacgtaagcaacaaactcacgggagaacacacacgagcagcaaattgggtggacacacacacaacagattccgtcggcgacacacgcctttgctgacttctctgatattgctgatctactaaaactaactgatgattacacggcttatataacctcccgtacatgcacatagctaacagcccggccgggtcgcacgcacgactacaagccactcactcatacaacgatctgcgcatcttacgccaagattcgctcctccgagctgaccgcgagccacgccacaacgtgctccactaatcctgcatgctcctaactaacttgccgctaatcttgttattcacctaacctgtttagttgctagttgtgctgcaacacacgcagctgccactcactagcactgactgattctacatgcaaatatggactaaccactacctacgtgatgcacacatacacatcacttacaagatacatgaacatatcacgttcctctctacatgcaactaatgcaaaacccaaagacatatgcaagtcatgattagttccaacagcagatagcagccagaggggtgcgcattctggctgcataccacccattgttctagatccgtcgtgtggttgccggctgtgcgcggtacgcctctcccatcacaactccatctgggaaatgaatgccagatgggagaggctggcgaacggaataggggcagaggaggcttgtgcagcccctacggctgcatgacacatttaacccttggctagcgcaacggtgcatcgctcgatagattgtgatgcgtcatgggtgtgtacgttgtggccacctagtccaaggcaagcaacgcgacagaaagcatacaaaacattaaataaatagtcgcatcaaaatattttccatgataatatattgatatactccatccatttctttacttgttagggtattgacatggtatcagcatgttgtatcactatctctgatcatatgaaacattaaatatatagttgcatcaaaatattttccatgacaatataataatgtcattttcacatatcaaattttaatatgtttatatatattaatgagctaagatttgtaggtttgactacacgcattctatcctaatagaacaattcatggcactaggtcattcagtgagggttgtgtggatatggatagtagcaacattctatctcacttttttagtttaccttccttaactttccatgttcattgtctgtttgagaaatgggaatattggattgtctagaataaagtcggagatctaaactcttatgaattgtggttacttagtttatggcacaacaataaattgtgcttccaaagaggagaactgcaccaacaaaaatatggaaagcaatt

SEQ ID NO: 20499 - DNA, 3056 bp, Oryza sativa
actatagggcgaattcgagctcggtacccttatgaattgtggttacttagtttatggcacaacaataaattgtgcttccaaagaggagaactgcaccaacaaaaatatggaaagcaatttatcattaccaagaaatagtggaatttatttatgaattgatgattggtggcttctgattgcactaaggaagactgtccatttcaacatccagggggaatattcgaagataacccgtgaaaactggacataagcattttttaatagagataagtataagcatgaaatacattcccaccaaatctactgtttaatgtaaaatttgtcttttggttcccccacatgaagttgagtttggacatgaatatatttcatgtttatacatatctctagtatttttttcattaatttagaaaacttataggttcggttttcacgggttttcatttatttgatggttttcattggatatcccccccccccccaaaatcccccacacccaaacatccataccatgatatatcaattaatcatcatgatacacgataactgatagtgtattttgttaaaattaaattcaataaagaaacattttcagacattttgcttatctcttcattttgcactacaaatccgaatgcattagtttataaatagacatactcatgggatgaaatcagaaattattaaaattatttgataagcacacatcatgccactgctaaatatttggtcagcatgatgtgattgtcatgcgagaaatggttacactcctcgaaggcctacaaaaaaaatctgaaaacaattaatatgcgagtggaaagattatgttgctacaaatctggtttgtaatatgcttaaaaaatgaatatgcagatattgatgaatgtttaactaccatataaagcatcaattttgatacttaaaggcccttttcaacaatactacatatttacatgctaattctaaccatgtttatttcacagattgcaacgacatgatgaatcaatctctcttcttagtcggagaaattggtggcaatgattacaaccatcctcttatgggcggggtatccattagaaagattcgcagcttcactccgagtatcattgccaaaatttcttccacaatcactgtgagtaatatgcctatggacatacatacatatatataaggtgtctgggcttcaaggtttgaaatacacgaattggctccaatttttgaaaattttcaacttcttgtttttatatacctagatgcaagaatttgattcaacccataattagcagtaaaacaactcaaattcatggatgggagagaacctttttaattttgacatggggaaaacatcttgttagtctataatttattgatgtcttattctatattttatggaattcgttctttgtagctgtgacacatcttcttatttatgtgagagctataaatgtcttgatcatatttgctgtaatatttgtaaatggctcagaatggtctaaagataagaatttttggattgttagagatggactcacttcactcgtttgtataactagtcctttttcaccatcacaagctcatgtatcacaacatggaacaagtgtatatggctagtaatccaatagagttgagtttgtaggaattgatcgggctcggagccaagacgttagttgttcctggtaatctcccaattggatgtattccacattatctcatgatattcaagagtggtaagaaggaagattatgagccagagacaggttgcctcaggtggatgaactagttctcgcaataccacaacagacttcttatggatgaactagaaaatttacggaagcttcatcctgatgtggccatcatctatgccgattactatgaagctgctatggaaatcttcctttcccctgaacaatttggtgattttcgttaattcattactgtatctactctgatttcttttgtaaagcttaacatattaattttagtttttagtttacaagaaaaatactctatatgtgtgttctcttaaatttgatttccttatgttgacaatgaatcgcttgatgacaaacactctatatttgttcttgcttcaactatttgtagtagacaacaaagtatctagaggagaggagctgaaaagcaatatataggcatctaaatttgatttccttagcacttctcaaaccaaagcaaatctttatctatatatgcctgtatcttagtcacagcagctaaataggatttctgctccacaaatttattaccaagttggctagtttatttttcagcacctcatggcatgcgctcctatgctaatttttgcattgacaaatcacagttttttattctcgttgatagcttgaataaaaattctctgattgtgtttcagaaattgagaatcctttggtagcttcctgtggtggaggaggaccttatggtgtatctgaaactgcaagatgtggaaatggtgaatacaaggtgtgcgatgacccacaactgtatgggtcatgggatggctttcatccatcagaagcagtctataaggccattgcaactggcctgatatggggttcatacacacaacctccaatcgctaccaccaccatttcgtgcttgcaaattacagagctcagttcttctgttgaatacaaggtcctctatgatttgtaattgtgtgactatattttgttattttcatagaatgtatgtgcggataaaaggttcatgtggaatcgtcgaaataagctggtattgtgctgaaatcgagttaaacttatgccatcgggtcttctaacggattagttctatgacttccatctcaagtgtgccacctcccacctccatgaatcaaagcacttaattttttttctattttccttcataagttgtgttttgtttagttaaattttttccatgtactgttcatcttgtctttagttcttgatggcttagtcaaagactaatcatttatatatctcagtagttcatttgtttgattatctaggttgatataatctaaatatattcgaccatgtatccattatgtatttaacaat

SEQ ID NO: 20500 - DNA, 640 bp, Oryza sativa
  unsure (1)..(640): unsure at all n locations
nnnnnnnnnnnnnnnnnnnnnnnnnnnnnnnnnnnnnnnnnnnnnnnnnnnnnnnncgccgagttccacaaccgggttctcaccgcgcggctcgacgacctccgccggctgcacccggacgtcaccatcgtgtacgccgactggtacggcgccatgacgagcatcttccaggccccaggaaaactaggtgagtgcgtacgtacgcgtcagctctctctctctctctctctccttattttggcattgtgtcgtgtcttgtcttgtgtgctgcaacggcgacgttgcacccgtcggcgttcctcctctctgttggtttgtgtggtgatatatgcatacacgtgacaaacgagcgaggcgagtactgcacaaagcttagcagttatgtatggcccgataagcagcatccaccgctgccatgcaggggccctcctaattcatacttgcgctaaggttcacgtacgaacagaggggtagagccgtagaggtcaagcgaacatggaattcagcggtgtccggttcggacgcgtctggctcatacgcaattatgcatccaaattccaaggtaagctgtaggcacttgggctgaaacacttatttcggtccctattgggctgggaagattttaataggaataagtcca

SEQ ID NO: 20501 - DNA, 430 bp, Oryza sativa
  unsure (1)..(430): unsure at all n locations
nnnnnnnnnnnnnnnnnnnnnnnnnnnnnnnnnnnnnnnnnnnnnnnnnnnnnaaattgataaaaaaagaaaaaataaaataaaatcttacaaatattatgatatccatagaacttattaggatataaattttcaaaaaaatgatgtattgtgtgtatctactaaaacttacatcatgaaaaaaaagaatttcagcaaattacctctattacaaattactgatcaaaatttcgatgatttcgatcggaatttcgctaaaaccgaccggttttcgagaacttgttggcaacttagggattttgtattcaaattttggtttatgaaatttgttcggaatttactggttttccaccggatttcgcgaaattccaaattccgccagtacccgaaacggaagggcctgtcggaatcgtaaaccctgggtaccgag

SEQ ID NO: 20502 - DNA, 235 bp, Oryza sativa
ttcctttacatattttaatcacatattgtgtttaataatacaaaaatatattttcagaatttacaagtcgtacatggcgttgtgttcaacagaggaaccaaggccaattatctgcggacaagaattagtgatgctaacaattggaggttgagtgtatgaaccctgtagcaggccaattgcaatgcccttgtatgcagcttctgatggatggaagccatcccacgatgcatatttt

SEQ ID NO: 20503 - DNA, 641 bp, Oryza sativa
  unsure (1)..(641): unsure at all n locations
nnnnnnnnnnnnnnnnnnnnnnnnnnnnnnntgtgtttagtgtttgatcaggacttgtcattttccttttatttttaggaaagtgtgtttagtgttcgatcaggactgttaacagcctataggtataaatatgtacacccaaggtccctataaattatctctcgatcaatacaacttcggcgcatcgccaccctttttatttttcatctttctcgacgagctcttgtttcgagttgggctgcttcagcttcgatcaccgatgaggggtaaggcttgttatggctatttgtatcggcgaggctagggtctcgacactctaatcttgtcgttgtaatacatatttatcatatatctcagttaatcaaagtcgttgtctaggccataccatttctagggttttgttggtatcagttaaattgcttcatcgatctagattagctaaggtatctaccaccctgaaaatcacacaaaggcttgatttgttagactttatgcttcttttcatatttagtgttgcatcaatgggtttgacctactaagctgtgcttataatcataaactaacctgcctttgattgccattaaggtttcatcggggttttagccgataaggttatttagacgttgcatcggcttacaagg

SEQ ID NO: 20504 - DNA, 1077 bp, Oryza sativa
  unsure (1)..(1077): unsure at all n locations
nnnnnnnnnnnnnnnnnnnnnnnnnnnnnnnnnnnnnnnnnnnnnnnnnnnnnnnnnncttgatttaaccattagtatatcaacgaaaaagccaatatttattgtcttatcttctgaagcaaacgttgtcaatttttgtccaagttataccttagtatatttaagtatctaaagtagagtatagtagatcgatagttacgcttgaaggataggagttgtttcatttgaagtgaaggaaagaaaaggatgtataccagatagcttatgctatggatcagggtattgcttatttgcttatacttcactgaaataacatagtacacgtgcaaatgttgtagaatcgctgtgcttgttatttatatgccctgctgttgcacatagttgtatggtaaatgttggtgcaacataaaactaatgaaaagcaataaaactgatttaagaagcaacacttgatataatctttcctgtttccctattatccattgtagagaaccaacgtaaggactccttttttcaccaatcggccatcatgtatctctgttccaccttactgcactaatgaagcatcatgatggtttcaagtgggagattattccgttatgattctcccaaagcttaatccacataaagacaatcatcgcacaacactagtgcattgcaagggaaggaagcttggattactgggtctatgatattaatgattactagatgttaaatagcattgtctgtgcatggaaaggaattttgatcgatcaaactaacatatttgtatcaggtcttgaatgagatcaaacggctccaggatatgtacgagcatgaggagactagcatcaccataacaggccacagccttggggctgcacttgccaccatcaatgccactgacattgtctccaatggttacaacaagagctggccagtgtctgccttcgtcttcggtagcccaagagtgggcaaccctgattttcagaaagcgttcgacagtgctccaaatttgagattgctccgcattccaaactttcctgagggggttcaaactggccaaaactaggatacagcgatgctggcacagagctg

SEQ ID NO: 20505 - DNA, 6258 bp, Oryza sativa
  unsure (1)..(6258): unsure at all n locations
tcttggtgggtggtgcagaacaaaggtatggtgaaaggcacggatggtcggtggcatttggccgaccatgaggatgatgactgatgcacccaggcatctcctcttgatgcctgattcaaccgacagctcaaaactaagactctgaaaacaggggatactttcatgtgttcgttattgctcgacaatgaagtaatgcatatgtttggaatcattttgtttttaacatttttcagttcattgtgttttacttaatgttatctgtaataagttatcaaaattgcccgctgaaaaatgaattatcagaattgttaagttgtgacgtttctgacaagcaaagcaagtgaaggcagtcttggtatatcattgtgaagatgtagttggaaaatagcacctgaggttggatagaatcagatgcactgagtaatttgctttaaaatgtgttgactccataattgtgcttgatgatcttctcgaacatttcagggggaaggaaccagatttgagttattcgtctacgagtactttatgttcaaatcattgtagaagcacatctctcctgcagttcttaaatctaacgaatcttaagaggctactaaatacactttccatatgcaacttatatttaaatggttctttttcatattagcgcagaaaagggcacatccatctcttaaaatagatgaaaagcatgccaaaaaattaatcgcaaattatgagccaccaaacccactgactcaatgacccaataaagtgcccggtccagttggcaccgtcccaatcactccctttctccatatctgagatctcattctcatcctggcagtcgggaactcgggatcgatggtcaatggatcaccggcgatctacacctctcctcgccagcggctgccgccggttcgttcactttgacgggccaccaccaagtcgcctcctcagattgtaggcggcgccaaggaaggttccaaatcaaaggtgataacctttttcttgtttcttcctgtgttgggtaattcggtttaggtacaataatctgccatttttttatttgttatttacaagactagtatgcttcatctgcatgatatatccaaaaccagtgcttttaatcatatttatttgtaaattaaaaaaggcaaggaaaatgaatcgcatgaaacaaaagaataattgccataggtaacctaccagaaataatatcatccccctctgaaaaatgtaagcattatcttgcataatgctcctagttttagccttatctgaagaataatggaccatgaatacatgttaaatcgattccagctgccagcataatcacatttatattctgccaacttttttcaggccaatatacgcataagcctaaaaaaacagttgtacacaaacattttttctctaggtcccacgaaaaatttcatagatgtttcagagcaactgatacaaatatctagcatcttggggaactacctccattccaaaatataatcatttctatgttttttttctaaatgtgcgtattgaaaaatgcataaaaatgattactatatttgagaatgcaccatgtcaacttaactttgtcggaacaaaattctaacagtttgacaggatagcaccaagagcagagctctcagatcgatcagaaaggtaccctggcgacgatgttctcctgcgacatggcgagccggtggagggagctgcacggcagcggccactgggacggcctgctcgacccgctggacgtcgacctccgccgctgcctcatcacctacggcgagatgatcatggccacgtacgaggcgttcatcggcgagcaccgttccccgaacgccggcatgtgcaggtaccgccacgccgacctgttccggcgcgtcgacgtgtcccatccgggctggtacgcggccacccggtacatctacgccacagccaacgccgacgtgcacggcaaggtgctgctccgtccgctgtgccgggagggacgcgccacggagtgcaactggatggggtacgtcgccgtggccacggacgagggcgccgccgcgctcgggcggcgcgacatcgtggtggcgtggcgcggcacgcagcgcgcgctggagtgggtggccgacctcaagctcgcgcccgcatcggcggccgggatcctcggcccggagggcgccgacgggaccgacccgtcggtgcaccgcggctacctgtcgctgtacacctcgaaggaccaatgctcggagctgaacaagcagagcgccaggatgcaggtgtgcgcgccccgccctgctccctccttgacactcttgtggttgtacggtaccagtactacttcctccgtttcacgatgtaagtcattttatcattttgcatattcataataatgttaatgattctagataaatatatatgtctcgattcattgacatcaatatgaatgtgggaaatactaaaatgacttacattgtgaaacggagggagtagtattttgcatgtagttgacttagtagaactataatcttcgacagttgacagttttccctagtaaattatgttggcatatctgattagtacacagccaccttacgtgaagacaattagtatatgctggtagaaatatcatccaaactaaattcatttagtactggttgacactcggagtgctgccatattttccacggacgtggaagggtgcagagcccatcatcactcttagatgtacttttaaggcactcacaccaaaataacgttacatgtatactccatccgttcaaaaaaaaaacctaaatttattaatgatagaatatcacctgatacaacgaatttgggttgtattagataatatctcatctaagttaggtttctttttacttaaggagtagacactaataggaaagtgagaaaagaaaacggtcctttcgctgcttttcatgttcattccatcctactccctccgtcctataatataagagattttgggtggatgtgatacatcctagtagaatctggacagaccgtgacacatccacccatcacagtttacaactttaggttacatatttaggtttctttgtttcagaaaaggttaatttgagtcaggccctcgtttgaagcaagcagagtttttttttttttttttttttttgaactccagagtccagaaggttttcattcatgtttaggtcatagagtggattgccgttaaacatcatttttcgaaattaagagaagagaaagattgcaacacatcttcataacccttgtcacaaggcaaatacagtgtcagttaaggagggcacatgtattgaaaaggagattagtgaagggacagactgaagttgaaaggtggtgctggcttgctgcaacgtggaagtggaaggccagcgacaggtgtcgagagaggctgcactgcagtcagagttgttggaagaaaagaacgttcatttacattgatggtttcttgaacagctgggcgagtttcttttgacatcacatggaccatcattttgtcattttaaacgattttttcattgctaaatccaacttagaataaaaagttgggatttgatcctatgcgacaaactttgaaaaaagtaagttaccgtgcgagtaggcacttacaaaattcgggtttgcttccccagcaggatatactctatgccaaaaaaatatatatatttttcaaggtttgaatttagcaaaatttgttcaaattcagtcaaactatattcctttttttttcctgttggccttcaaattcagtcaaattttgaaccctgcaggtattgacagagatagcgaggctgatggacaaatacaaggacgaggagaccagcatcaccgtcatcggccacagcctgggcgccaccctggccaccctgaacgccgccgacatcgccgccaactcgtacaacannnnnnnnnnnnnnnnnnnnnnnnnnnnnnnnncccccgtcaccgccgtggtgttcggcagcccgcgcacgggcgaccgcggcttccgcgacgccttccacaggctccgggacctccggatgctcagcgtccgcaaccggccggaccgcatcccgcactacccgccggtgggctacgccgacgtcggcgtggagctgctgatcgacacgcggctgtcgccgttcctcaggcgccacggcagcgagtcgcagtcgcacgacctcgagtgccacctgcacggcgtcgccgggtggcacggcgaccaccgcgggttcgagctggtggtcgaccggaacgtggcgctggtgaacaagttcgacgactgcctggcggacgagtaccccgtgcccgtgcgatggaaggtgcaccacaacaagagcatggtgaagggtcccgacgggaggtgggtgttgcaagaccacgagcctgatgacgacgacgacgacgacgacgacgattgatcgtaggtttcgatatgtaccatcgccatggggcgtgacaacttttgtcttctctatcttgatttcttctgataatagtggttttggtggtttttgttagttgtgtcatagattaaacttccataagtacaatatattagctacaaatttaatctcacgattctttgtggctccaattcataagacactaacgcatcgtactcctaggaccttacaatcttacaacgtgtttatgccatgtgctaatgtgcaatattcgcaaaggctaaagactcagagcgtgcagagtttaggctgcattcggttgcatgggttcccaacccctctccctcatttttcacgcgcacgctttttaaactgctaaacggtgtgtttttataaaaaagtttctatatgaaagttgcttaaaaaatcatgctggtccattttttttaagaaaaatagttaaaacttaattaatcatgtgttaagcgctgatttgttttgcgtgccggaacaaatacagcctagtgcaggcacaaaagcttgctatggttatcgtcgtcttgtgggtcacatttatctggggcttttaactatttgccactcttacgagtggtgcttaacgatttgccactaggcccacatgccatggacacatgagggcccacatgtcattgacagggtgtgacaaatcgttaattgtcatgtcatatgagtggcaaatagttaaatttccccatttatctctatcaacgattggaaagagaaatatatattgttccctccgttcaaaaattagttttgtattactttggacttctcaaagtcaataagacataactctgaccactttgcccataaatatttggcgttaaaaataggatttaatcaaaccttggaaactttggccatcaatttttacaagaataagtttataaaatctaagttcaggctattatgacattatttttcaaggcaaatctatacataacatttttttaagaaaaaaaagacattttagaaattatggatggtcaattttcacaaatttgaccaaataatcaaatattatcataaatgtttatgtctggacagaataattcttttgcatgaatgcgatactacgaaagtttttgttataacaaagttggccatgtcattttcatatgcctaaaacctatattccaaacgataatcatagttgaaattaaattatgttacaaattctaaaacatcacttgctgtaattggagtaagcatttaatacaataattaagcaccaaactctataaatagtgtgagctatatatatatatgaagaaaaagatccttaactcttcttctaccctaattaattgtacgttttacgcggatctagaagaagaaagaactaccaataaatcccttatattatattacatgtagccttatatgtactatcttaaatgatattagtggtggtggtgattttgccaccctcacctatctaacaagtgggggccaccacctgtaatgtgggtccatcgttgttgaccaacatctatttggtttatatatactatagatttagttctaatcaattcatctaatataattagagcctactataacacacgggtattttgctaatctactgaaaaatagtcaactttggaggattccaccctccaatgaagaggccctttgagtaacactagccttgttgatcatgttgaccctattcatgaatgtgtggtttcttttaaagacatgtgagattccgaggagcattagcttttccttttttgtgtgatagggaattttaaatcgattgggtaattgttatctctcgaggggatatctccttgtttcttacttcctttatttcaggttataagatgtt

SEQ ID NO: 20506 - DNA, 2270 bp, Oryza sativa
atatgaaacatatcactccacaaatatacacgttaaaattcaacttatacaaattgtaccaaatataactgtgaatgtacattaactatttttaattgaatttggtcttgcatgtttgtgaaatgatatatttcatgtcaatcgatgttgatatttttttatgtctatataggtaacatgcaaaaaacgaggggatgtccctaaaggaataaaaattcatctccaatcgattgtacatatgttcatgcccaaagttcattttttttcaactaaattttgagcttagcgaattgagtgttactctatggagtttttcactaattagttagttagtgaacatatatttgtcaacaaatattcgtaagtttataatttgttgacaacaacttcttaatacgaaatgtagcacttgctcaactctaggtacctgtgcaactcgtacagtacgtagtattaggcctatccacctatggaaaccttactaattcagctgttgatcggattcaaccgtgcaaacagaaaagaaagcgaactatggctaagctccaggagatctgtgctctcaagcacagaatctaaatatacgtttcactgaaaacgacacccgcacatgccgttccacccagggagatgaacaaaatgacaatttggaacacctgccaatttcgttagcacaatagaacccgataaatgcttggctaccagggccactcttttcgttaccatttgcatggcctgataaccagaaacaaaatagaaagggctaggaaaaaagagagaatccaaatgcaatgaaccccaaaaggacaagaaatctgtatcatactatctggctgggctgctgctcaacgctgtccttctcagtcgcacatacgaacaacacaggggtctattcatgcaagcgcaacggcattgaactactgtgacttcaggttaagctcatggcttgttcgtgttgaaaggagtcggttaaaaggagccaaggatgtgtctggtactgcatgcgcggcgtacaggaagttgagaataaagcggaaggtgtgtttattcagttagttcagcgtttgccctgtatttatgttggcatgccacggctaggtgctgtctacttccgtgttgattgtgtccttggcaccttgcaattccatccccctgtcacgctacaaaacctcaataatggcgtgtggagctctcttcaacaagaaataccggttgctgctgttgctgccctgcactcccatgttcttttcatttccctccctactgtctctggttctctgctcctccacttcagagcagcacaccggctgctagctagccaaagccactggatcgaacagtcaacagtgtgctagctgctgcctccttggtggtgtgtgtacttctcccatgtcgctcatgcgaggcggtttcggtttctccccggcggttgcggcgctgtactgcgctgctctcgtgggggccggcggcctcgggagccggccggtgctcggctgctactcgcgcatcttcagcttcggcgactcgctgacggacaccggcaactacgtccgactgacggccggcaggaagcccagcagcccctacggcgcgccgccgtacgggaggaccttcttcggccgccccaccggccgggccagcgacggccgcctcgtcattgacttcatcggtgagcgaaccgagctgccctccgtctggtttcagcatgcattcccctgctccgacgtgtcgatctgtccgtgttcccaccatctctgcgttgcttttgcattgtgcagcgtacatccctctgttttcctgccaactactacgtactgtgcgtctgtgcattgtgcaacctgcatgcatgctctgtttggaggatttttttttggaggggcctcaaacacgtactcggtggcctcttgttcagttgtccgtcaataacatccaaacttattattgtcctgaaagacgggtaacatgcgaggcgagtggtgtgagcattagaacgccgacaatagctcattctccctcctgtcaaaaaaaaaacataagagtatcattttttatataggtaggttatatgtatgaaaattatatatgtaaatttgactcaaaaggtcctttcataatactattatactacctccgtctcaaaagactttattacttgctaaaataaaatctttttgagtggaggcagtaatttttatctgctatggtcaaacttgaaagtttatgttaagagatttgctccggtccaacaaaaagtatctcgaggtaccggt

SEQ ID NO: 20507 - DNA, 4485 bp, Oryza sativa
  unsure (1)..(4485): unsure at all n locations
ccttgaggtattttttgttggaccgaaacaaatctcttatgttaaataccatgcttatatataaaaaaatggacaagtttggtgactagtgaggaaatatttttgctgcaataatcgtcatttactaacattttatactttgcttttcgtttacaagctcaagctcttagtcactgatgattgcactggaattcatgccggtgtacgctaacttaatttgtcctggccccaagcagctgtagtattagtgacaagtatgtactacagtgttttgcactttaattaggtctagcggcgaccatggtccaccaaaactccaaaactgtgcgtgcatgtttagcagagtagatgctgattaatttgtgtacaattaatttagaagtagccccttcaccaaaaagtgacagtagttagccaagtaccaggtgctgatctcgccgaattcatgtcaagatcagccactgcacgaagatgtcagctttgactcatcgcacggtgctgcttttcaagttgcaacttgcagatgccccgtcgcttgccaagacattctttcttccctaaagggcaccacaaattaaaccggaatcgcttattaatttcgatcatgtagtgaaatattttgagctgtttcttgagccttgttaactttgcttcggtaatttgtttattatgcgttctgtccaaacttctctagatacgggagtatgtactactccctccgtcttaaaatataatcatttttaatatagtgacaagtcaaacattttaaattttaactattaataacaaaaaaaaagatcaatcatataaaattgatgttactagatttagtattaaacaaactattataatatgtaacactttttatttaaaatatcttacttttatatatattattgatcaaaatagcatctcagagaccatagtacggttcaaaaatgtttatattttgggacggatggagtacgtactactggccgtcagttaaaaaaaaaaaactactgtggtagcagtgctaatgtaagtccttgctgttcgttgcagcgcaagagttcgggctggccaacgtgacggccattcaggtgggtgccgggccggccgacttcccgcacggcgccaacttcgccatcatctcctccacagcgaacaacgcctccttcttcgcccgcaagggcctggacatcacccccttctccctcgacacccagatgttctggttccgcacccacctgcagcagctcacgcagcagctgaacggtgagtacgccatgcatggccggccttctccatcagctacgcgcgtcgttgacacgccagctgatgcattacatgttactggttgattcgtaggcggcggtggcggcggcggcagcatcctgagcgacgcgctggtgtcgctgggcgagatcggcgggaacgactacaacttcgcgttcaacaagggggtgccgcgcgagacggtgcgcgcgttcgtgccggcggtggtggacaagctggcggcggccgtggaggagctgatcgggatgggggcgagggcgttcgtggtgcccgggaacctgccgttcgggtgcgcgccgctgtacctcaaccggttcaggggcgccgccgccagcgagtacgacgcccggacggggtgcctggcctggttcaacaagttcgccgagttccacaaccgggttctcaccgcgcggctcgacgacctccgccggctgcacccggacgtcaccatcgtgtacgccgactggtacggcgccatgacgagcatcttccaggccccaggaaaactaggtgagtgcgtacgtacgcgtcagctctctctctctctctctctccttattttggcattgtgtcgtgtcttgtcttgtgtgctgcaacggcgacgttgcacccgtcggcgttcctcctctctgttggtttgtgtggtgatatatgcatacacgtgacaaacgagcgaggcgagtactgcacaaagcttagcagttatgtatggcccgataagcagcatccaccgctgccatgcaggggccctcctaattcatacttgcgctaaggttcacgtacgaacagaggggtagagccgtagaggtcaagcgaacatggaattcagcggtgtccggttcggacgcgtctggctcatacgcaattatgcatccaaattccaaggtaagctgtaggcacttgggctgaaacacttatttcggtccctattgggctgggaagattttaataggaataagtccattttgactcccttaaaaatgacccgaatctaattcgtgaccctcaaccgtaaaaccaggtaagatgacttctgaactattcaaaccagtgcaatttgactccctaagcaattttagagggcggttttgctgatgtggcgctgacatggtgctgttgacctggtctttgtccacgtggcgcttatgtggcattagaattaaaaaaaatatttataggacccatctatcattcataaaaaaatattgtgggggcccacatgtcatcatctatctttctcttcttccttctccctgagatttctctgccttctctctctccccatttctcttcactttctctcgacgcagtgggcggataggggcaccgtcacgccggggagggcgagggcttcatggatccccgtggcggcggcggcgggggcgtgggacatcgatgtcgatggtggaggcatcgagcgggttgagcggtggctccggcggcgtgcggcgaccccgttggcgttggagagcgagggggtgtcagaggtgtctcgcgacgcggtcggcgtggggaggggcgccggcgcgtcgatctgtctggagccggtcggcggtggggcgtcatggacccccgtggcggcgacggcgagcgtgggacgtcgacggtggaggcatcgagcaggttgagcggtggctccggcggcgtgcggcgaccccgttggcgctggaggaggggcgccggcatgtcgatctgtctggagctggtcgcttggaggggcgtcggcggcgtgcaccgccaaggtcgagggcggcggcgtcatggaccccggcgacagcggcgtcatggcctctcctgtcctcacgcctcttcttcctcctccttccttctctcattctttccccctctcctttctaccactgtggcgacggcggcggtagcagcgagaggctgttgggaggaagaatggaggggggggcgtatgggccgctcgactacctcacgatggaggccgctcccgtggaagccactcgacgctgctgcgatggaagccgccgctcgactgcgctgccgccctattgtcgcttgcccgccgcctccggtccagctcctgccccctgcaaaccagcaaaggggagagaaagagaaagaaagaggatgacatgttagtgggtcccacaatatgtgtgaatggcaaattgggcccacatgttttttttaattctaatgccacgtatgcgccacgtgggacgaagaacagatcaatatcgccatgtcagcaaaaccaccctccaaaaccgctgagagagttaaattacactggttttaatagttcgaggagtcatcttatacggttttgtggttgagggtcagattatattcgggtcatatttaagggagtcaaagtggacttattccattttaatactaggccatagctcatggtcagtcacaggcctgaaaaatgagtttcataactaggctgggcctgtttccaggcctaacagtatacccatttgaagcccagctcatctattcctcggtgttattctttctgatcttccttaaccaatacacacacatcgacacgctgtgttatatgcaggattcacaaacgcgctggggtcttgctgcgggaaccagagcgtgccgtgcggcaaggcagggtgcaccgtgtgcgaggacccatcgacgtacgtctcgtgggacgggacgcacccaacggaggcggtgtacaagctaatcgccgacggggtgctccacggcccgcacgcctcccctgtccctctcgccaagacctgcccgcccacctgaccaaaccgctcctcctccaccggtagaaagaagatcgatccatccattctttgtgctatggttttattacttgctcatggaaacattgtagtacattgtgtaggtgaagttcaattacaggattcgtgtagagaaagagctagtacaaagtttgcatgctatgatccatgattcaatggacgaattgcaaattgcatgcgtttggagaaacacttttttactgatccctgaagaagtgtatggctccttttaagttattcttcccaaacagacatgatttagcgtgagacgtcgttgctacaggctacggctcgttgaggagttccgtttctccttgtgatcacagtgttttcgtgagcgattttccgctccttaatccatgtatgtacataccatcannnnnnnnnnnnnnnnnnnnnnnnnnnnnnnnnnnnnnnnnnnnnnnnnnnnnnn

SEQ ID NO: 20508 - DNA, 1181 bp, Oryza sativa
gcgaattcgagctcggtaccctggtgaaaaaaggagtccttacgttggttctctacaatggataatagggaaacaggaaagattatatcaagtgttgcttcttaaatcagttttattgcttttcattagttttatgttgcaccaacatttaccatacaactatgtgcaacagcagggcatataaataacaagcacagcgattctacaacatttgcacgtgtactatgttatttcagtgaagtataagcaaataagcaataccctgatccatagcataagctatctggtatacatccttttctttccttcacttcaaatgaaacaactcctatccttcaagcgtaactatcgatctactatactctactttagatacttaaatatactaaggtataacttggacaaaaattgacaacgtttgcttcagaagataagacaataaatattggctttttcgttgatatactaatggttaaatcaagaatgacatgaattacctgatatcttgcactctgcttattgtactgagattctggatcggcactcgtgtacacagacagccaccccccatgcacacaagggtcatcagcactgcctggccgtactatttctgaagcaggtaccaaggaaatatcaaggtcatccatccattctaccatccgtattgttccacgccatgccaccaccacatcccgtctcccaagcacttctttaccttcatctgtggccaccgcaacaaaccccatccaatttgactgcttgctccatgcagccttcgaccatgactttatcatgaatgcatcaggcaaactgacagtacacattgcatatatgaactttgtaatgacatacagatttgggtttgatacatccaccctgctgaggaagtccttgcgactgaagaggcaagacccagcgtaccttgatcttctctctctgtttaaccccgtgtaggctgcctgagaaagctcaccatagttgatgatgttattgcggagatcaacgtcaagaggatcaagtaaccccttccagtaactcacaccattgagctctctccatcttctggcgatatttccaagccctcttagggagctcatctttgccgtatatggttggtctgtgatgcttggtacttacaagccacaaaagcttgcaacttcatattccactgggcgtctggg

SEQ ID NO: 20509 - DNA, 2431 bp, Oryza sativa
  unsure (1)..(2431): unsure at all n locations
nnnnnnnnnnnnnnnnnnnnnnnnnnnnnnnnnnnnnnnnnnnnnnnnnnnnnnnnnaagtataagcaaataagcaataccctgatccatagcataagctatctggtatacatccttttctttccttcacttcaaatgaaacaactcctatccttcaagcgtaactatcgatctactatactctactttagatacttaaatatactaaggtataacttggacaaaaattgacaacgtttgcttcagaagataagacaataaatattggctttttcgttgatatactaatggttaaatcaagaatgacatgaattacctgatatcttgcactctgcttattgtactgagattctggatcggcactcgtgtacacagacagccaccccccatgcacacaagggtcatcagcactgcctggccgtactatttctgaagcaggtaccaaggaaatatcaaggtcatccatccattctaccatccgtattgttccacgccatgccaccaccacatcccgtctcccaagcacttctttaccttcatctgtggccaccgcaacaaaccccatccaatttgactgcttgctccatgcagccttcgaccatgactttatcatgaatgcatcaggcaaactgacagtacacattgcatatatgaactttgtaatgacanncagatttgggtttgatacatccaccctgctgagnaagtccttncnactnaaaagtcaagacctccgccaaaagggggggcgcccggggggttttaaacccccccttttggaattccttctctnntntgtttaaccccgtctagtcnncccagatgatctaagcaccgccnnnatgttantncgnagatcaacgtcaagatgatgaagtnnccccttccagtaactnacaccattgagctctctccatcttctggcatatttccaagctcttagaagctcatctttcgggggggtttgaaaatttaaatttggnggtttggttcctgttgatgcttggtacttacaagccacaaaagcttgcaacttcatattccactgggcgtctgggtatatatgtgtgtgtgtgtgtgtgtgtgtgtgtatgattctaggttgctatcctctccatcaaatctgcagttccataagcatgtagaagatgagctccctgtcattctcttccctaccaatcaaccgcccaacttggcaaccatccatcctggatttcaaagcatgaagaaacttgcacggatcaaataatccgcctagagaagaggtgaacaactccatcatattcataaagaaatgcctcctgacactacccagcacaccaaatctttgtgtgcctctgaagagagggggtggggttcaccagttgcaaccagaaatgagcagcatcttctgtaaaagatttttctccaataaatggcagaagtttatacgcgtactgtttggtatttgaagtattctccaataaaagcatccattagtaccatgtttactaaccaaagcatttcatattaaaacctttagttccaatgattactaaccatatgtataatcgtaatcttgactatatccttaatagaataatatagaccatgaccatacagccaaaagttctgtttgtgaagagccatctacagagttatgatgtatgtaaccacatttttcactgttattggcaacatcatccaggaaaggcacatttgtaaaggagtattttgcaacactcatcaccagaattaggcaaggaaaaccaatatgagcttagcagccactccattgcacctttctgaatatgggtctagctgcctagctggtcaaggtcctacgtgcaacaaggtaaagccacaaataaagctcagatctctacctatcacttccaaagtacaatattttaatacatttagcagctacctttaagtcttggcctaacaaatttcaacagatgtaccagtgcctgaaaaataaagctaatgctactttcagttcacattgcattgtttagctaatatccaaacagggccacaataatttttcattttgatctaaactgagttttgctgttctatttaagatatagaagtttatctttctcaaagtagatgacttagtaccaaagaaataatacaattataattgataatactatagaatgacagacattataaaagaaaagttatgacttagtaccaaagaaataatacaattataattgataatactatagaatgacagacattataaaagaaaagtttatatgattatagtgtaacggactgaactgtaccatgctgatgtattatggtgactctcaaactggtgtatggaaacttgtatgtagcttctcctgatacatcaatcattcttctatgcacaacgaagcatcagaacagtctcaactnnnnnnnnnnnnnnnnnnnnnnnnnnnnnnnnnnn

SEQ ID NO: 20510 - DNA, 1850 bp, Oryza sativa
ctagctggtcaaggtcctacgtgcaacaaggtaaagccacaaataaagctcagatctctacctatcacttccaaagtacaatattttaatacatttagcagctacctttaagtcttggcctaacaaatttcaacagatgtaccagtgcctgaaaaataaagctaatgctactttcagttcacattgcattgtttagctaatatccaaacagggccacaataatttttcattttgatctaaactgagttttgctgttctatttaagatatagaagtttatctttctcaaagtagatgacttagtaccaaagaaataatacaattataattgataatactatagaatgacagacattataaaagaaaagttatgacttagtaccaaagaaataatacaattataattgataatactatagaatgacagacattataaaagaaaagtttatatgattatagtgtaacggactgaactgtaccatgctgatgtattatggtgactctcaaactggtgtatggaaacttgtatgtagcttctcctgatacatcaatcattcttctatgcacaacgaagcatcagaacagtctcaactatcgtgcagtgaaactgttattcagattattaaactgagcctaacatatcatgaccgatgtcctgttttatttatagaaccatggctgagtccagctgtttcagcttgaaggttatggcatgtttttttctgtgccaaaacagcatggcaatagatttgtgtttcataccagccactgaacctgtaaagatctatttcctgaagaaatataatctaaaatgcctgaccagaaaaacatgatgaatgagaatgaggtacatcagaagatatatcaccagaaatccccacaagagcataccccatcctcaaaccggtgaaaccgacggttatccctgagaattacaatccttcctgtacacttactgagatacttaactgcattgtggcaatcatcacaaactcgtaggttcttcataactcgtattggtacaccttctggaacaatcagaagccccaaacctattgctagcctttcactatgatacctcattgttgcctgcttctcatccttgtccacatccttaaccactgcacttgtatctgctacataaccagctgcctccatcttctcaccaactttctccagcacattgtaaatttcgttgcttcttggatgtctcctgcaatttgacacaaaggtatgtacctcccctgcagcttccagccagcttagtccagtctctttacgtacacctgcatcacgcattgctttcctcgcaagtgctgcatccatatgccttcctgcagctgcatacgtgcttgacaagacatatgtgcaccagagcttcgtgaccctgtctcaaacaacctctttgcagcaattgctgcagcgtcagcatccttaaacatgcgacatgccataaggagtgcaccccagacatactcaggtggctccatgggcattgactcaataaggcctagtgcttcacttatacgtcctacacggccaagtaggtcaaccattgcagcataatgctcagcctgcggctcaattctgtactctttcatgagggaaaaatatctctttccctcatcaacaagaccagcatggctacaagcagtgatcaaagacaggaacgtgatggagttgggacgaaatccagcattttgcatatccataaaccgttgaaatgctgcagtagtatgaccatgctgagcagatgcattgagccccgcattccaaattccaaggtttctctcaggtgcttcaccaaacacctggtatgcacactccacaaggccacattttgagtaaaga

SEQ ID NO: 20511 - DNA, 922 bp, Oryza sativa
gcgaattcgagctcggtaccctttcttgtagtaacctacaaactagaattaattaatagtataaagcttacaaacagtaatgaactagctgcactcaccaaattgttcaggggaaagaaaaatttccatggcagctccatagtaatcagtatagatgatggccacatcggggtgaagcttgcgcaagttttccaattcatctataagaagtttgttgtggtattgcgagaactcattcatccacctaagacaacctatctctggctcataatcttccttcttatcactctcaaattgcatgaggtatgttggaatacatccaattgggaggttaccaggaacaactagtgtcttggctccaagtccgatcaattcctgcgaactcaactttattgcattacaagctatataatattatattgcttcgtgaaacaggagctcaaggtatataaaaagatgcaggcacattactcacggtgattgtagaagaaattttggcaataacactaggagtgaagctgcgaatcttttcaatgggcacgccgctcataagaggatagttgtaatcattgcctccgatttctccgaccaaaaagagagattgattcatcatgcccttgcaacctgtgccataaacatcgtttagtaatagctgaaagggaactttaactatcaaaattgctgctttatatggtagttaaactaaactatcttcacctactacttctagcatgttcgtttattatcctattataaactagacagatttgtagcaaacccacaatcattgacctggcatatttattttttttattttattctatgcaaccaattcaagggttaagcaattattcacgtggaaatcatatcatgttgaccaaatatttggcagtggcatggtggggtaccgagctcgaattcg

SEQ ID NO: 20512 - DNA, 2560 bp, Oryza sativa
acgtggaatttaacatttttgcacacaaaagatttggtcagttcttaaagtaaagatttgaatgtgatatgcagcactctatttaccgggggccatctgccggttacctcttccgattatcgcttccacacaagtatagtaaccggccgatgcctaaatttgtgtatgcgagtagtgagcaatttcttgttttcaaaaatgctgtcacaacatgattggtgttttttcaattgatgaaataaattctgatctttgcttaaaaaaactacatctacttattacttggttcactcaacataaagcaaactaaaaatcctacaactgatctaagacagtactaattatagccactcacgctgaaggagaaaaaaatgttctgttataaaatctctattcgaaattaacaaatactagccgacaacccgtgcaaattgttactaattttgtaagtataacgtttttctttgtattctaattttaattcacaccaaagccttattataattttttggagttttttattaatttaatttagaaattatgaattactaagtatcaagagagagtcttaattatattgtttttcaccatttaataattttgaaatcgacaacaaatcaatagtgagaatagtgagttgtgttctaaatgtaccattagaaatgcaaaatagtgtagcctatgacaataactagagaacacacgaaccaaaacccagaagtatgcatgaaacattcccgagaaaggcaaaaggaaggaagaggcgacatcacggcggcaacagccatctagacaaggtgaacaaagaactaatttacatatcttctagtaaccactaagccttgtgctacaatatataagttagaacattacgccacatacttataagaaacaaagaaaaaagaaatctcaaaagtttaggaagacgaaaaagaactataaataaaacctcatgacaaaaaaaaaagaggggataaaaatgagtcgacctgcaggcatgcaagttagtaacagttgggatgtaaaacagtactgtgggtctataatgagacaacaataccacaatattcctttacatattttaatcacatattgggtataataataacaaaatataattacagaattacaagtcgtacatggccttgtgttcaacagaggaaccaaggccaattatctgcggacaagaattagtgatgcttacaattggaggttgagtgtatgaaccctgtagcaggccaattgcaatgcccttgtatgcagcttctgatgggatggaagccatcccacgatgcatattttgctgggtcatcacacactttgtattcgccatatccacagcgtacagatgcagatacaccataaggtcctcttccaccacagcaagcgaccaaaggatcctcaattcctgaaccgcagtttattaggaagtgttaaacaagctaccgacaagaaaagttgttctttatcaatatagaaagtagtgcaggagtgcattccataacatgatgaaaataaaatagccaacctggtaaatatatggagtgagagaaacccaatttagatgttgtgattgtggtacaagcatatttacaaaaagatttcatttgttcgagattgccatagaagtcaaatttaagaggccaacagaaagttttttttttcttgtagttacctacaaactataattaatagtataaagcttacaaacagtaatgaaatagcttcactgaccaaatcgttcaggggaaaggaaaacttccatggcagctccatagtaatcggcatagatgatggtcacatcaagatgaagcttgcgcaagttttccaattcatctacaagaagtttgttgtggtattgcgagaactcattcatccacctaaggcaacctatctttggctcataatcttccttcttatcactctcaaattgcatgaggtacattggaatacatccaattgggatgttaccgggaacaactagtgtcttggccccaagtccaatcaattcctacgaactcagctttgtttcattacaagctttgtaatattgtattgttttgtgaaacaggaactgaaggtatataaaatgatgcaacataggcatattactcacggtgattatggaagaaattttggcaatgacactaggagtgaagttgcgaatcttttcaatggacatgccgctcataagaggaaggttgtaatcattgcctccgatttctccaaccaagaaaagagattgattcatcatgcccttgcaacctgtgcgataaacatcgtttagaatccgtatgtatggataataatagttgaaagggacctttaactatcaaaattgttgctttatatggtagagaaactatcttcacctactacttccagcatgtccgtttattatcctattataaactagacagattttgttcatttgtagcaacacaatcatgaatcattgacctgacatatttgttttttttttcaattttgttctatgcaaccaacctaagggtaaaacaattgatcacgtggaaatatataatgttaccaaatatttggc

SEQ ID NO: 20513 - DNA, 3278 bp, Oryza sativa
cacaatcatgaatcattgacctgacatatttgttttttttttcaattttgttctatgcaaccaactcaagggtaaaacaattgatcacgtggaaatcatataatgtttaccaaatatttggcagtggcatggtgtgtattatcatatactagtatactcaaaatattgttaatgattgtggtatatctccaggcacgcacctttctagacaataaagccccacctactaaatagcaaccgctacgatttgtgcttagaaaaggagaactgccacgatctctcgttcaaaacgtcattgtcaaaggtgggtgcaaggcgagaggtgttttttgattcaaacataccgtccatgtcgccgccggtgcagagcatgccgagcagatcacggaaccactccatctccatgtcgaggtgcacggtgtcgtcgtccatgggcacccctctctcccggaagaagtccgggctgagcgccgtggcgccgcccaccgcgaagttggccccgctggcgaagttccccgcggtctgcccgccccagtacggccgcacgaacggcagccccatcgcttcagctgcggcgcggcgcgacgaggcgtacccatgcacaccacgcgcgcgcgaattattccacatctcatattagcaatggatcgagcgatcaatcgatatgcagacgaggcctggatggatgacgaggcgtaccgatgaagtcgatgatgaggcggccgttggaggagcggccggtggcgcggtggaagaaggtctcgccgtagggtggccacagcgagggccggcgggagtcgttgccgtagaggaaagcgatgttgccggtgtctgtaagcgagtccccgaagcagaacacgcgcgggtagcacggcgccgccagcgcccgtgacgccgccgccgacagcacaaccgccacggccagcacaaccgccggcggcgagagtcctccggaagtagaggagaccatccttcctacactttcgtttccttctgctcgaggtggtcgtcgggcacgaaggcgaacccgccactgggattggctctgcggtggtttttcgcgttggcctaacgttttatactcaaaaaatgcgagatatttaaccatttgccacatttagatgtagcaattaattttttaccactggacccatatgtaatagatatatttagactcacatgtcattgagatagggatgacaaatagttatttgccaaatctaaaagtggcaaatagttaaaagcccaaaaaaaatgcaaatactctaataaacgtggctcgttaatgttagtgggctcgaatgacgagtgcccacaggtcagtggacctctggtcgctgttagcctgttacacatgaatgaacggtgacaggtgtatgctccatcctccactaaatgcactgtgaaacgcagtataaattaacgtagacggtagacgttcacgatacttacacactcgtccctctaaacatatacatcattctccattgagataataattagtcgtaaatacaagcacctatatcaaaaatagggtttaaactcgagtgaatttatttcatccactgctgaagaaaccatctttattgggttgagcaaaaaccacaatagttaaagatgatttttttatcccggtttcaaattttatcggccctaggtgatgtttagtccctgttggtattagcaaccgggaccattttctgtccgaggctgtcagaggaccaggcatttttagtttcggttggtcacacggtcacaccaaccgggaataaaaattgactaaaaatcaatatacagtatataatccctatgacttatcccccgaactcctcatcttcctattcctctctcttatccctatcctctctttcctattcctcctcttatccttatcctctccttcgtattcccaattgagcgtgagagtgagcgagctgaggtcggcggacagcacgagagcgagcgggtggagggcggtggccggccggcgtggcagcaggcgggcgtggagggcggagtgacgggcggacgcggcagctgcgggtgcggcggcgggcgggcgcggcaggcgggcagcgcctctgagattgttttttttttttgagaatttgtgattcggatctaagatgtatttgatttgtgtgtgacgtgaatatatgatgtatttgtgatgaattttttagaacttgtgatgtaattttttttaagaatttgtgatgtatttggagatgatcgatttgaggatttggaaaatatccttttgctctgtgatgtgatgattgatttgggatttcacgatttggggatggagtgaaatcaatattcaatgttaaaaacaatgaaaaataataataaaaaaagcaaccagacctaggacctagcctggctccacttttagtcccagttaataacacaaaccgggactaaaaatagatttttactcccgattcatggtaccagttgtatagccgggagtatagggggttcccaaccaagactaaaacccctttctccatcagtgatgataagaaacctaaccagttgagttaagctcacttcgcaaggtagcacaccatttgtaaacagattattgtcgatcattattttggacccaatgatttgatacttccgtatactgaatttttttttccggcgatgtatactgaaccatgcataagtgaaaataattttgcccgtcgttcctgtttctggctttctgccacggtgaaacagctcattgaacgatatataatgaggcttgcagcaacaaatcacaaaatgattccggcgatgaagactcgaggagatataaacgggaaataagtgtagttcaacgacaatgacagtatttttgtactacgtaaattttcgtttctcttagaatgttaggtgcaaggagagtaggtactgaattaatgatgttgcaacaaattaaattgacctgattgatatatactggtggttgtgctatttattatctaatatttgcggagccattgtttatttgtggaataagcgaaatggcatatttgcaaacgaaaagtaatttgttaataaaacttttatatatgtattcttagcgatctaaaatcaaaggctgaaaaataaacttcgataaaaaaacctcaaaatcagctccaaatttaaaattgaaaattcaaaatttggctggcacaagcataagcgaaaatatgagtcccttgaagtgttttcgatatttaaattttcttaaacaatatcccgtaaatgtttgacactgacactggtggagaaaccat

SEQ ID NO: 20514 - DNA, 429 bp, Oryza sativa
aagaaggacatcagcggcaacccgcgtgctctgcgccggctgcgcacggcctgcgagcgcgccaagcgcacgctgtcgtcgaccgcacagaccaccattgagatcgactccctgtacgagggcatcgacttctactcgaccatcaccagggctcgcttcgaggagctcaacatggacctgttccgcaagtgcatggagccggtggagaagtgcctgcgcgacgcccagatggacaagagcagcgtgcacgacgtcgtgctcgtcggcggctccacccgcatccccaaggtgcagcagctgcttcaggacttcttcaacggcaaggagctgtgcaagagcatcaaccccgacgaggccgtggcatacggcgccgctgtccaggccgacatcctcagcggcgagggcaacgagaaggtgcaggacctgctt

SEQ ID NO: 20515 - DNA, 50565 bp, Oryza sativa
  unsure (1)..(50565): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcacctcatgattttgtttctaaaatatctcactaaatttacctctgttttgtcttgttctaaatattttaatgttttttgttttttattatccagtaatgtagattcggtttctgtgcaatgtaaacaaaaattgaatgttttttgcttgtgcagttgtgtggatctttggtttacctttctgagcaaagctataaaagcaaataaaaatgatgttctgttaaaatctattttttaacttccacagcttcaatattttgaaatgacaaatgaacgatgaagtgatgctttgtcacctcatgtcaaatagaaaattctgaattaccattagttgatcttgtgatctcttgagcctatgacgtgaaaaaaaaattcactttactgaggagaactacaatctccaccatagctgcttctcgagtctatgaccagagatttcttttgctgtcttcctgatgaatacggccatacaccatagctgcttcctatttatattctttcattaatatgttttcttgtcttattgcagaaaagtaccaagagagtgaattttgtcaggggcttgattagggaggttgtgggatttgctccatatgagaaacgaatcactgagcttctgaaggttggaaaggacaagcgtgcactgaaggtcgctaagagaaagctcggtacccacaagagagcaaagaagaagagagaggagatggcgggtgtcatcaggaagatgaggtgtgtgtctttactactgcattctgcaatttcattgttgatgttctctgttttttagttgctattttttttccgtgcgtattgtagaatgggttctactccctctggtttcataatttttgactttttgaacaatgacacggtattcaaaatatatctttgaccttgtttttctattataatatacaaaataaataaatgcatgtttacttttattatagaactttgaaagatgaatccatatatgctattctaattcttttaaactaaatacttttaaagttgatagttaaagttataaaagtttgactacactctgtccaaaacgtcaagaattatggaaccggagggagtagcactttatcggtaacattgttgtgagatttatttgtgtaagtactcccaagtatataagaggcattctgcaaatattggacttgtctctaaattaacttggtcctttttctgtagctatgtaggggtgcaagtggacaataccactatttgcataaataccttcttgctagttcatttcccacatggtagcacaaattttggaagaaaaagtgaactataagtgggataaccgggaaaaataaaataatcccgcttgtccgcccaacttgtgtccctatacttctgttctgttatttattatagctttataattcaaagcagtacaaatgattttctccgttgttttggtacctcagttgtatgtaagttttgtttcatttttcattttctggccaattcttacctttgacaaagagaatttgcaaactaaatcccttctcttgttgtgcaggtctgctggtactactgacaagaagaaatagaagtttcaagttgaagatctttttgcaatccttattgtaattcatttatatggacctatagtaagctctagatcgaggtgctgtattgccgttgagaacattgcaatgctattgaggagcattgaaattttggcacatgtttcgatacatcggttttgtcacaatttctcagggttctattgcccttgattctgtggagttttgtccttgaaactgttcttgcctattgtgtcctgacgtgatcgtaacggtctattgggctgtaagattgggagctatttggtttccaatggcgaaatggcccaacgattaaccaaaaatttgtggatgctaatcctctgaaacacaggattatccaaaatgagattaggaaaatgtaagaaatatggtgtcatgtgcattagatttggattatccaaaatgggattgggaaaatgcaagaatatggtgtcaatgtgtcatgtgcattggtttacgttggaaccctggaagattttaaaacagacgttcgcgaggtgtggtctcatgcttttttttttctttaagggtcttgaagggaatataatcggacgacgatactttttgtagaaaatactaagaacaaatttctatatggccattcagaacacatgaactggcttccataaatcctacagatattttaggaatatccaaaataatgctcttgccaaaatatcgggcgctgatgtttacaaacatattattctctctctcatctcatcgagtggttgatgcacaataagctttgtatattcattggtcccacaaatcctaccacccactttggtaattggaggactataaaactatagaatttattaacttatttaaggaatagaaaaaagcctccacgttcgctctatggtctgaaaattctcatattaataaaaaaaagtctatatataaatgcaattcaaaaatatatgaaatttgaaattaaaaataatgaatatagaaaaggaagactgaagtttatacgggtatacaatataactaatggaaatttggaattaaaaaaataagaaaaattaaaagtagaggttagagtccatataaaaatacaatttagaaataatgaaaatttgaaattaaaaaataataaatattggaagaagaatatagagtccatatagaaatacaatttaaaaataattgaaattcggaattactccccccatccataaaagttagacatattttacatttgagtttttccaaataagttttgtagtctttttgcattcaatacttaatgaggagcgaaaatgcctgtagcctatagtagttacaagagtctcagtagcatctgaggtcctgggttcgactctccatggaagcgaattttctacgatttaacagtgttgtgctttaagtggtagcgaggcgcctgtgatgatttcgtcaatcttaaggatttgccggcctagtcttcgaggatgctcataggggtagggtttgcgtgcgtgcgttcataggtgtgaatgagcgtgcgtttgacttcatcaatctcaaggatttgccggcttagtcttcgaagatgctcataggggtagggtttgcgtgcgtgccttcataaggctgtgtgcgcgtgcgttgtgagtgtatgcgttgtactgtgtaattataaaaaaaaagacttaaatgaggagataaattaaatgtttgattacaatccaaggagtcatctacatactcattggttgcatgcttgcattcactccttaattttgtaacattcaagatgattgaggagataaattaaatgtttgattactccctctggttttattttgattgacgctttggataatgatacgctctacaagatatatctttgaccttatttctctattataatatataaaataaataaatgcatgtttacttttattatagtgttttgaaagacaaatctatatatgtttttctagtttctttaaacttaatatttttaaagttatagatggtcaaagttataaaagtttaacctcaaccttgtccaaaacgtcaattaatatagaaccagagggagtacaatccaaggagtcatctaaatactcattagttgcatgcttgcattcactcattgattttgtaacattcaagatgattcaatttttccttggtcttggcgacaaaagtaataggtgtaacttttgtggatggaaggagtataaaaaaagaaatattgaaaggtaagtttatagcctatttagacttaatagaaattaggaattaaaataatgaatattagaataagagtatatagtccatataggaatctagaattaattaaaattcaaaataaaaacaataaaattaaaagttgagtttagagtaaatatagaaatacaatttacaaataactaaaattagaaattatgaaaattattggaacaatagtctagagtccataaaaatacaatttagaagtaactgtaattcataaattaaaaataaataatatcgaatgatgagtttagagtgcatatagaaatacaattagaaataatgaaaattcacaaattaaaaaaaataagcaatattaaaagaagtgtctagagttcatataggagtataatttagaaataactgaagttttgaatttaaaataagaaatataggagtaaaacttataaataatgaaaattcataattaaaaaataaagaacattggaagtggagtatagagtttgtatagaaatataatttagaaataactaaaatttgatagccccctaaaccctatcctgaactttccataccggacaaattaaccccctagaccaaattaagattggttttgtccaacgtggcgcacgcgtggcaatccagtcatcatactccacttcccctcttcctctctctcgcacatgctgcgtgcatggcgaggacgggcggtgggcgtgggtggacagcacagaatgcggcgcgcacgacgacatgcaggcattcggagggtgtctgttgacagaaaacacgaggcctgggagatctgcttaactccagtgcaggtccaaagctcgccttcgggtgtgctagcgtgccagttgatttgatcctgtaaccaacaagaagtagaagcaaagaaatcgcggttaaatctataaatgatagccgatcggctaggtgccgatgacatatcatttatctttgagccgatgtcatatatacatcaatcggcaaccattaataaataagaagggactaaatatactcgatcggctgcatatattaccaatatataatctttatatcgatatatacttaaatcaagtgattgggatagatcggtcgccatgccgagacagtataaatcacttagatcgaaatatatattaataatgaaactatatacgtttatagcatatacgttctttgcggcagacttttgccctaagcatatctctaaggaaattacgtaaaacatcctaattaatagatacaattgccttctcagaactctatccatgtgcggcaatcatcttgaagcatatcgactcaacccgatgttgtacaccaagtcgtattgccggaattggttgtatcacgtaacccagtctgattcagatttagccgattctagtcgtagctgatctggactccagccgattcttactctgttcccgcaacaatccttatctccaactccgcttcgatcccatcttcacctccgacgctgatattaccaaattcggttgttaacacatgccccccaagtccgggatatttggtaatgttccggatttgccgtgtactgacttcgagcaagtttcgcactttgctgttttccgaccgttattgccgtgcttgaaatactaaccgtcaccctcgagaaatctcacaccgtgacttctgttttcaccgctcaagcgaaactttatcctctctctctctccggcgattcctccgacgcaaaagcgactcccgggtgacttcatctccagcgagacctccgcctgcagcgatgtcgtcttccaccaatccatctgatgtgccatcggccgagtatgctgaggtaagtctccactggctagatcccctttcttagcagcagatcgattttctcctatcttatatcgctctctttctctcggttgtcttggatttgtagcatctctctaactgaatcgcgattccaagcttatcacacgaaaactactactttctcggcccagtcggcaatcctgatcccactgagtttatcattggtgaaaccaataggattcccttcagactaaccaacccagatctaggtcattggaataacacctttaaatcttggccatctctagagaaagttccacccgagaaaagttggaccacatggttcaaacgtgtgtcagcaagcaaaagggttcactgggacgaaattggaatcggccaagcacttgacctcactatagcaaactcggccaaagatgaacccctgatggcagctgcttcttacttctggtcaaacaccatcaatgccttttcgtttaatcaagggccgatgatcccaactctcatagatatcagcatgatcacgggtctggatgtcacctcatcggccaaccctatgagtttgaatacaaagaaccaatatgacttcaagaccaagagcataggcggctggtcaggctatgtagcagcatatataggccagggtccagttacccctcgagaacatgtggctttcctattaatgtggttagaaaagtttctcttttgtgggtctagctgcggtcctacaaccaattggcagttcgtagccgaagccttggagacaaaaagacaatttcctttaggcaaaatcctcctcggctacttgtaccaaatgctaaataatgcatcggctaagctaattgtcggctcagtagtcggagcgggtggaccatggtggctgctgcaatcctggctaaacttggtagtcatgaggttcgtcgatcggccatctgtaacagaaactgaattcccaagattagagccgactgttaacgatgacggagaggaactcactcatcggagatgcacatcatatggagagtacgcctctaccccaactgatgcaggagcaaagctatcggccgagctgctcaaagattggttttgtagcttttatgaggggttccaaaaggatgctcgagtttggtttctctatggagactcaacacttctagaaaatccatgggacttcaaattcgaagacatcaacaatgacagatatcagaagcccagagaaatcttcttatctgcaatcaccccatgcatccttccagtcggcattcatcaagggagaaccatccaagtttcctacgagttttatcatccaatgagttctgccagacaatttggaatgggccaactcccaattggcttattctttgccgataagatccaatgccgaggagaaatctcatcatctttaatgatggatcggctgctcaatctccaaggacctcctctaggcagcattgacaccataaagctggcaacctttaggagcaaattatttgacagatggtggggtgaatggaagctacacttattccatcaatcggcttccaagtatatgatagatctctttccagatattgtccctcaagtaagtcctaactcacttgattttatttgaataactacttggttgattagcccttagctaactttcctcctgatttacagacaacagaatcttctccccatcaccaaagcaacagcggcagggatatcgagtatgccccaggactgatccccaacggaggtgggccatctccccccgtcatcggctataatgcccccaagtcttcagctcttctccaagggcttatcagagaaccagctgatgcccgcaagaaaagaaagaccagatcatcggctataaatatttcagccccagctccaaagaagaagactaagacaaagaagaccacaccagctgatgatctatctgctctagatccatccattgaacaagctctggatgaagaaattattgaagatgacattgacgaggccgcagccgaagtaagcgatacagaacgaacaccatcggcttcacccaaacaaacccctccaactccttctgctccagtccacttttcaagagtaaatagctccctttaatcccttttataatcattgtatcttatgaccgattacttaaagatttaataattgcagaaaaagaagactgctgtgaaaaagaaattggctgcgacaacatctaaaccagctccaccagtaagataacctcaattttccattaattaactctcagccgattttgcctaacacttgtttctttttaagcctcctcctcctccttctccttctgtacagcaatcaacaagtgaccagactccatcagctgtaggaagtcaccatatagaagaagaaattcaaccaactgttcctactatcccagtaggttttcttttgacaaaaaacattcagatcggctatgcctatttgacccctaactctctttaaatcgtcgctgcaggtcttagccgatcttttttcttttgacatcaaagattatcttgatgaaggagaagaagacaccataagcaaagccttagcccctttatccgatgacgtgaagaaaactctggaaaatatttctcatcggctagaggcatcatcactagatagcttggtagttgattgcgcctcaattaggactcagctacatgaaattcaagctctgatcccagatgagttagtcgatatccttactccagccgtttatcttgagcaacatcaattcaaattggagaaagccaagttaagactgaccgaacggcgagaacgtaaagacattgaagctacaatccaagctaatcggcaacttgtgcatgaggaaaaaatccaaacttgatcagctttcagaaggtccgatcaaatccaacattgatcggctcgaggctcgcaagattgagctcctggcacaacttcaggaatgcaatgccgaattagatctggagcacaagaaactagccgatctcccgcggtctgtcgaagaacaaaaagcaagacttaaatcggctatcaagaatgttgctgatctgactaagtctttgaagatcattcctggaactgatgctcaaggtgcccaagctattgaggaagttgaacaaattaggcaaaaagctatttcggctatccagcaatacttgtctcaataacttttatgtaataggacttagaaatctttgtaatcggctaagatgctctagtactttactgtcttgacaatcctttgtgccgattaatatgacttcgaaatttgctcaaaaaaatttcattttgatacatatgtgccccctaattttacaatgtcaaaagcattgataaaattatagaaaccacaatcgattataccatgaaaaaacaactaagggcgatataaccatatcggccattgtacatcggcaaaccacaaccgattacaccaggaaaaaaaaacaactaagggtgatataaccatatcggccatctcaaggcgatggaaacacatcggctgtcatgcatcggcaatactagccgattatgcgttaacccaaacacttgggtaatatttcttcaaatacttgccattgagcgctcgctcatagacttcaccatcaagcccttgcaacatatacgctcctttagatacaaccttataatttgaaacggtccttcccaattcggcgaccacttgtcaaatttaccatcacgagtaccaatcggcaaaatcaacttccatacaagttctccttccgaaaaatctttaggtaccactttcttattacagtgccgagcaacacgttccttatccttggtaacctttgcaagggcacgcaatcgtgactgaaccagatcctccctctcatcggccataaggttgtaatactcatcggccgttaaatcgttttgtaattctgttcttcgagagctgattctaacctcccatggcaaaacagcctcatgtccataaacaattttgtaaggagggacttggatcgatccatgacaagccatactataagaccacaacgcttcggccaaccgagtgtgccattgccgcggataatcagaaattttccgcttaatcaatttgatcaaacttttattagatgcctcggcttgcccgttagcttgtgcataataaggtgaagaattcaacaacttgatacccatgctatcggcaaactgaacaaactcatcagacacgaagattgaaccctgatcagtagtaatagtttgaggaataccaaatcggtagattatatattcctgaacgaattgaatggcatccccagaatcaactttcttcaaaggaatcgcctccacccacttggtgaaataatcagttaccaccaatataaacttatgtcctttactcgatggtgggtttatcataccgatcatatcaatgccccatcctctaaacggccatggcttaataataggattcatagccgacgccggtgcttgctgaattgctccaaacttctgacaatcttgacaccccttataatatctgaaacaatcttccagcattgtcggccaaaagtaccctgcgcgccgaagcaaccacttcatcttatgagccgattgatgagtaccacaaattccttcatgaacttcgccgattgcaaccttagcctaatcagcactcaagcacttaagtaatactccatcaatcgttcggtaataaagttcatcatccaacagagtatactttaatgccttatatcttaatttcctagaagctgattgagacggattactcaaatatcgatgtacatcatacctccaatcatcagctatcattgctgcaatttcaactttaacatctttgatcatcggcttatatcccgatgccccttgagctaaatcattagcttcaatattttgctctcgagaaacatgctttaaagtaaccagccgaaactctttcattagttcttggcacttctcattataaaccatcaatgtatcattcttgcattcatattctcctgccaattgactgattactaacagagaatcccccatgatttcaatggtatcggcttcaacttccttgagtagttgcaaccctttgagcactgcctcatactcagcttgattattagtcgcatatggtttaatagtataagcaaactcgaaacatgcccccctaggggagattatgactaagccgataccacagccatgagtacacaccgatccatcaaagaataaagtccacggtactatttcaaccgagccgattgaatcatcacgatgttccacaataaaatcggctatagattgtcccttaatcgccttcggtgactcataccgaagatcaaactcggttaaggaaaatatccacttttcaaccattcctttcaatattggagccgatagcatgtatttgactacgtcggctttacatataacagtacactcgttagatagtagataatgcctcaaccttgtacacgaaaaatacagacacaagcataacttctccataggggagtaccgagtttcagcatccaagagccgacgactaagataaaatacgactcgttcctttccttccaactcctgaatcaaaactgagccgattgacttctcaccggccgataaatataacctaaacggtattcctttctgtggaggaatcaaaacaggaggagagctaagatactccttaatatcatccaaagccttttgctgctctgcctcccaagtaaattactgatcagctttcaatctcaacaatggtataaaaggttctaatcttccagacaaattagaaataaacctcctaacaaaatttatcttgccgatcatctcctgtaattctgtcttattctccggaggctgaatcttcttaatcgcattaacactcctttgagttacctcaatccccctttcatgcacaagaaatcccaaaaactggccagccgatacaccaaaagcacattttgtcggattcatctttaggtcatattttctagttctctcgaaaaccttcctcaaatcggctatatggtcccctatttctttagacttaacaaccacatcatcgatgtagacttcaaccaactagccgattagatcatgatatatgtaattcatggctctttgatatgtagctccagcactcttcaagccgaaagtcatgacaacccattcaaataagccgattgcaccaggacactcaaaagctgtcttatgaatgtcttcttcagccataaagatttgattgtatcccgcgttcccatccataaaactcaaaattttgttccctgatgcagcatcaaccagctgatcggctactggcattggatattcatccttcggtgtagctttattcagatctcggaaatcaatgcacaccctgaccttgccattcttcttgataactggaactatgctagaaacccattcagcgtatcggcaaggacgaataaaatcagcatcatacaatcgtttaatctcagctttgacaggttcaagcatatcggctttacatctcctcggaggttgctggtgtggcctaacccctggtttgataggtaaccgatgttcaacaatcgatcggctgagtccaggcatctcataatactcccaagcgaagcaatctctaaactcttttaagagttctatcagcttggttctaaactccggagataagttcttactaataaatgtcggccttggccgatcgcctggacctatgtctatttcttccaaatcatcggccgacatgaaaccttgaccttgcttgtcatcgagatcatctactgtatccttagggtagacgactgaaccccccacgacgccctcaaaataatagcttgggttctccatcttcaattggttgtatatcagaatcggatacttttagaaaatctctatcccagacttttccagataaacaatcaaggctatccatctcccaaagagctaaatcagcactggcaacattaactgacctgtcgactggcacgatctctatcttgtcgccttgccattgaatcaaacattgatgcatagttgaaggaatgcaacaattatgatgaatccaatcccttccaagcaacaagctgtaagaacccttcccatcgatgacaaaaaacgtagtaggaatagttttactgccgactgtcagctccacattcagaacacctttggtttccgatggattaccactgaagtctttgagcaccatgtttgtcttgatgagatcctcggcatttctacccaacttcctgaacgtagcataaggcatcaaatttaccgtagccccaccatcaaccatcattttagacattggcctcccattgacgtagccatttatatacaacggtttaagatgccgattctctgtcccctcgggtttctcaaacactgcctgttctggtgatagaaccaacttagccgattcctcttccacctcgtcgacatcggcttgatcaatcccgaaatcggctggcaaggtaaagaccatgttaatcagtgccgtcacaacactcttcccttttgccaacctctttgcctcatcggctgcaacatcatcggctacatgaacctgattcttaacacgccactcctgccttggctttgctttcctcagccgatgattaatttcttgttcaacctcctgaaggcgttctctgttcctcaatctttgaacccttctcttctgattctttgtgaaagtaccagaaggacaccattgattcttcctgaccacactgtcttcttagccatgatcttgattcacaggacccaatctttgatgaatagaaactcttgtctgcctcagccgattacccctattatatgatcggcttgagctctcgacaatatcactgcacccagggcagttttcaatagatggcaacctcataccttcattccagcagaatctaaagaactcacaaccccaatgaggatcaaaaccatcatcgtattcttcataatgcttctcctgctgcttgtcatacttcctctaatatttgttgataatcttagccgaattcacctgaaaaccccttgcgcgggccctatcggttgtttggctagctgtatgcaccatattaacaggaaaaggattaccatcgaccttcatcggctttttggaatcatcaaacctaatcttgcccccctcaatggccacctgaatctgttgtctaaaaaccttgcaatcattagtagaatgagacctagaattatgccatttgcaatacctctttttgcctaactcctcagccgatgggattgtatgaccagcaggaagttgaatttgcttttctcggagtagcagatcgaagatcttgtcagctttagtaatatcaaaattatacttctcctcttttccagaacatttcacccattggcatggtacgacctttttactccttacccattcggctgcagctatttcaggatcatcctcatcatccatacatgtacggacaaacatgattaactctcttagagctcttcctaacttccgcagacctatgctcatgcagggttactttctgtatcagatgtgacaagctatcaaagtcttcagatgagaacttctccctaattggagcaatcataccgtgaaaggccaaatcggctaactgggcatcagttaaactcaagctgaagcatttgttcctcatctccctgaatctctgaatatactcgtgcacaggttcatcatgccgctgcttaatcgtcgtcaagtcagataacttcatctcatgaaccccactgtagaaatagttgtggaattgcttctccaaatcggcccaactgttgatcgaaccatatggcaaggaggaaaaccaagtaaaagccgatctagacagagataaccggaataacctaactttcagagcgtctaccgccgatgcttcaccacattgagctaggaatcggctaatgtgctcataagtcgacacatcatcttgtcctgaaaatttggagaagtccagaactttgaaccgattgggaagaggaactctttcaaaccactcagggtaaggctgccgatacaagcttccgatctcttttggtttaagcccaaactgttccctcattacgtcagcaattacatcggcccacggtcgttgctgagttgcgccttgtgactgttgctgcatgggctcgaactgaccatattgcgatgcaaactgaggttgagccaatccccctggccgatattgggcttgtggggaaggaggttgatattgataatttaggttacccccttggtaattgtgagggtccggctggatattgcacagcaagtgctcaggaacaacctgaggcattactatgccatccggctgtacgtggtgaaccaaatgttctgggacaacttggtttaaaagttgttgtacaggctgaccaccaggcgttgcaaacccggccgatgcgctcactaaaccttggtgctggatcggctagacgatctgctgtctcaacggcgtttgctaaatcggctgcagagactgctgccttggtggtgtttgctgaactggttgtatgacctgttgctggattggttgtgctggttgcatgacctgttgctggattggttgcacaacctgctgaatttggggtgtctgctgaatcggctgttgctgaatcggctgctactgtattagatcaaccgcatgttgaggcggcaaaaacatagcagcaacctgatcttgggttggccgattcgcaacctgcccactatgctatggatgctctctcattaacagctgaggattcattggctggcctggcgccatagctgatgtagcaggtaggggagttgttgccggtgccgtcggctgagttgtgggtgtaacggagggaactgcctgagtagatgactgaacgtcggtaatcaaagaccgataatttggaaaaacacctccttgcaaatagatcgggcctgcagcctgatgttcagctattgaaccatcggctattgacttcatcatgtttgacagggtattgactatcaccccagactgattgatcaaagcatgatgtacagcgtaatcaacctgatcttggaagttattgaaaaagtcctgtgccacgtcactattaagatttcctccctgcagcccctgagcaccgtcaccttgaactccatgcaccccgtcaccttgtcctccatggaccccttgagaattgttgccttgatttcctagagagccatcggcagcacctttgatactcggctgagcggagccgtctagagcttgtttcccatctccatccttagaagaactggttccaggatcatcagcaacaacttttattttgtacttctgaacaagtgtccccttgcgggtctgcatgaatgagttcaagaactgatcccgtgcttgccgcaacattgcttcaaactctttcttctgctcaggtgtgaatttttctggatcgatcggcacgacgtttccttcattgacgtcagtcaatcccaacttcagcatcttttccttaacagagcctgggctagatggtggtggtggtggtttttcggccatgagggaggattgttggctgacttcttagttgtcccaccaggcgtgccaaaagcgtgttgacagaaaacacgaggcctgggagatctgcttaactccagtgcaggtccaaagctcgccttcgggtgtgctagcatgccagttgatttgatcctgtaaccaacaagaagtagaagcaaagaaatcgcggttaaatctaaaaatgatagccgatcggctagtgccgatgacatatcatttatctttgagccgatgtcatatatgcatcgatcggcagccattaataaataagaagggactaaatatactcgatcggttgcagatattactaatatataatctttatatcgatatatacttaaatcaagtgattgggatagatcggtcgccatgccgagacagtataaatcacttagatcaaaatatatattaataatgagactatatacgttcatagcatagccgatcagatagatctagcatgtatcggctaatactccgataccactttatattaagatattaaagcaagtagaatatactaaacaacagcctaatatacttaaatgcaggaagatcttaacgtaaagggcagatttaacatgtcaatcaagcatataagataaaaagtagttaaatcaggtaagatcggctgaaactccgatgctaccctaatcagcaaccgagaagcaggctagagattgagattctaatcacgactcataagatcaaacttaactgatgtaggtataagtatgaaaagaaggacaatatctagacaatcaagccgttagatgtgtcatagagtggtagatatcctatataatctaagtcaacatcggtatttaacttaatcggctgccttctattgacggacgttagccgattgtaggttagatatcaatattgccagggattatgtaggatatatgataactcgacgaattacataaacaagattagagtgtcataaagatggaagcactaatcccgagaacgcaagtcgtcataacaagttttacctcttgttgaagatcgaaaccgatgcagctcaacccgaaagcaagaactcgtcgaaataacactaaagcaaaaaagggtggcgatgcgccgagattgtattgaacgtgtgttcttaaagttacatagggctcggggtctatttatacccaagaattacaagatatgtccataccagacgcgactattatctctaacaaactctaagataccataagtctttacggcagacttttgccctaagcatatctctaaggaaattacgtaaaacatcctaattaatagatataattgccttctcaggactctatccatgtgcggaaatcatcttgaagcatatcgactcaacccgatgttgtacaccaagtcgtattgccggaatcggttgtatcacctaacccagtctgattcagatttagccgattctagtcgtagccgatctggactccagccgattcttactttgttcccgcaacaatccttatctccgactccgcttcgatcccatcttcacctccgacgctgatattaccaaattctgttgttaacagtgtcgagctcggggcccttgagcgtggcgaagtagctgtcctaagagcaaggtcaatagtgttattgtacctgctctaacggtgttgggaactcaagagatgacggaaggatcccagaatggagggactgaatctactttgagacaactagatctagccgccgtcccctggtcatcccatcgtggatcacgccgtcactacatgcccgtgttaagctcaacccccacatcctccttgcccacattgttcccaatatagcttatgggtctgttaggggagtttctgacaactgcagtttcttctataatctctagctgcgagctcctccatacagttcagtttttcatttagattatgagaatctacagttgtagaatccagaaatgagtttctcaatttctctagattctcacttgctacttttcagaataagctctcccaaacagaccctatttgtcccatacagcacctccacgatggctccttcgtattcgaggccttgagggttaatcgccaaatagggtcgtcggtgaagccattgtggacatggcgagaggtcacacgaaggtgggagaggatggacggtacaccggttcaagtgtttcaaaataaagaattttcactagggatggcaatcgggcgcgacgggcacgggtagttcctacccatacccatgcccgtgagattatttgtgcccgtgggtatacccattactataagttcaagtgccttaattctgtttcggtgattaatgacaaatttaattatatgagactaacatttttatgagcctttctttgactagtctcatttggatatgaaagtaaaaatgatgagaggtatgtattaaacttcacacattctaacttggtctctcttgtggatccaaaatatagtgtgagcttcctatttgatctttattgattatgtgcatatgcgttccttcatatccatatgtatgcacatcttgagggggagcttattctatattttgtttattataagatttctttcttgatttgaaatcatttttcatctcatctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaatgatatgtaccacttcttatctcctactttttgataggttcatatatatgatttccatgttattgatatataagtgtgagactaatgtttactcgaatgttatcttatttagtctcatttacattgagaacatggagatcatgaaggtatatgttttatgttagtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatctatatctttcatatgcaaccggttggtcatcaagtgaaggatgacaaccgatttgttgagactaatgttctcctttgaggtgtgaaaaggaataggtcccattatgatgaggctaatgaatgacaccatgggttagtggtcaccaagccaaggacatcgtcatgttggcaagaatgaagtcaagcttgtaatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagactggatttgctagataggcgccgtactatcaagaggggtctatgaagcgagcttgtggatgatcttatgccatattagttcatatgcatgtaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgatacccgagtcaagagatatcaccgttttactaacagtcggttgagctgaaaagtgacctacggtctgaccgtgggccttaggccggtctgaccgggtctgttagccggtctgaccggcgtggtaaggccagtctgaccggccccactagtctattgcactggtctggtttttggtggcgatacagagccgccagagccgcaactggtcagaccgagccgacggcggtctgaccggcccctacactgcggtcagaccggccaggttgagtgggctcaatgattgccctgtaacggctagttttctagccgttacaaagtagtccggtctgaccggcctcataacggcggtctgaccggcagagcacaaagttggggatttcggttccaacggctagttttggtggttgggggtatatatacccactccccagcaacaagggtaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacagcttgtggaggtgttgcccggtgacctctccgaggagattgtggaggaggcccggcaccgtttgtgagtggtttggagttcaccaccttcggagtgaaggaagaactaccccaagtgatcgaggcttgggtagtcctctccgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgttgcatttacatttgtgctatttacattcatagagacatatttgagcccatatcacttaggtttgcaaaacttaacttagttgcttagttaaccttgcacctcaccttgcctagcaacttaggttagttttgtttaagtgccattaagttttaaaaccgcctattcacccccctctagtcggcctccttgatcctacaattactacatgacgggtaaggatggttgcccattgcccgcgggcgtcttatgcccgcgggcgtgcccgtttacccgccacaacaaaagcagtggaacaaaaagtctacaagcttctaagttcgaattgaacttaaaacatcaaatattctccgcctcggtgtcgtctctcttctagcggcgatagagtaaagggagagaaataataagggaaataaaagggaaaccgtagaaaataaaaacgtggcttatgtattctagtggattttgctcctagcctacatgtaagttagattttgcgggtaaatgggcaaagcgggcatgggtagtgattacccattcccatgccaatttacccatcgggcatagcttttgacccaataagatacccatgggtataaaatggagaacaaacccaaccctaatagggtttttacccatggataaacgggcaaacgggcacaattgtcatccctaattttcacctctagaatccttgagcattagggatgcaagtggggcgggcaagcgcgctttttttcccgcttatctcacttttagttaattttttcttctaaattttaaactatcatacgaaaaatatactaacaagcgagtttttatacgggtagtggattacccacttgcatccctgttgagcatgcataccaacaacatgcacacatttgcactggcctgtttttttctgatcgatcctctatgcactatttcacggtgctaatcaaccaaggaaaaaatatatgttgggcccagaaaacttcgttgtactcatgcttctcgtgcccgttattatttttatccgttcagaatgtctgttccagcagctgctcaacagctctcaagtgttgtctttttttttttttttgacaatctcctgatcatggcacacgcaccgttgcgctacgtgcccggaattctaggatttctttgacgcggatgtctcgcgtcgccttccaccggcgtctacctgcgcctgcactgcaccacggcaactaaccagcacgggctttggatctttgtggtttcgcgctagcgttggctcgctcgcggttaacctgctccggtgttttgatttgcccaaccggccggccgtcgaagtttttaagtcggatcagggcgaacggttttccgggtattcggatctctcttgaagatttgtcgccgatcaaagtcaatccatgtcctatctagtcagggacacccgacgacgacgacgctcacgctgccactgctcaccggagcccgattgggtgaggcgagtcgcgcgtggttagcctctagctacgcatggcatttcccaatgcgcgcagcaccagcaagcgccaatttgcagcgtctccgatccgttctctcctcctccccctctcgtctgcctctcccttcgtccctgcctctctagtctctagcttagctcgtgaggagtaatgcgacgcaggcgtgcagcgtctcggcttctctcacatcacgttacggggaaacgggaagcgataatctcaaaatccgactcctgaaccgtccggtctgccctctcccattgccgtgcgttgcatgcatgtcccaaacacaacgcatgcatgcatgcatacagtgttcgtcgtctcatctatcgccctacactagcctgctttggtatcagcctcagcctctatctccatttcccaatgtgcctcgccatttcaatccctacctatggcagcctagctgccgtctccagttgagggagtaaaagccatggccggcgtccctctgtcccaatattgatcattcaggtcccggcctctctctcctcttcattgtttgtgagctcgtgatagctgattaccatgcacacaacatgtagacaagcagtaaagttgtctttaaaactttccgtttgcatgcacacagcatacttcttagaccctgtttagtttccagaaagtttttttcaaaaacataacatcgaatctttgaatacatgcatgaaacattaaatatagataaaaataaaaactaattgcatagttaggggagaaattgcgagacgaatcttttgagcctaattagtctatgattaaccataagtgctacagtaacccacatgtgctaatgacggattaattatgctcaaaagattcgtctcgcggtttctatgcgagttatgaaattagttttttcattcgtgtccgaaaaccccttccgacatctggtcaaacgttcgatgtgacacccaaaaattttcatttcgcgaactaaacgggccttacttttcagatttgtattcctagattggagtatggccttgtttagatctcaaaaaaatttggtcaaaaaggtcacatcaaatgtttgatacatgtatggaacattaaatgtggggaaaaaacaattgcacagtttatatgtaaattgcgagacgaatcttttgagcctaattatgtcatgatttgacaatgtgatgctacagtaaacatttgctaatgacggattaattaggcttaataaattcgtctcgcagtttataggcggactctgtaatttgttttgttattagtctacgtttaatatttcaaatgtgcgtccgtatacttcaaaaactttacacccaaagaattaaatacaccttatatcatatctgtactaaagttgcacttatatttagatggaggaagtatcttgctggtttgatcttttgttattgcaaaataaacctgatttatcatttcagagatccttgttcgggcacgcatgcggcaaccagtaactcgaaaaatttcagctgcatgcagcatgctgcaagcctgcaaccaattgctttacaccgatgtatactgaattaagctttcacagaacggaatgcgcgagatcgatatgaatctcctgcattgatgtctttagaaccgcggcgaacattttctgtgacaatagactgaagtttgggcgcaaaaccacgatacgagcatttcccaacaaaaaaaatgcttgatccgtttatcctgaaggcactctgatctgatcgcgtagtagtcaaagcatgcaatgcgatgtaacaactcgatctactttggcctcaagcagtcaagcaagcttcaattcactcccaaactcgtgcatgcattgaatctgatcgatctaacttggacattgcaaaagtagcctatacggggacgcagagtacagcgcatagtacgtgcagaggctacatgtacgtacgcgatgaatagagcgacgcgatggatgctagctagtcctctaccgaaaggggctaaacacacgagatctcgcccgtaaaacgaaaaatctgttgccacgagcaaataattcccatcattcccgaggacgactacgaggagaggagatgcttcgtacggcttgcgcctcctacactagatcgactaggctactctacttctcttctggaaaggcaagttggcacgcattcactgtgcggccgcgcgctagctgcgtgcattgcatgcgctccgctccgcagcctcctttccttcctcttcccccattgttttcagagcccacgtcgaacagcacgcacgcacactttactctctcctttttccgatcgatgcggccagctgggcaaaaaaaacgcgtacacgaaggaaaaggcccttttcacgagtgaaaaattgcttttcatttcacttcacaatgggcacgtacgcccttgatccatcgattggagtaccgacgacgatgcatgcacgcatggatggatcacgccactcgccgtggtgatctacgcggcgcacggcacaggggcggcacgcgactcctcccgtcctcacgaaaacgtcgaaacgtacgctccccttgaccgcaacgcgacacgatccccacgctagctacgcctccccctgccgcccgcgcgcgcgcacacgcgctacggcccacccatcgcccacctcctcacactcccatgcacgcttaaaaaccacgcacccgcggccgctcgcaggcagcaaacgcatcacaaacgcgagcgggcgagccgagcgagcgcgaccaaagtcagagcaagccatggagacgacgacgacgacgttgggcggcggcggcggcgggcgggcgggaggcttctccgatccgccgtctccgctctcgccgccgctgtcgccggcctcggcggcggcggcggcgctggcgaacgcgcggtggacgccgaccaaggagcagatcgcggtgctggaggggctgtaccggcaggggctgcgcacgccgaccgccgagcagatacagcagatcacggcgaggctccgggagcacggccacattgagggcaagaacgtgttctactggttccagaaccacaaggcccgcagcggcagaagcagaagcagcagagcttcgactacttcagcaagctgttccgccgcccgccgccgctgcccgtgctccacaggccactcgcgcggcccttccctctcgccatggcgccgacggcgatgccaccgccgccgccgccgccggcgacgacgacgacggccgcatgcaacgccggtggtggtaagccaaaccttttctcgtgctttaaatgtcacgtattaaatcttctctttggcatgtcttgcttaattagctttacacatgggtgtcatgcacctggcatccattcatttttcgtggtattcatgcgtatggaggtcaaagttctcgtgctgtcgtttcagttcttgcatttttcatgcatgggccaataaatctatacgaaatcgttttgtacatgcatggctggcatgacaagtatacttggcgtagaacatccattcttcacagttgaccttgaccgctttgttgcacaacggcatgatgtataacacggtagtagtactgccgctagttgtctatttgtacttatcctctgcatgcacgcgttgcgttgcatgcaatcgcattacgcttgcttagctagctatcactattctgtcacgatgtgcatgccttgttcatgtctcctactgtaaatccgtccgttttttcttccatttcttccattgtttcgtatcacctgtcttttctcctctgcccccctatatacagtgccagtggaacagagagactgcctattcatggtcacacgatttaacgttgcctgcctgcctatgtagcttctgctgctacccttttgtagctccattaatcttctgtgcactgtgctgctgtcatgctgtgcatgaccgagggtagaaggaaatgaccatcctcctagctagggccaaaacggccagacacaaccttccacatcatcctttagctgcttcctttcccatccaagaaatgctgcccttccatctcataatgttgggacatgaaaatgtgtcccatgagtggtcggtgcacgtgtcatccaatccagcttcgagtatcgttgttgacattggcatgtttgatctgttgttcttagcatgaccatccatttgatcataatgcgcgcgtttattagattctatttttactacagtttgtgtttgcatttcaattcttaaatgccaattctccactccatgttctgcactgatccatgcacactttcgatccttgcagtgatgttcaggacgccaagcttcatgccggtcgcgacaaataacgccagctactacccgcagcagcagacgccgttgctgtacccagggatggaagtgtgtccgcacgacaagtccacggcgcagccaccggccaccaccaccatgtacctgcaggcaccgccgagcagcgcacacctcgcggcggcggctggccgcggcgcggcggaagcggaaggccatggccgccgcggcggcggcgccggtgggcgcgagaccctccagctgttccccctgcagcccaccttcgtgctgccggatcacaagccgctccgcgccgggagcgcctgcgccgccgtgtccccgacgacgccgtccgcgtccgcgtcgttctcgtgggagtcggagagctcggacagccccagcagcgaggcgcctccgttctacgacttcttcggcgtccattctggaggccgctgagcgtgaaggtgagagtgagtgagcgtagagtggagtggagtggagtggaagttgatatcttcatgagtggacgaacccgtcgtgctttttgaaacttatctgcattgttgcatcgatcattgcatggtttaattggttaagggattggaaggtgtactgcttcatcaacttgaagtgtttcattggaatggaatgatgcatgttttgaggcggctgtgctctcacaatttgttcgtgctctcaagtgatttttgttttaatcataggtgatctttttttttctgatttgagtttgacaggtagtcgacttcgacactgagtgttgcagatattttacgaatgtccttagtcagagtaaatgttgaagatttttttttctgtggggctcgagtttggaccaaaaaactgatccactcaaacaatggcccagtaacaagtacaatgggcagtgatggagaagcaacagggctcaaggcccgcacaccttcacgctacgcgacccaattcgacggccccagcctcccaagtcccagcaccagggccaaatccccaacagaaatcaaactcggccggcgacggcgagttcccttgtagtagctgagttctcttcagaagcggactttccatagagcaaagcatcttctacaagaacactcttgagacgtcaatcgatgagacatccggcgacggttcatttgtttgtttttttagttgaaggtcattttgttgttgcatgcgataagttattcgaaaagagacagatggaccgaacttgtccacttctaaagtgctagttaaccaataatttaccgctccggataacttgacaaggagctaggctacaagattcctgctcatctacagttctactgaacttagtgaagtcttggctgacggaggacgaaagggaggccatgactatggtgaaattattgcccgcaatttgccttatcagtttccactagtccactctgcacgcttcatattgaacttagctagcatccctatattttctcttctataatagtatttttttcttcttttattattacaatatattaaaatgataacataatttaaatttttgtactaattttaccaaactatcaatatgtaatattcatattgtattgtatgtacgtgatagttattaattatttttaatattgaatttagttctttctaaattgtattgactttagtctcatcttccaatactcatttttttaattctgattttttgttacatataaaatttattcatatatttcttattttagaaatcagaatttcagttatttctaaataatactcctatgtggactctagacccctctaggcttttcttctaatatttatttttttattttgaatttttattatttttaattgtatttctatatggactctaaactctacttttaattttattatttttattctaaattttagttaattataaattactgtatggactctatactcttcttctagtatttctttcttttattccgaatttcggttatttcttaattgtaatcctagatggactctatactcttcttctaatattctttattttttcattccgaatttcagtgatttctaaattgtatttctatattaactctatactcttctttcaatattccctttcttaattccgaattttagttatttctaaattgtatttctatatgaactctaacatctacttttatctttttttaaaaaataatacggaattttcattggttctaaattgtataccggaatggactctagtatcatgttttaatattccttattttttaatttcgaatttcagctattttaaaattgtatttatatatggactctgtttttttatccgattaatatgagaatttctagcccgtgagagcgcacgtggaggctccttttcctagtaatttaataatagatgggccaaaatgtctttccgtaaagtggaattttacagtcctgaaaatgtatttttaggtaactaaattttatactaaaaatttttgataccttaagatacgtagtacctagaggtaccaaaattttatactagaaaatatgatacctctagatatctttccaaggatgggcagacttcacaaagtctagtagatttttggaagaaaaacagatataggcatgtttgggttctcctataactaaaagctcttccaaatagattttttttcagattttaaaaggttatagttatacaatgtgaaaaataaactcgaaatcaaaatcatattttcctagtctcaccagctagattttcaacgggtacttctagctccttcgaaaagtgcaatcgtacaacattttttaaaaccaatcatctaaggattttgtagccacaaaaagaaagtaacgcgtcgtgttcttcatcgcagtacttctcagatgaggaaataaaagagaggccgggcagaaaggaggcacgcttatttgttgacgcctagactttttagggtggttattggtgcggcatccaaccatccaccatcgatcgactagttgttagacaatgcacacatatttacagatcgtcacatgttttgtcgtcggtttgccggtcatggcgaaaagacacaaggcttgatttgggcgatgtatctgtcccgcggttacgcgagcacgcatgcacgcacgacgacgacgcgaacctaacaatcactgcattggcattgcttctcctgatgcacgcgatatggcctatgggtactaggggtctgtttgtgaaggtaaaattatgagaaatactagtcggtagttagtttctgagaatttgaaaggttaggtttctcaccttctaacttttaagtaattcattttctggattctatactacaagttttcataatctagattaaaagctaaactgtttgtgagagattctgattctggaagaaattgcaattgctagaagctagaccaaactgaagccaaaacatcgcaaaagtctagtgctcactagtctcacatctgaaatatgcgatggaccatttaaaggtttgcttttcagtgtttgcttagttctatccaggagtttcaggctttcagcttggggttgggattgaggaagggaaattgtgtattgagatagcgactaattcgtgttccttgctgaaaactgccgataccagcaatgcttagaattaactattgtcttcagcatatgtgcagacgtctaaatagtagtagtagtagtacattttgaggaagatctgaacagataataccaacgtatctgtatgaagttgctcatatgcttcccaaagagaataacaaaagagacatcaatgcagctaacatcgagctattcgaccagatgcagcttataaactttccatcagcaagagaccaaacgacattttaggactgaagagtttcacatggatcggttactctgtgatccacaggaaagagcagacaagtggccaggcagccatctgcctgacaaaaatttgtcgacaatcagaaagtgtgagggggaaaaaaaggtttattatttctgctttgtacagaagttgatggattttaaaaacagcacgaaagattccttcagatctccatcatttctggagttcttttgcatgccagacagctagagggctcctcaatcatgttactaaaataaagactaatcatgtgccgagcttatgcacaagatattatagtctactactagttcgtgccgttcactgtctgatatgtttctgctggtttcctgtagtgaactagtgatgaaaagccttcttaaaataccttttccccgcaaaatcaaaatacattaagtgtgggaaaatttgcaactggccctttcttctgttcactaaaatatcagaatgtcctggaccgctatcctgcaaagaagacatgcacatgaattgatcaagcctggtctttccgagagaaaagaagatgaaaagagagagagagagaaaaaagtcgctgacagatgacgaccagagatcaaagtgataaaggcctcgcgatcttatcagatctaagacaagtggttatagtacagaattattgcagcgtagccagtacaagaagcagggacgttacgccgctttttgcagcacctgaacggtgtagctgaggttgatcactcctctccttcgtagtggcggagagcgcgacccatgcggctgcacctgtcccaagctttcaacttgggtggcgctgtgcgagagagattcttccctccatacccacagccacccactcccaccctcccaataatgtccatataaaataggatgtaggctattgatcagtggctgatacgtgggtccagactcaacataagtgtatgctactgcaccagtcctaaatacaattccactgagaaaataggagtaacggccatcacgaacatgaaagcaaaagaaaagatggagcatgatcgcaacaaggcctggcgagcgagtcatttttttcctttttaaaactcatgcatttatttatataaagtagattagaaacataaaatacatgagttgttacagtgctactgggacacttccagttttgaaaagaagccccttgtgaatgggcaaattacacttttgcccaacaatttgcaaaaaaaaaacttaaaaagaattgaaaaaacaatcaaatccttcttctttggtcttcgtcaccgatggaaaatatttggagctcacttccggtggagtgtgaaatcaggtgagttgcatgaggtggcgccattactcgatccctgaagaggcctcccacacgtggaggttacgacgttgacgagcaaaatgaaatattagcaacaccaattaagatttacaccattgttcttgagagaaatcggtaaaaaaccataactattccaaagatcacagccagatgtatttcaccgtgaaaaaggcaggaggcgtacccggttgaggcccccttggcgcaacctgaaaattttagccaccaagtgaaaattcgtcgccagggatcaagcataaggccccttccttagaaagaccttgccggagatgtttatgtaggcaggcgatacctctctttgtacatatctggaggcgccctaggtagtacccaggagaagagtcccagcgatggagtaaatcgcctctgagaagaagcccgacaacgctcacccagatgccgggacaaggacggccaacgccaacaaccacctcgagaaccaaaaggaaaaagaccacgggaaaaacctgaatcaataggagaagagggacttgacccctttcccggtcttcatcggcgagaagccaccttaggccggaggaaagagagaggagtagggaagtggaaaactttactgtagcaagtattcgcgagaggtctactgagaggtccgccacgcctgttgtgctcactccaaattttccaagcccggtgagcgagtcatacgtgcgtttcagtgtcatcatttttcttaaaaaaaacgcgtggcctttttgctctcctctactgttgttcgtgagtgtaccttgctacgatcagggccggccctagggctatgcagccgaggcgaccgccgggggcccatgatggtcgggggcctatgatggtggaggggccaacacctaatactagtagtctagtacctgcctattgtctatctggaagcagaaacgtccgagagacgataggagttgtagcgtcgtcggcaactcggcagacgacatcgcatcgcacagggcacaaccgcacaagcgcacaacatcgtcgacttgttcttgatgattttgcatcaagaaatgctcgagaagtatcttttcatgagaaataatggatatgatgcgattctattcttcattaaggtagtgatattagttccaaggtacaaatttgatcaactttatttttcgataattaccagacatgttaagatttaatatatggatgtatttgttttgcaagtaaaattaattagtgtctatatatatcataaaattttttatatagcttagaggacccatcgtgatgaattcgcctaggaccctcaaaatcataggaccggccctggctacaatgccagtaggttttctactagtgctcatcagtaattcaggatgataggttaatcgtacacgctagtacttgtggaaaaataaaaacgaggatcctgagaatctgatcccagacaacccatcagtttgcatctgaaccaacatatgagacctgagttttgcaaccagttggccgagccaaatcgaatttctcagttgaatcacgtcttactttgacctaagcagcagtgtactagtgtactcgtagagttgtactgccctcttctgaattttctcagttggttagcaaattcagtcactatgatcgtcagtcaagacatggcacttataaaatttcttccggttagaaacagtcatgaaatgcagaagacgtggtgaagtgcatgtgccatttgcatcgagaaacaaagaaaacttaaactgccaccagcagtgcacaccactatgccgctcagcatcagctagtatccgggggagctctcttctgaagcttccatgcaggccacatcacgcttgcacttgccgtagccttgtgccgttctgctgccctcacaaactcggacaacgccaccggcaataatactacaggctacagcttcccacttgtcttgttgtgttcgatctgtgtgtgcgctgaacagagcgaaacagaacacggcaacagttgagacttcagatcgaccaagcaaaaaagagagaaaagaacaaggaggggaaataatggaaggaaacgcaccgcaccaccgcaaccgctgctgtctgttcgatctgcttgggggcttgttcattcagagagagacctgcacttttcgctttcgcattgggcgcttttgggggcaatcattcgtggggttttttcttctcaacgaaaaccaccggcaacagcggcaattatgggcatcgaaattatatcgggcctagccggagtggacgacgtgtcgttttcccactctcgagcgccatcgccacacacagtgtgatatgtgtgcgatacagagaccgcttgagcacgtcgtgcgagtgcgacgtccatcccagcgtgctctgctccggccactttctcgccggcgacccggcactaacagtcagcggcacacaggtagcagcaaatgttaactgcaaatcgttctgttcccaagtggaagaactttgaacatcttttttcctaatctgaaatttattagtatagttcatctccaagtggaaataaacatgcattgctttgccggaacgggtaaccggctgccaaccgacgagccgagttactacattgctgacaaaatcagtgtgctcaagtgctcaactgatgatactgatacgctgccgaacgccgaattgccgataaattttctgggttaggccgggtttagttactaatattttcttcaaacttttaacttttctatcacatcaaaacttttctacacacataaacttccaacttttccatcatatcgtttcaatttcaatcaaactttcaattttagcgtgaactaaacacacccttagaccttgtttagttcccaattttttcttcaaactttcaacttttctattacatcgttccaatttcaaccaaatttctaattttaacgtgaactaaataaaggttcgcctcccccactgccagccgcgcgcgcaagcagccgagaatctcgacacgccacgaactgatcgagcgaatgcaaaatggagagatcggaatcggacgttggtcgttgggccatattgcaatgcgccgaggcgcgtcgccctgttcaacacctgcccacttcgcgcagccgagacagccacacgtgcagtttactagccttggcgccgagcgctgagcacggctgcacgattcagctcagcacccaccgtcgttcaccgatcaatcggctagacgacttttcactggagtaatcacagaggacagaacctcccctaggaacaccatagctgcaagaggatgataagctcgtcggcatcattgtacaagtatttaaccttcaaatttctttattgtacaactagatacgtgggttgtagctgggacttggggtgcacgtatggtaagttattgtttaggttaacgagactatggtggtttcaaattggaggagagctcttactattatggactaaggttgcgttcgtagtcgaaggttgtgaactttagctccccacacacaaaacaaaagtgattaagtagcgtattattaattaagcattagttagaataaatttaaaatagattaatttgatttttttaaacatcttttatatagattttgttttttcaaaaaacaacgtttatcaatttgggagggaaatatacatgcggtaaaaaaaaaacccaccctaaaagctactcccaccacaggattagacatctaatccgccattttcctgccagggcctatatataatgcgctcaattatgagcaaaaaaaattgctaacttggcatgtggcgatgagctcacgcacggtatttttctcagttatcaccgtgtgtttggttgagaatatatttgggaccaccaaatcttgttcgctctagaaagtgcgttttaatagtcgtttttaggggttataattcagacgactaatgatgtactatccacgaacgatagtccaatgaggatgcatattgtggcacaaagtacaataattcactcaacttggatagggaggcctctaattaattatatggggcagaatttactaccttgctaacaagggaatttacagggtaacacgtgacacgtcatcgatgaggtaatacagaggtaaaatcatatattatcatgcattgagaagactgaagattgtgacgggagaaagatgcatttcaacctacattggagcccactaaagctgaagcaagcaaaaattcctttattttcttcctttgtcgtcaggagaaaatgatttttttttactaaaataccacaattggttaagtgtgcgtggttttctttgttacgctagattaaactaatcgtagaataaatttaaagaagcataatagatgctcacacaattaagtattgaaggagtgcatattttctgttcaaattaagagtagggttaaagtacaaaagatataacactaaaaaagaagaggaaaaatgcgagtggtaaagccgtttgtggggggtttataacttataaatgatgcaaggtttttctaagatggaattggaaccatcgctatcagacaagcaccagcttcaacaggccaatctccaatctaatccacctttacgacattcaaatgacgaactttcaataacaggacacaaatttaatcatatcataagttgattgtgttattagcgcaaaggcccaccacttctgttctactctaccaaccaccatgataagagagaaatcagagatgcgataggttgctttagtttttcctctttgataaataaacgagcaaacagccttggctagagagtacagagataagctcgtcaagtcaaacatgaatgccgctacatttcaaaccttggtgggacctagcgatatcccaacaaccaaagcaaataattctcttgttgtgtgtatatagttgggcaacgtatcctatgcacacaggccttcacgtgtacacaagtgtacaccaactaaaaaatatcaccaaaaaatctagaaaaaatcatatacatactttcaattgtattacacctagggttaaaatcttaacgttaaattcattatattttagccgtaacaaaaaaacaaaaaatctgacagttttaaggttgtaattttgtcagaattttatcttttttgttattatctatgtagaatgaatttgaagatgtgactttgcacgtacatgtatgaattttcctagaattttttgtgataatttttaattggtttacacgcgagagcctgtgtgcataggatacgctcccatatagttgagtaactatgttaagcatcccacttgccaaatgacatcttaggagtactaatctattggcgctgtagcagtaccacagaaacatgaaaccgtgtgcttatcatggctaaataatgctctaacgctctgtttggaatatatgattgttgaaagcaaaacataggagatttttttaaggtctagtggcaaaaacaggagtttttcagctgttagagatcaaataaaaaactttcctatatatacggtgtacttatcacagttagtccatctaggaaaaaattacatggaaatcatttggacagatgcgccaaacaacccgatagatcgacagcagatgaacggcaagcaatgcgagtctatcaaccctaaccttgatattaccagaccctctgccacaagaagaagaatcgccacaaagatactaaccttgataagatgtccgaacgccacgctgatttgacacgcaatttcggtcgtttttgtggctaagcaacctggtagtagtagtagatcaagcacgcagcctttgcctccaatccatagacagcgatggctgcagtgaaacttcgcaagtagagtagtagcagtagaaagaatcgcgctttgctgaaaggctgaaagcaatgtgggagaaggggaggagagaggggaggggaggggacaagtatcgcggaacctgacccaccaaatagaagttgcatagtggtgggtggtggccgcgctgctgcgcggtgggtcgcatctgttgcaccggaaaaggcacccacacggggaagatccgggaaagctctcgttaaacgccgcccggccatcacctcaccgtctagacactgtgtgataaaaagccgaacaaccgagacgagaagttaaccgtgtttggttgggtagataactagattgagtctgtttggccggtttttgcactaagctaatcacggtttaaaacagacggggttggcttgtgccctaacggcgtgagaggcgtgacgggcggcgccgtcgtcgtcgtgttcggccgcatccggtggagggcgcttccggatctgagaggccattataagcggtcgcccccacgagtaatctcctcttccccttttctcccacctcgccgcgcacccctcccctccccatgtcctcgccttcctccccgcgctcttgctcccgcagcttcacgcttcccccgcactagtacagactcctgatggtggtggaggtaaacctcggcggctaacccatcgtccaccgcgcgcggcggctctgtttttggtttgggcggcattttggtctccttgggggtgtggatttgggttgggggggaggagagctgggtgaagatttgtggcggaaactgttgggggggaattgatggtgggattcatggagtgcgtgcacgattggttgctgtgggacgccgtcctggaatgcggagggatccggaggccaccgattagatagcggccgggggaggagggagaggagaggagagaggagcaggcggtggcagaggcggaggccgtcgccattagcaccagtcaccccgaggcgcgagtcaccaagccatgggggaagacctcgtcaccaccctgtccatggagaacggcggcggtggcggtggcggtggccaccacagcctctgcacccttctctccatggatcccgccggccacctcgacgaccgcgccgtcggggtcatggtgcagccccgcatcggggacggcgccgggcgcgcccacgccgtgtcgctctccggcgcgcatccgccggacatcaaccagccgtggcagactgacctctgcgacatgctcgacgtcagcctcggcccgcagattcaggtgtacgacgccgaggcgctcgccgtgctgagcagtgccccgaaggctgggaaccgcaaggccgccaagcgcggggacagcatctggggcgcctggttcttcttcacgttctacttcaagcccctgctcgcggacaagtgcaaaggcaaggtcacccgggatgccaacggtgtgtcagggtttgacaagacggatctccggctcgacatgttcatggtgcagcacgacatggagaacatgtacatgtgggtcttcaaggagcggccggagaatgcccttggcaagatgcagctgaggagctacatgaacgggcactcccgccctggtgagccgcaattcccgttcagcgttgacaggggatttgtgcgatcacaccggatgcagcgcaagcactaccgtggactctcaaacccacagtgtattcatggaattgaggtggtgagatcaccaaatcttgcaagcataactgaggtagacaggaggaggtgggtggagcttacagggagggagctcaatttcgcaatcccgcaggaggcctgtgattttgggacatggaggactatgccaaacacagagattgagcttgacaggccacatcctgtcatgaagggcaacgttcatcaacacccaaagaagctgcttaatggatctggcttgaatttgtcatcaccctccaatcactcaggagaagatggcatggatctctccccagttagcagcaagcgcaggaaggaggtgtttccgcatgccatggatgaggaatgcttcttgccactcaactcttgcggcgagaggacacaacaagatgtggagatgcattcagtagtgcagccttcatggcagcacgaattttctggggtgatgaaaaaggctcgcgggcctgtgactgccgccaagtcgatttatgaagatgaccaaggctacttgataatggtcagcttaccatttgttgatcagcagaaggtgaaagtttcatggaggaacagtcttactcatggtatagtaaagatcctttgtgttagtacagcccagacgccatacatcagaaggcatgacagggtattcaagcttgctgatcctatgcctgagcactgccctcatggggaatttgtccgtgaaatacctctagcaactcgcatccctgaagacgctaagctagaagcatactttgatgaggccgctgcagtgcttgagatcatggttcccaaacgtggaaatgagccagaagaacatgaagtaagagtctctatgcgcccccctcaccttgcagctaacgatctactcctgacataaccagtggaaggtctatcaaccatatagtcttgtttctgaccaccagatcaatgcccaaacatggctgagaaggtatgagcatgactgtgttgggagttttgctttctgagtatttgtcgtactgcactaggcctcttcagcgaagtctgctgaaggctactcagtttgttctagtatgttatgatgggtgtctttttagccctcatgctcttctcctttgtagaatatggctagattgctttttctagaatttgtactgtgttgaattaaccagaaataaattgtctgaattactattccattcttggatcatggattgtgggtgttttgtttagcattaagatatgattggtgggtaagaacctagttgcatgtgtcatgtgccaatcaacacaggaatgggcatatgcaggattgccttgatcttctcctgcagagatacgttgaattctagcagttagatggtctttttggatatggtagtataggttgtgagatggtgaacattgctgcgggtctgcagagtatatgcgcgcccaagaactcactgaatgcaactctttataggattatactaaaggagaagtagttcatcttccagttaggcttgcaaattcgaaagcagctgactacagaagccaaccatgatttggtagctcagctgtgtcaaaccgtcaaggacactctgatacagcagtgaattgttgatcggcaaagaacttgtgaatagcagcagtgaaaacctatacaactgcctacaaaatttgtttaaactaaactatggcactaatcttagtcaatctcaaagattttttttgtgtgtcgattcctaaaacaagtcggcattttgattgatatttcccttaggtttagaaacatgaaacggacgtgcaattcgcctattgctcctaaaatttggatgactccctacccctagagtttgggtcaatcaggtcagggcagaattgcgttgcatatcaaaagaagctgaattcatttgtgttggtcgcagccgcaaaagattgatttgatcctgttttgaagaataaaggaaaagaaaacagcgtctcaaaattggtcctgttttgaggaataaaggtaaagaaaacagtagcaactggctaatcctcagtgtgaggaagaatggaaaaaaaaaaaagaagacagaactcgctagtcattgcatcccaccaactttaactttgtctgacgaaaagataagggcaatagaacaaacttgcggctaatcctctgtctgaaactgcgaccgaacgaactcgtgaagcaggcaagccgcaagccgcacaaaaagagagagacagagcgatttaggtcaaagcttaaactatttcagagcaagttcaggtaaaaccatacggcgatacacacttacaaaagcttcatcgcacgaaactctcgacggctaaaaaacacaggggatcacacgacgccagccacatcacacggttcagactcccttccagccggaatcacgtaggaccaccaccagcttaatcgacctcctcgatcttggggcctgcaccgctgccacccgccggcgcgtcctcgtccatgccagcggcgccgcccatgtccgcgccggcgccctggtacatcttcgcgatgatggggttgcagatgctctccagctccttcatcttgtcctcgaactcgtccgcctccgcgagctggttgctgtcgagccagttgatggcgccgtcgatggcgtcctcgatcttcttcttgtcgtccgccgagagcttggaggcgatcttgtcgtccttgatggtgttcctcatgttgtaggcgtagttctcgagcgcgttcttggcgtccaccttcttcttgtgctcctcgtcctccgccttgtacttctccgcctcctgcaccatcttctcgatctcctccttgctcagcctgcccttgtcgttggtgatggtgatcttgttcttctgcccggtggtcttgtcctcggcagagacgttgaggatgccattggcgtcgatgtcaaagcagacggtgatctggggcacgccgcggggagctggagggatgccggagagctcgaacttgcccagcaggttgttgtccttggtccgggcacgctcaccctcgtacacctggatcaggacgccaggctgattgtcggagtaggtcgagaacacctgctccttcttggtgggaatggtggtgttcctcgggatgagcacggtcatgacacctcctgctgtctcgagccccagcgacaccggcgtgacgtcgagcagaagcaggtcctgcaccttctcgttgccctcgccgctgagaatgacggcctgaacagcggcgccgtatgccacggcctcgtcggggttgatgctcttgcacagctccttgccgttgaagaagtcctgaagcagctgctgcaccttggggatgcgggtggagccgccgacgagcacgacgtcgtgcacgctgctcttgtccatcttggcgtcgcgcaggcacttctccaccggctccatgcacttgcggaacaggtccatgttgagctcctcgaagcgagccctggtgatggtcgagtagaagtcgatgccctcgtacagggagtcgatctcaatggtggtctgtgcggtcgacgacagcgtgcgcttggcgcgctcgcaggccgtgcgcagccggcgcagagcacgcgggttgccgctgatgtccttcttgttcttgcgcttgaactccaggacgaaatggttcaccatgcggttgtcgaagtcctcaccaccaaggtgagtgtcaccagcagtggccttcacctcgaaaatgccctcctcaatggtgagcagcgacacatcgaacgtgccaccgccaagatcgaagatgagcacgttcttctcgccggagctggtggccttcttgtcaagaccgtaggcgatggccgcggcggtgggctcgttgatgatgcgcatcacgttgaggccggcaatgacaccggcgtccttggtggcctgcctctgcgagtcgttgaagtaggccggcacagtcaccacggcgttcttgatgttggagccgaggtaggcttcagcgatctccctcatcttgatgagcaccatggaggagatctcctcggcggagaactgcttctcctcgcccttgtactgcaccacaatcataggcttatcgccggggccagggatgaccttgaacggccacagcttcatgtcactctgcacggacgggtcggagaaccgcctacctatcagtcgcttggcatctgcattcaaaattgaacgagattatgagtcagattgttcaattgaattcatatgaaaattcagcttacaggtaaagcagagcacagcaggcatgacaagcagtaaagccagcttaaaaattcatcttacaggtaaagcagagtacagcaggcatgacaagcagtaaagctagcttaatttatcaatcagtaagcaatgtactaatacaaattgtgggtatatatttcgctcaaagcaaattccacgagaatatgagttgcctactccctgtgatttaccaccgcattactaactagccaacaagcagaatttcaagacgaacgagattatgagtcagattgttcaattgaattcatatgaaaattcagcttataactaaagcagagtacagcaggcacacaagcagtaaagccagcttaatttataatcagtaagcaatgtactcgaaacaaattgtgggtatatatttcgctcaaagcaaattccacgagaatatgagttgcctactccctgtgatttaccaccgcattactaactagccaacaagcagaatttccagacgaaaattccatagaacaaaatgcaccactgcaacaaaatgtaacatgtacaactagcaaactgttcaattcaatctcttgacaactagcaactcctatcaatttcaatgttcaaccattcaagtacagaccctgagagttgcagtaaatgcatgatacttgtttaatataatccttattctttggttttatgagattagcaatttagcacacccaaacagagcatagatacaatgtttaaattgttcagttcaatctcttgacaattagcagctcctatcaatttcttgacaactagcaactcctatcaatttcaatgttcaaccattcaagtacagaccctgagagttgtagtaaatgcatgatacttgtttaatataatcattattctttggttttatgagattagcaatttagcacacccaaacagagcacagatacaatgtttgtcttcgtttcggagtgaaatcaacatcagcgcaacccaggaacatcttaataacgaatgcatccagccatccagatgacagttcaatctagattcgaactagagcgtgcaaaaggactagtaacaacgatagctcaaaaaaaaaaggaagaaatagcaggagcacgtaccgaagacggtgttgatggggttcatggcgacctggttcttggcggcgtcgccgatgagccgctcggagtcggtgaacgcgacatacgacggcgtggtgcggttcccctggtcgttggcgatgatctccacccggtcgtgctgccacacgccgacgcacgagtaggtggtgccgaggtcgatgccgatcgccgggccctctcccttcgccatctcgcacgaacaggaagatcgaacagtggaaaagaaaaatccgacgggaacaaaccaaacctgatgagatctcgagatctgatgagattgttgcgagatttcttcgccttgcgagctcggaattcttttgcaaagagttgggggacggaggcgagggggagtggttttattggggttgaaggtgtttcgagaatgttcggggtgcgccaatctgggacgttggattgagatcggatgggagttctggaagggtctggatggtacgcagaggccaccgccagcgccaggaggggagagtggggtcgtcggcgggtgacgcgagttggtgagaccctgccctccgtgacgttgaacagtccagtatgttctacagttaacgggtttgttctgtggacttctatcacgcccgcagcccaaccgttggtcgggcaatttttagatgggcctgagaatatgctcgtgcacgagggcctcgaaaagcgtaatggactaagagtagaccaaaacccaaacatagcaggcctctgcccagatggacaaccaacacccactttttcgcggcccaaaataaaccagccgataaaataataagtccactttgacacccttaattagtggtcggatcttattcgcatccctcaacagtaatatcagatatcttgaccctccaactattaaaatcgatgcaatttgactcccttaacagttttcatggtgtttttcactggcttggcacgttaacttggcccttccaccaattaagaatgtggagcccacgtgtcattctctctcttctacccttacccctctcgatctccttcctcttcccaattcgggattcggcccttccttctagccggcttcaacacaatggcggtgacaacgcgccccccccccccccccgccgcgcttgcatttgatgcccactccactagcctttccttggcatgcaccatcacctcacgcttgttgtgcgcctccatgtcgtctaagtcgccgaagtcgaaatccgacatggttgcccccagccaagaacggcttggggtggggcggggggaggtagggggaggggcgatggcttgccagcgtcatgggtgtccgtggaggagaggaaggggtggtgcaccaactcatcgcagctccatcgcttgccggcgtcacggtggaggcacttgttgaggaagtcgcggcacgagtcagagacgcacactgggagtgacggagcgtggggctcctcaccgggagaccgcgcaggcccccctttgccggttcggccgggggtgctaagtgaggttctaagcccttgatctgtggaatggttcgcgagagagtaaatgcgcaagacacgggcgatgtagacaggttcgggccgctgagaagcgtaataccctactcctgtgttctggtggatctgtgtatgaaggagttacaaagagctggagagcaagagagttcaaactctagagcccctctcactcctcctttctccagtctaccagctcaggtccccttcccccttttcttttttttctttccccctttggtaggcatggtcctccttttatatctcaaggggataccacatacaccatttctacctaccctccttttgggtggggacccatcctactttgaccaaaacttggcttgtacctttgtctgacaccgggataaccctgtcctccctcattaatgggcggagatttgcaatggctgctgtccgaatgaccctccgatgggatgggtcataccaacctccactccgctggaagcaggtgcaacgtggaagcacggttgtttgctgatgacgcgaccggcgtcagaccagtcacagaccggtcattcttgtcctccacgtgtcagtttagcatgctacacgtctgcccttcttcatacaacgacttccttgcaatggttgcgatgaagcctggaatgtatctgaccggggctgacgtgccaactccaggagttcccatgccggctccggctagggacgagtgcctggaggctctcatcattccgacgggatggggcgaggcgtgtgtcaggccgcctgttgccccctaacccgcgatctgaccggtctgtgaccggtcacacactgcgaccgatcacggaccggataagcatgcgctacgctgcattaaatgcggcgtgaggcgctcgtccaacccgcaataaacgcggttaggtgagcgccgctgtgctcacctaacccacacacgtggcgccaaacccccagggggtcggggcgtcccagccctcggggggtcgaaacgggagcggcccgacccctcggggagatagagggaggggcggcctcatcaccctcgggcccgaccccccccccccccccccgagggggtcaggccaagcgggtgaccgcggctgccccaaacctctagtcaagatatccccggtcccatgtcaccgacagggagcttaggggtcttcccgtcgaacccgatgaggaagagcagcttgccaacctcgcaggtgttgcgagctctgaccacgtctacttcccgatgagcagctccattgttgtgtaattgagggaccacatgctgttttggtttgatggtgtcgctaagggagggggtggaagtacctccccgtggcaagctagtgcagaaggggtcggggagagagaggagagcccaccactatcgctgttgttacccattgttgtcctaccattctgctactgtcagctgtcgtcctgctacactgggtgtcaagaagaagaaatggggaaagagacgttagtagagaaagaagatgatatattgatccgaattaaatttgaaaatatattgttcattcattttttgttagaaatatccgggatgtaaaatcttttgcacaaatataccatcagtctcgcacaaccgttgcacgaaaatgacgcggaaaagatgttgcgnnnnnnnnnnnnnnnnnnnnnnnngagaccgcgcggtatcgcgcgtgaacggtctcgctcaatcaatcagtgagaccgctcaagcaaacagcgataccgtgccttgtcgatttaattagcgtcaggataattaatcacttattattactaattaatttttaattaagtaattaattactaatcaaatggagcccatcggacagtgtcactggttgcttgagcgatccgcgagaccgcgctgtcgacgtttgatgtcgcaattccgatatttgcatagtatggggatcgttggtgctagggtatacgcgagactgaggtaaaagagatagagacgaagatttttatacaggttcgggcccctgaattgtcaggtaacaatcctacatcctgttggccaaagccggtcgttgatcttattcaccataatcacaccagtataatatttggggtagcctatctaactgttatcaacatggcgatctgaaggtctgactcgtagtcgataacagggtagtcttcctcctcgaatctgtgcccggcaagatcagagataacactttcgtctctcctgacagtatccggagacaccgtaggggactagccgtgcttatccctgaagtcgatatccagcggcttgtcttggcgtatgttggcttgtatgttgtggcttctgttgttccgtgtatgatgattgtgttgggtgtgtcccctctcctcctagggggccttgtatttatactcataggtgtccccttgtccaagtagaaccagggaaaccaatatgggtacaatccgagtagtccttgtcgtttccatgtaaaactctggttgtctttccttatccgaaactcctcctatatccgcatgttgtttccgtataggacatggtatatggtgggtcctgccgagatttagtcaactgctattaggtatgtggtatccataaccctgacagtagcccctgacttcaatgcaaatgaacgaattcatattctcaaccgcgtgcaggccttggagtaactgttatcgagctcatgtgaccgttttcggtgagtttggagataacgttagacttcctttatcagcctcgtgcgggcacctaaagggtttgtctgagtcaatctccgatgtcaaccaagaaagtacagagcatacgactaagtctcacgtcttgctgtaatcgagaatttggattgaagtcaagaaattttatctcggcgggtacaacatctcttcattccgcattccttgtcgagatccaccaaccgttctcgagtaatcgagtaggcgtagagtctgcgacggagccttgtcaacatttgccgtactcgccttagtcgatcttggtgtacaaccagagagacatgaagtctttgacaatgtcgagtagaattttcctgaaatcaatactcagaaaagaatattagatagaaatagcccccgagcgaacgctcaaagggtaacatgttatagaatgtatagaaaactgataatgaattaaatttacataccaatgttttgtatatgagcgtctactcttttccgacttcgatcagtcggttttttgagttatacactctccctagcccccagccttgtcgtcggagaattcttctcggaggataaggctcttggacctttgacctgcctcggttgaacaagcactgatcctagcccccagccgtgaagttggaaaatccatttccgattacacggcttggttaatacgcacggtgagaactcttacacgaccagatcttacatggttctttcgtctctgaaggatccgacaaggccttatcagctctgggcgtccccagccgaagttcccttaggttcctcggaggccttgtcaagacggcgtaaagggacatgagaataggtttcaactctaggtgtcttttgtggtaagggatctctgggtaaaacacttggcgatattgtgtacctgatatcaactttgttgaagtagaggtaatgggagaatcgctacacctctggtcaagaaccaagtagtagtcgtaactcaaccactagaagtaaatgtacgagagatcgctacgattgactggttgagaaccaatgagtaggtgtctctcgatcatttgaagtcgtggtacgaggaccgctgcgttattgctgtagtcgtacctcgaccatccgaggttgtggtgcgaaagattgctacgtactggttcgaggaccagcgaacgtgtagaatcatctctcgaacaccaatggaggttgcggtgcgagagattgctacgtactggttcgaggaccagcgaacgtgtagaattatctctcgaacatcaatggaggttgcgg

SEQ ID NO: 20516 - DNA, 55612 bp, Oryza sativa
  unsure (1)..(55612): unsure at all n locations
ttcccttaggttcctcagaggccttgtccagactgcgtaaagggacatgagaataggtttcaatctaggtgtcttttgcggtaagggatctatgggtaaaacacttggcgatattgtgtacctgatatcaactttgttgaagtagaggtcatgggagaatcgctacacctctggtcaagaaccaagtagtagtcgtgactcaaccactagaagtaaatgtacgagagatcgctacgattgactggttgagaaccaatgagtaggtgtctctcgatcatttgaagtcgtggtacgaggaccgctgcgttattgatgtagtcgtacctcgaccatccgaggttgtggtgcgaaagattgctacgtactggttcgaggaccagcgaacgtgtagaatcatctctcgaacaccaatggaggttgcggtgcgagagattgctacgtactggttcgaggaccagcgaacgtgtagaattatctctcgaacatcaatggaggttgcggtgcgagagagtgctacgtagtggttcgaggaacagcgaacgtgtagaattatctctcgaacatcaatggaggttgcggtgcgagagattgctacgtactggttcgaggaccagcgaacgtgtagaattatctctcgaacaccaatggaggtgctagagttggtttattacatgtgcgtctcatgtggccagcatgactcacacacccaacttgtagtatatccagatgtccgttcgcaatcatgtcaggtgatcaagccgacgacgttcgcgaggaattatccgttaacaaccttttctcgagtagtccggccatggccggtgctatgagatagatcgtcggtcttcattggtaagttgggtgcgacgactcagccttatcgagaacgtcctcgacaagggggtgtactcgaccacaacctactcgagtgctcaattgttcctgaaaaataatttctagaagacaaaatatagcagagaatatcgattatgtactccaaaaaactgcatggatcttctagcattatcaggacataacgagcagatgtaaatatcaggcattatgtaaaccataaacaagcatgatttatacagaagaaaatagagcgagcccctagcattagaccgtagtcgatttaacatcggggacactcgcgcaacagatattgtataaaagacatgctctaggaaaacataataaattatagatctgacaatattgtatagattggaaaaataggtacgataaattgcatataaaatattgcgtacctttgtagatacatgctggatgtatctacgaaattagtagatcaatttaaaaaaccaatctaccaattaccttgttgcgtactcgttcgacatcatatgatctgacattttttggtacgccgcgaagcttgagacttggatggtttcgatagaccaagttgtcgatgacgatgatggttccgatctggttaggttagatctccccctcagctgaagtcgtcgagtagcttatcatcggagaatccatctcttaaacccatcccgtcgaaatcctgaagcaccaaaatccccctacctggcgcgctactgtcgacgtttgatgtcgcgattccggtatttgcatagtatggggatcgttggtgctagggtatacgcgagactgaggtaaaagagacagagacgatgatttttatacaggtttgggcccctgaattgtcaggtaacaaccctacatcctgttggccgaagccggtcgttgatcttattcaccataatcacaccagtacaatatttggggtagcctatctaactgttgtcgacatggcggtctgaaggtttgactcgtagtcaataatagggtagtcttcctcctcgaatccgtgtccggcgagatcagagataacgctttcgtctctcctgatagtattcagagacaccgtaggggactagccgtgcttatccgtgaagtcgatatccggcggcttgtcttagcgtatgttggcttgtatgttgtggcttctgttgttccgtgtatgttgattgtgttgggtgtgtcccctctcctcatagggggtcttgtatttatacacataggtgtccccttgtccaagtagaactagggaaaccaatatggatacaatccgagtagtccttgtcgttccatatagaactctggttgtctttccttatccggaactactcctatatccgcaggttgtttccgtataggatatggtatgtggtgggtcctgccgagacttagtcaactactattaggtatgtggtatccataaccctgacacgcgcggtctcgcgtcgttgccgcgcgagaccgcgcgataccgtccgcgacatcattcgcatgtcattttcacgcaacggttctgcgacaccgacggtatatttttgcacaagtttttacatcccgaatattcctgagaaaaattgaatgaacaatatattttcaaatttaattcatatatggatcccactttatttttcaatacatttgatgtctgggttaccacttggatattatgttagcaaaaaccgctctcaaaacaactgagagagacattttaaacgattttaataatagttgaaggtgtagttatatccggttttacggctgagagggacggttagccggttaggagagtccaagcggataaacgaacaaatctacggtgttgattaggaaccgtatgcaccacggcccagctctggccggccggccgtgcggtgcgcgaaacacaaacgccgccggacctcgtcctccgatcccgcaccgcgcacgacggaagcctccgccgggtgctgtttacttggaggactcgcacgcacggtgtcagtagcacggcattcctctgtcggcacccctaccgctcaggttcagtagctggcagcctggtaacaagtttcttcttggagcgcgcttcatgctgcccagtttttacagataccgagcagtgccatttcagctcctagtggtagcatcactcaatccgggtgaccactcccgacattaccaacaagcacatgggctatgtcgtttcgaacaattcagatccgaacagatgaaccccgcggggcttgcgaaggcaaaggacttgagtacgggagtttcattagccgacgagatatacgtacagcgtctagtcttaaggggtgtttgggaactagagactaaatttttgtgaaagggattaaagtttagccctactttagttcctccaaccaaataccaccttactcagaccgacatggacgaagccaccaagggctacccagccagcatgcgtccaagtaaacatcagaatgaaagcgagagtttttgaaagttagcgtcaaattaaactgcaatccgcgctaagatggggagtaacaaagtgtagtagcctgacagggggagcactaggataacatgtgggggcagaggagtacacggctcaatgtgaaaaaagaaccgaaaaggcagtaaaaagcaaaaacaaagcgaaagcgatcccggtgttcaggctttcagcacgatggcatgatatcgtccacgtcgcaggcgtattgctcttggcagattcccctggagcgccagggaacccgaggtggagaacaacggaagaacagtgtgtgagaaagctggtacgtctcctccctcgtatccaatccagtggactacccttgtttgcccaatgccagtcctatgtctgtgtctctgtctgccatgcttatccacaggtcacgaagaaaaataccgcattgccatattggcatgggccatgatggtccatggaggtggaggtgccttgctataggattattgccaggaaggcaacaccggccggccactaccctcggttctcgcggattattaccgttttcttcccgctaggtgtaaaatggcccgatgctagctttgcatttgctcggattgtttgtgaaaagctgctttgagaaaagaagtttaaggataggtaacttcgagataaccttctcgaatgataccattccaagaagataagtcctgagtcatgaaaatgcaaatagtttttccaagttttgataaacccattcagaatttagaagttctccacaaaaaaacaagccaccttccctctgtgttatacttggacatgccaaaccacgacaacaacaatggcaccacgtcgcctataaaaaccccctaaaacccctgacctatcaccaccaccaccaccactccatcacagtctgctcattagctcgagacctggtcagctcgccgccatggcttctgccaagctgcttctcctggtcgccacctcgctcctgagctgcggcgtcatcctcgccgactacgcgccgatgacgctgaccatcgtgaacaactgcccatacccggtgtggccaggaatccaggccaactccggccacgacgtcctcgagggcggcggcttcttcctcccggcgctctcccaccgctccttcgccgcgccggcccacccttggtccggccgcatctgggcgcgcacgggctgcactggcgccggcgcgcagctccactgcgccacgggcgactgcggcgggcggctccagtgcgcgggcctcggcggcgcggcgcccgcgacgctggcgcaggtctccctccaccacggcaacgaccagacctcctacggcgtgagcgtggtggacggcttcaacgtcgggctgtcggtgaccccgcacgagggccggggcaactgccccgtgctggcgtgccgcaagaacctgaccgagacctgccccagcgagctgcagctgcgcacgccggcggggagcgtcgtggcgtgcaagagcggctgcgaggccttccgcaccgacgagctctgctgccgcaacatgtacaacagcccgcgcacctgccgctcgtccaagtactcggagttcttcaagcgcgagtgcccgcaggccttcacctacgcgcacgacagcccgtcgctcacccacgagtgcgccgcgccgcgcgagctcaaggtcatcttctgccactagaatccagcgcgccaaggcgtactcggtaggatcccttccggggtgtctgtgactgtgttctaatgttcgattagctcgcgggtttagatgctggagtcgttacttacgttcgattagcccgtaatcggtgtgctgctgcttgtgttggctgcagggatgtctgtgactgtaatggtgttactgccaggtttccagcctgaaataacatgttcctagtgtgttcagatgtttacaaacatgctccactattggaaactgttttaacagttcgaatggacgttcacccgtttattgcatgtcatctaaatggttatgaaaaactttcgaaaaaattgacaagatagatcaacatgtaatatatcactccacaaacatgcaaattcaaattcaacttttacaagtcgtaacaaaaataataaatttaattgtaaatatacatatagtaatttgagtttggtttgaacttgcatgttctcactgaaattctgaaatgcacgtccttatctccgccaccatctctggactcgactgccggctgccgcaaccttgaatagtacttctatagttctatgcagggctaaactttagccgctctcttaaaaacataaatttttaagtctttgagagagactagtttagtccctaaacataagtaccatagattgctgaaaaggcgcaatctcctaatcggtttttcactttaaaaaaaagtaccacgttactggcacgcgagatgcagtaaaatggcacggcaccaactcaaggagtaccccaagccccagaccctttccctgtatgccccttctctctggctctgcttctggtaacgggctcgtcttatacctttctccttttaaacttttcttgcccattggcgctgccgctctgccttttcaggtagcgcattggattgtttctctgcgtctttggcgcctctctgcagtaattttggctggtcctagacccctagtctactcctactagccctacatcacatatgcacatttctaaaattttgttagcctcattttacttgaaatatggaacaccaacaacatttgacacaataattggcaccttctgaacaaatagccaatgtgtttttactaaggaaagtagagcttccagcttgcaacaaggatgaatgtaatcatgtttgtcgatatcacaatttaaatcctttttttacacaatgggataaacctggcctttacatccaattggatgtatacaacccaatcacgatttatttcctagtacctgatgaaagaaagatttaaaatctgatggatggtagcatggagccatacatcctactgctttacgtattgatagtttgtttaggataagaaattaaagagggtagcgttgtgctctcttttgaaacccgaataatcaccctagtatcatgatctgatgaaccctggtctccaaacattggattgatcaaacaagtgtataagcttggtccatcctcttttcaagttgatggtgagggtcagctttaagagcatgtacaatagcaggctataagccagctgcaaacatattttaagaagataaataaggagagagaagagcagtgggctacagatttgtagccaactgtagtacgaacttcaagatgcagtgtgtgtatgacatgtgggaccagttattaatagtgtagtatgtaactattgtatgaatgagctattagattggctatagatgaattggagctagtagttggctatactattaaacttgctctatgagcaagtataatagtaggctataagccaactataagcttatgtggaggaaagagaatttgaaaaatggagagggttggctttcatgcaagagctagcttttcacatacttcaagataaatacattaaatgcacaggtgagagatagagagaggaggagaaaaaaagagataatcttatagctcatttactatacatgttaactctaatataagctataagctcatagttggctctattattaaacttgctctaagagcaggtacaatagcaggctattagccagctataaatatattttaatgatataaacgatgagagagaagagcagcgggttacagatctgtagctagctgcagcacggactccaagacacactgtgtgtatgacaggtgggaccatatattaatagtatagtaaacaattattgtatgaattggctattagattgactatagatgaattgaagctagtagggagctgtacaactagacttgctagtgtctaaggtagtgcgtgggaagaggtgaaaggttaagcatggcgtgacttgctagtgtctaaggcagcactctttttcctgtagcaaagtgtaccactagtagcttacactttacattggtatcaggcagccgcaagtcactagtgtccatgaaatgggataagcacagtgagtagtgccattagcaaacggattgtcgagggcttgagccttgaggcagccgttagctatccactgtgcaccactagattatcatgaggagatgatgcggagctcgatctttgaaaataaaaaagcggattcgaaatgctgctgggtctagcaaaaacatatttgctggtttcagacgtcgaatctgatgggcttttgatgtttgatgaataacgaaaggcccatgatagagatgccatcacatgttcgtacgaaaaagtacatcaaaggtccctcatcttgtcaccgaattataatatcatcccttaaccgaaatatatatatatatatatatatatatatatatatatatatatatatatatatatatatatatatatatccacgggcggatccaacgtgggtgcagggggaacttgagtcccccctaaacccacaagacccatggatatccctggagcacccctttcgattttttcaccatgaatgataaattaaaggttcctaaatggctggaagttgaagaaactgcgtaattgagccccccctccccccacaaattgatctgcccctgtatatatccctcatcttataaaaccgggtaaccctcgatctttaggcggtattgacctcggttttgtccgacatgacagctgagccaacgtgagcctcacatggcccccacatgttagcaccttaatcttctccccctcttttcctatcctacttctctccaacgtggctggggaggggcaaggggtggtggccggcagggagaagcatgcggtggccagcgacgagcggggtagacacgcgtggcacgacaatggactccacacagctgcggcggcctctccccactggctgccgtgcgcctctcataatttccactagcgtgctctggtgattaccgatagaagcctcctttccatgctttacaggagaaaccgaaacataccctccatgtcttcgagccactcaccgcctccttgccacacctctccctcgacttcgtccctgacctctaccacttctagatctacggctcccacctcggccttttcctcctctactagcacggccccctctcccccgactccaaccccgcatcttttgtcgtttctgactccatttgcgtcccacgtgcagttctgaacactggtcatcgacctgtcgacgacgtccccaaaagaggagtcctcgatgccgcgctcctctctcgtgatgacgcggaacacgcaggagatgaaagattgcagttcgacatcatctgcattgacgtcgaccgcccgcacccggaactgagcgggggactactgccactggagcatcgacacgtggctctcatcccacgcctcgtgccacgcttgtgtaccctacccaccgctgccatcgagtatcttcccaccagtcggtgtgagaggtgcgcctctcctgctaaccgccaccccacccgttgctggccctaaagagaggaatgaggattggatgggaaagaggggagagaatattgagctgctgacgtgaagggcccacgtgggtcccatctaactcagctgccatatcggataaaatagggggtcaatatcgcctaaaggcctagagtaacccgattttgtaagttgagggatgccatatatcagattttttggttgagagacgattctgtaatttggtgacaacgagggacatgttcccatgttcgtacgaagccgtagaatgggccaggcttgtttctctttagacataacgtagtgtggctgcaacggaagcctatagtttcgtcttctaagggttccatgcaagtgtcaaatttatttttttgtcaattgtaaatctaccaattttcttatagagttactagggaacgctataccatttcggaatggaatagatctggtgccaaacatgacgtcagcaacataaactatattattgcattctagtatttcttctagtatttctgttttttataataaactaaatatagccttaccattaccgacttactaaaagttgataattccataagttttctttcacaaaaactccaccaaaatatggcaaggctccaaatttgacccataaaatactaccaaaattcgaaaagattaattattagcaacaaagtaaacatgttttgatctcgatgcattaatatgagttgttgacttgttggtcgtatggcgctctccgttgtcatcgccagatatgttgtcgaattaaaacgctcgttgtcaacacgccatacctgacggtccccatcgcgtgcaactgtgcagatgtggtggaaagaattgaaacgctctttgctgttcatgtgtcctctccagctcccgcctacatcgtccataccattatcagcggggggtgttgccgctacatgcagggttaagaaaaggccaagcctacgaaacagtagatccatcgttatcctgacgaagaaaacagcgacttgcaccagcaagagatgagagcgacgccggctttccccggcacggcaaacgattccccgaaacagcaaaaggattgcgggaaacagaggccaatttgggggcgaatggcctctccgccgggtcgggtcagcgtgtgcgccgtcccggcgcgtcagccgcgaggtcatcaggttcctgaccgcactattggtggcgcgggaacgcgcgtgcgactccgcctcgcgcgcgggcggggatgcgatgcgatgcgatacgatcgcgaggacccgaaggcgagggcgagatccgctcgctatcgcgcgttccttgggtggtggtggtggagtactggagtggaccagggaagggaagcgggtggtgggagtcgcgcgggaccgtccggggtccgggaaatcaacagcccgtcctatcgcgtctctcgggacggaaagtgggtgccgaatttgtaggtttcgtagcccccagtggacgagtggtggtgggtctcgttctttccttttgggtgcaaaagcggtgtccttctttgttgtgcgtgattgttttatatccgtctaccctatgcatctacttagatgctagatgcgggtaagagcaagaatagtatagctcaatttctactattatcttattttaaagccaacatatatagtagattagttataatgttaactataattttcttctactttctctatcttacacttatatgcattaatgtatttatttttgaaattgtgttaagctagctcttgcataagagccaacactcttaatattttgttacatctcttctccacgtaagtttatagtaggcttatactcactattatacttgctctaaacgtgtgtgtataagacacatgtaggaaccacggtctacttgctgtgcttgcgtaattgagtatgagcgtatctgtgaaaggagatatcaggacgggaatctttcgaaagcctgttgaccaccacgatgagctcgcctcccgccaatgttcgaccgagcaattcgcgtgggcgagcgtgagacggcgggtgagtggtgacatgggtcccctctacctgcggcaaccaagccgatcaccgattcaccgttcaatccgagctgcgtacgctctgttcttggtgcgcgtcggttgccgcggggggaaatcaccgcacggcaccgcacagcacaggcggtcgatcggcggctgactcgtcatatcgcagccaaaccgacgggcgggggaacccgacgtgactgcctacgcccccccaaatcttgtcggctcactcgttcagttttcgcgtttacggtttaccactcggtgtcgcgtgctccaaaccgcgaacggcagcgtccagggggtgctcccctccgcgctcgcgcttcgctcgattcgtcaactggccgcgggcgccataccgtgtccatccttcgctcgtggactctgttcaatggcacaagcggcatgtcggccattccccccgggatgcgcgtacatggcgatgaatccgaagcagttgacagatgcgtggtactacaatcctgcattctgggcctgctcggagagcattcgagaatggacggaattacgaaatgtcaaagctacacgatcgtttgcgtgatgctgcagaatctgactagctttgaattactacaaaagcttatctaaaagaattattacttgctctgaaatagtacacaaaaaacatcatcatagttaaacggttaaacaaccgaaaagccctttacccaaaacggtgcttcccattttatccgcctgctctgctgctccacattttctccctctttccttcccttatcgtcctctctctccttcttcctttcctgattcatctcgccgagctctcctcgtcgcctcctccgtctctctataaataaggcgccccacggcgcctatcgattcgcgtcgccgcttcctgcagaggccgagaattattctcctgcgcccgccgcaaaaaccctagccacgccgatctcatggcggctaccatcagccaggcgagcctcctcctgcagaagcagctgaaaggtgcggatccatgcggctcgcttcgtcctcgttcgtcggtgttctgtttgcgccccttttttttcatccgtggattgatcgatttcggggttgggtttgtggtttggtgattggtgcagatctcgcgaagcaccccgtggatgggttctcggctgggttagtcgacgacagcaacgtcttcgagtggcaggtcacaatcatcggcccgcctgacaccctatagtgagttggattctctctccaattcgatgcatgcttccatgaatcatctgcctcatccgtgttcatgccatgcgagtggagttttttcgtgtatacccgcgaattggaggcagaatcttgaattcgtttctaaccgtggcttgaggttggcttccgattgaattttgcgatgattttaggttcttggaaggtttgcatagctaccacagtcctacgactagctttcatggttgatgcccatttcaatgagtttggtttgaactggatgtgtggatgaggcatgggtagctcgttttgcaggatgggtttgttgaagtggtggcagtttgcatgttcacatttagattgcgcatatttctatatgcatatgtgtgggtaaaggttcatgacagtctggggtcagattcttaaactacatcatggaaatggaaacctatgtatcgattagactgactgtgtttttctattaatggggataaactgggcagctcatgttctcaatgtaagagtttatgccctcataaaattttggggaagatatgcttcagcttatttattagtgctttcttgccggtaattgacctggcaagtttttcactcttgtttcaagtagtaccgatgtatcaaccaagttacattctaatttcatctggtgtttggtgcatgaatggatttttctttcgtagaatttatgtttaaaatccagaaatccgtccagagcagctagtttgcactattggaccacatgctggaaatacaatagtccaatctaatgagtgataaatggattaacataaaggtacagggatgctgttttaggaaaggaacccgaagaactggcagtaggttcaactcaacctgcatgtgacataattaaaactagctgaatttccaatgcaatggggatagactattagatatacaatcgcatttgctatgcatctttcaggtttatttgtaaaattacaattgccatactgctgttttaattatgtaatagatggagtaatgagtgtggttactagttgcaaactacaacaccacatctattatattattaagacagctcgaaaagaaggcaccacgttcaccgtggaggctagaaattttcacattaatcggggaaaaagaaaaaacctacaccgttagatcataacaaatctagactataagggttgagatttaatcaaaatatatgtaaaagcttgactctttgactttttgaatcggacacgtgaaagagcgtggaactagaattttggtgcatgctatgcagtagcctttgaaatcaaaatcaaattaggaaacttaatttactgacacgagacaaacacgtcatgtctgcatagcaaaattagaaatcataaatatgcacaactgtgacacgtcctgtacaaaatcatgtgtaggggagacaaaacaactgggcatccaaactccttcaaccacattcaagttttgcactatcgcataatctttagagacaatatgtttttttaaaataaaattcttagtaacaagattccctaatagctttctctgtatttagggtccatatgttatagctcatactccgagaatggggcaatgctgagaagcggcggaaatcaccatattaataataaaaagtgaagtatttaaaggatctaaattttaatggtgtatattgatcgatgtagttttatataaataaaatattctatctattattttaataaagtaatgtaaaaagaagtctctacgtttgctctcaagacttacaaattctcggattaaaaaatataagcagttggatcatggtcatgcctgtaaagaaattgagtggtgacggttgatgggacatctacaaatttgaaaaaaaacccaaatagaatcccaatgaggattaagagggggaacgatggatagatcgttatgcggtatggttatagcggttggctggacttctagaaagaaacaaaaaataaacccaatgataatcatgtacaatttttaaaatatcaaaaacaataaagaggggaggcaacaggcgagctgtagatgagtacattggcaaagccattaacggattggcggaacttctagaaagtaaaagctgaactaacacgataattatgtttgtttttttaaaatcccaatgaaaataaagagaagaggcagtgggcaccccataaaggagtacagtggcggtgtttaacaggacttctaaaaattatagaagagttcatgcaggaatacaatttataaataaaatgccagaataaagaatatagaattttcaaaaaaaaaagtccatctagaatacaatgatgacaaatgataataaaaaggagaaacaacatgcctgtaaagtagtagatgacggttgatggtacatctaaaaattataaacagaactccaaatagaatcccaattaagattaagaggaggaacacagacatgttgttaagtagcactgtcacaacgtttgaggggaggcagcgggcgagccatagaagagtacagtggcaaagccgttgatggtttggcaggatttctagaaattaacaaataaactccaatgataatcatgtttaaattttaaaatatcaataataacaaagaggggaagcagtggacgagccgtagaggagtacattggcaaagccgctaaaggtttggcgggacttcttagataattatgttcgaattttaaaatcccaatattaataaagagatgaggcagtggacgggccgtagaggagtacaatggtagcgtttgacgggactttctagataattatgttcgatttttaaaatcccaatgttaataaagagaggatagtggactggccgtagagaagtacattggcagcatttgacggaacttctaaatattataaaaatgaaaccaaacaagccaataaactctaaaaactacaagatataatttttaaggttctaaggagaatgaatagaagcaatagtagatcgagcaagcaaataacggagatgtgacaaaggagtaagtggtagcgaccgacgtgactcttataaactataaaagtagaaacaccgagatgataaggttcggtccaatgtcccaagacaacgagatagttgtttaacaaattttaagtaaaatcatatgtaaaagatagatagttttgtacggatgctagccgcgcaattgcgcgggccacccagctagttatttgaaagaaaactaaagaatagtctcggtaagcttaaaatggaatcgtgcactcttgtcagggagcttgcatatgcgttcaatatattttctactttcaaataatgcgctctttggtgttttcttggcttggacagaaggattctttacacattaaacgaatttactggtttgcttgttccatggtccagaatctcaaatgtgtaaacatttgatatgagctcaaaatgagttagctactatggtttaaacttctagtaagtggtaactgataacagtccttatttcagatatagagcccttttcatgtgcttgctgatttgtcatctattcatctttggtgtttgggctgttagcttgatgatctaaactgttctttctcaaactgccttgtgacaatgacatttattttcagtgatggaggttactttaatgcaataatgagctttccacagaattatcctaacagtcctccaactgtcagatttacctcagaaatgtggcatccaaatggtcagctttcctcattgtaacttcatgtttctgtaactccatgatccataattttaacacagcataatattggtcaattgccagtttatccggatggacgtgtatgcatttctattcttcatccgcctggtgatgatcccaatggttatgagcttgcgagtgagcgttggacaccagtgcatacggtacgaattatggtgtctatgatgcaagcaatttcttcccttttcattctgttctgcactagttccattttgttgacaacttgacatatattctgcgtggaggcctggagggtattgtctgctgaattttcttacataaataatcaataagctttgacaaaggaaagagcttgtgatgcaaatttgggagtttgttaagcatctgcaatgcaatacacgggcataacaccacactgcaaatatttcctaaaattgtgaacaatgatgatggctttgttttgcattttggatattcatgataacttttttgccttccacctagagtttcgtttttgtaatccttttatctctaatattgttactgtaaagtgcaatgcgttattttctttggactagcaagttattaaacttgcataagaatctttgtgcatctgatattatctagttcagatagtaaatcctttcaaacttcaaagtataagaagccttatatgtagagttggtgtaaccttcggtaatttatagtatgatagcttgaaacatcactacaaattccatcgttgacatatcaaactcagcttctggtatactgaaaagtcaaaagtaattgtagcatttgaatcttgcatttgaataatagtcatattttgaacaatgctgcaaagttacttgtttgttttgtcactgatcttgtcatgatcatatgtttatcttctctagctttttgtaagtagccattttttactgtctaatcatcatattcctgattcttgtaattttaatgagtgttttccatttacaggttgagagcatagttctgagcatcatttcgatgctttctggtccaaatgatgaatcaccagcaaatattgaagcagctgtaagttcacttaacatttgctatggaaattgagaactctgttcctcctgggccttggtgtatatggcattttatctgtcacggagggatgggggaagagttgaagtacttgtcaatagggaaaacacagagttggcagatcctacaaaataatctaacttccagtccaaaaaccatttaactttattatcaacatttgcatactggattctgcatgtacctttcatcttagatattcacctatttatttggttagttgcagccctgagaattttctcaggtactgctatagtccttgaaacatctgtgaatttacacaccagacatttgaatgactttttaaacacacagaaaattgtagtcaggacaatgcgtagtgtattttgcctgctgtttggtggacctttgttctgaacttctgcctactgttcttgcgcagaaggaatggagagagaagagggatgacttcaagaaaaaggttaggcgccttgtaaggaaatcacaagaaatgctctgaagaaaccggcagtactggggaaagttaaccataccacgtcacatgtgcatgatttggctgtcgatttccaaatgtcagttgacactagcaattcacttctccccctctgtacttcccatagtgtgcctggtggtggtcgcggtttcgtctcccaggaaggctgaatagcactgggacatgtttgtcacctattctaaagctctggttgtatttgtgtggcttgggctgtaaacgttgagaaactttgaaatactgccactcatcacaattttcgtaacaaacgtcatataagcaggcacctgcctgatctgctagctgttgaacgttgaaacacaatgtctgcaaactggtttcagtccgttctttgtaatatgttcttataaatggagcaatactcggtgctgtacaaaaatacttgctggagtttactcattcatcagttataaatctatattggcttaccgtgtttcgtttcctctcgaggcaaactactactctttttagtttgcagttctcaaaaaaaaaaaaagggtttcctgatactgaatctacgccgcatgatatacatcccttttttgttctagcaaattttccaaaatcaagctaccacagacaaatatatatatcggatgttttctccacgcaacgcatacgaacacaataactctggattgaatctactatggtctcacaggtagaacgtaaaaagattttctgaaactagcaaccacaccacgccacagcctcatgttttggataatgctgatggaccatcgtcgagcaaaccttgcttggatggtcccatttccggtaaaaagaaagatcacaattgctaccagcagattacagaaggcaaatcgataagccatgaagttccaagcatgcaagcttgtatgtatttgcagggttgcagctggtaaaaccggatggtaagactcccaagagttagaaatgagcagaactctgcactccgtgccaatcctctccaaaggcagcaaagttctgggaccaaccatattcaaaagtgaactctgaatacctcgtgcccttgtggatgatgccaatatgtccctgtcagctgaaaacagaacaccagaaacaagaaggaaaaataaaagccaagggaaatcgatcatagtgggattcgaacccacgacttttagattcggaatctaacgcgatatccacttcgctatatgatcgttgttggcttgcatacacaattaaattttgatacataaaagccatctgcatccatgtcctagctttcaagaggcagaggaaacaactaacaaggccaatgcaaataagttctagctagcattagtaacatccaagaactgaagcaaaatgtaataactatggataaagggtatgcattgaactgtttctatagggaggaaacaaaaggaaatgcatactcttcaacttacagacgttttaaaattacagactagataaacattattttgccagggtggccgaaggaagggccatccaattttattaagatttgggagatagttacatagttatatatatacaggtaacaaacatcaacagtagactgtcgaaactgaaagaaaaataactgtcaaacaacataaataaacattaaacagcacaggatgacaaggatgcacaactgtgcaacatgttaaactgtaggtgaatttctctcaattcctaaaagatactccctccgtcccaaaaaaagtgaatctaggactggatgtgacatattctagtataacaaatctggacagatgtatgtccagattcgttgtaataggatgtgtcacatccagtactaggttggttttttatggaacggagggagtaagtctcaccagcactatacacaaacaaatatttctgtatccagtaaaggtatgttgatggtacatgacaaacaagtagtaagtgaaatcggcaaggtaaccaaactcaataactgaaataaggaacatatatgcccccaaaaaaaaagttttgtcactacaatcattccatgctaacggctagcaaagcatagcagctgatgagatagtactgttttggtttgctgggagaactaaaatgcatgcagcagcaactcattgttgtgaaaaagcaaagcaaatatttgtgaatttgtgatacagccatatgccatgagccttaatctcatgctcatgtgcgctgcaaacctgcaattaccaggtccaaccgggcctaggttaattttcgtgtcagatcaaactcagcgctccgttctaagtaataccagcacgattccatagcacccaaatgaccgaaactcactcaaatcaacaactatgccacgaaccctacaaatagcgtgttgacagcatctaaacgattatccagacaaccgacaaaagctttaccatcagatcaggggggtgttagatcgattcaacaaatctaggtcaggccaccggtagatctaaaccagatcttcgcagaaggagatccagcgatgggcgtggccctggctgtagagatgtagagtggatacggagaaagtagggatggatcgtaccggccggcaagtaagccggcggagaagcgagcggcagggatggccggcggccggcggccggcggatcgaccatcttcccagcggcggttggtctccccccgcctatggcccaatgctcgtcgtgggccgtgcgcggcccgccaaaatcccctgaaaaattccaactcgaatcgcctcctccctttggccaaaacacgggtttcccgcttgcatttcgctttccaaactccagcttaccgcctaaccccacccacggagccgccacatcacggatccccacgccggggcgcgtcaagatccagccgtacaacgaatccaacggccgcgagccccaccaccttatcgatccgcgccaccacccaacccaccaatcacgtnccttcccacactcctatatatccccaccccacccgccccatcctaattccccacacggcgaaagcaaatcaaatccaatccacctctcgcctccaaatcccaaatcctctactcgtcgtcgtcgcggttcatcttcagcgaattcccgatggcgcccaaggcggagaagaagcccgcggagaaaaagccggtggaaggagaaggcggagaagaagcccaaggccgagaagcgggtgccgggcgccaaggagggcggcggcgagaagaagggtaagaagaaggccaagaagagcgtcgaaacttataagatctacattttcaaggtcctcaagcaggtgcatcccgatatcgggatatcgtccaaggccatgtcgatcatgaactcgttcatcaacgatatcttcgagaagctcgcccaggaggccgcccgtctcgcccgctacaacaagaagccgaccatcacctcccgcgagatccagacctcggtgcgcctcgtcctccccggcgagctcgccaagcacgccgtctctgagggcaccaaggccgtcaccaagttcacgtcgtcttaagacgcgtgatctgttcatgttcgttggatgtttatctgttctgatgtttatttagagcgctcttagatttcccacatggaacaatgtagtatcggtgaaattcgctataaatgaatcgctgatcttatcacaactttcaatgtgtttctcttggtgcttgaattcctgtgaatttgtggtttgtgctttgaacgggctgcaggaaatgtcaaatgagtgaccgcagaggctacctacggaggattttgtaatttgtatcagtggaaaaagtttgtgatgtatcagagtgaataataccgaatttatgggatttagattacagaataatatagaatgttttgaacacatgttaagtactctacaggcctttagaagtgtatccttggtctcatctcatgtcatggttttgcaagtgttgatgtggccagatcagtttcctttcactgatgttttcagcgctaacgtttgatttgcgatttaaacaagtttatttctttccaaaaatgagagaatttcgcccgaaaaaattaaatcaaaagacaccagtattatggtgattttgtacacactacacaatctatcctttgtgtagtgtctactattaaaccatttgaggctggagcttgatggtcctagactcctagtctgcaattctgcactcggtatgattgaatatgttttctcatccaaaggaatttcaatttgaacaggaaaaaaaaaagcacactcacgtgctggttccattcaaaaaaaaatttgaacaggaaagttctatcgctaacaattcaattttgacagtatttgtagcatatgatcaattttccctttgtgcaagaagccaatcatgtgaggcaaaaaataaagaaaatggtcagcaccacaacagatccagagttgagagttgcatgtggtcatttctgttcatctccaggttaccaggtaccatgcttaaatcttatgaggtctgtttcagactttcagtatttcttgctaatgctgttagggctcatagtttaatctttaagcaaatacttgatatgcaaagacaagcttgctgtacatgtgcccagaactttatatttatctcaagatccgaaaaagctttcattggaatgccattcctcgagctgtcttttttatggtgtctgataatcatacaaggcagtcctcatcttcctcgctattcagacaagattcaagcatcatgtaaatatcatcactctttggatgtctgcggtctccattgaagaagacatgaacctggttctggacctcaatccaactgcaaccagtgatcctcttcagtcccttttctttaatttcccttctgatcattgacacatcctgccagcttcctgctgcagagtaaacattagatagaaggatgtatgaagaagtatccttaggatccagtgcatgaatatgcttcgcgacactcttagccagctccctattccagtgaatctggcaccctcctatcaacgacttccagaatccaatgcctggctcgaagggaaggttctcaagaaaccgcttggcatcatcaaatcgcttagccctggagaagagatcaaccacacaagcatagtgctcaggtctcaatacacccggctgctccatctcggcagtcctgaacaatgagtaaccttcatcaaccagaccagcatggttgcaaccaaacagcaagccaagaagagtaacacgatccagcttcaagcctgtagctttcatcctcctgaaggcatccaaagcctcctcccccctcccattttgcgcatatccgcagatcaacgcgttccaggacaccacgttcttgttcttgatctttttgaacgccaggacgctgtcatccaaactgccacatctagcatagaagctgacaagagaattgcccgcaaaaacatcaagcttacccaagaacttgatagcagaagcatggatgcttctgccaacgccgagcgcccctgcattggcaacggatgtgagcaagcagggaaacgtgctctcgttcggcctgacgccttcccgacacatctccaggaacagattgactgcctcctcgttgagtcctgccttgctggatccgccgatcatggcgttccaagaaatcacattcctctccggcatgcaccggaacagccgggctgcatccccagacatcccattcttcagaaaccccgcaatgagcgcggtgtaagagacgacgttcggctcgcgggtgtcctgcagcgcgccctgggcttccctcacggagcccatcttggcgtagtggtcgacgagagcgctgccgacgaagacgttggaacagaggccaagcttggcgacgcaggcgtggagctgcgcaccgacgcgaaggtcgcgcagcgcgctcgccgactgcaggatggtgccgaaggtgaactcgttgggcacgatgccgtccccaagaatgccggagaagagggcgaccgcgtcccggtgccggccgctgcgggtgagcgcgccaatggccgccgtggccgagacgacgtcccggtgcggcatttcgtcgagcagattgtgggcggatccagggaaccgtgtgaacggcaccaccagctgtgccgtgggctaggtcagggtcctcagggaacccccaaggtgctgcatctgatcgcaggaaagtcgggccttttggagcggacgagctttgccgctttggatgtggtggatgaggatttctgtatcttgttggtcagtctgatgcaatcgccgaatcggccgaagagaacgttggtgctgcagactactagcaggttacagggtttgctcctatcttgaagaattttgtatttattcaaaacataataaatattaccacgtcacaaaatataataactaagaattagatgagacacatcataatcctttatggaagatgcactaaatctgatccagagtcgctatattttggaattcttgcttgagaatgatctccccactgctgctagcatctactccgtacatacttttgcgttttttggttgtgttgcttgtgacttccgaaaatgacaacatctcctgaacattgaaccggatcctctaacgtaatctattctatgtcagagggacgttcgactatagatcgtcgttgcttgcgtatccgacggcaacaaccgtttcagtcccgtctcttgtctcaggccccgcaagcgcgatgtccctgcctgctctctggcccattcgttaataggggcagcggcaccgcgccagccgccggggagctcaggccgccgcgcgctgaagccggcggggaggttggactggaacgcggcgctaccgctgtccgccggcgaggtcgagggcgatggctccgcccagcggctgctgttgtcggaaccgtcgtcggagagctatacggggaacaaatagaacagaaaagttactcatcttctcttcatttcatgccatgagatttctttacttggttaacatctgcactcgattgatctcttcttcaaggaaaaaaaccatcttctttggtattttcttattgcaattgtagacttgctatgtcgcattctactgtgaatctgttggcaaagttttggtttcttttcttctggttagctctgaattttattcttcaggttacttgtagtttcttagtttctgggacaagttaatgacagcacgaatgccttagcaagattttcaaccagctgcctcttccatgagaaaaggcaacttgatgatggaagttcgatcggctacagatcgattccaatccaacttcgccggcgacggttccgagaacagcagtctctgtgcgatgggacaaacagcaaacaccaaggcgggcgtagccgtcgccctcgacctcgccgacggacggcgctagcaccgcgtcctagtccgacctccccgctggcggcagtgtgcggcggcctgagctctccggcggccggcgcggcaccgctgtccctatcaatgaatgggccggagagcaggcagagacattgcgctgtggggcctgagacaagtgacgagactaaaacggttgttgccgtcggatgcgcaaggaacggcgatccatggtcgaacgtccctctgacgtagaataaagtacgtcagaggatccggacatgtaggaagtcagtagctacagtctacagaaaagaaacatgtatacagtgtacacacaatagccagaacgaatagcatctaacccaatcacgaattggcaagggggactcatatacatcagctataggaaatccagtactccaccgatattcttccgggaataatacaggtatggataattctgcatttcatatctcaatgaatgatttgcagtcatacatgatacacatctcatgagggcatcaggctttgttaaaagtaagcagccaagttcaaattattctattgacaatatatctcgtgacaaaactcctccaaaatgacaagctggtgcctcatagcctagtacagaaaattgaatacagtctcaaggaactcaacacatgaatattattttcataagccttcttttctagagccctcgctgattttaggtcccgcccactgttggctagcacgagacttggcccagggatcaagaggagaccgttgaggtggctgtggtgttgcaggtttggcttctcgaagttcattttccctatcaacgaacctgcagatgaagacagcgagtgacttgggctgcaaaacagcaagttatgatttctgggaatttgatatgatgatatatttctggcacagccagctaaaactcagcattttagaaaaaaaaaactttgcatggtttgaagatgcttttagcacgctagcttctttcatttaaaaaacactgcatgatgctgaattttatactcaaccagttgattgttccacgtgaagcaggggcaaaaacaagtcggtggcatggtagtaattttttaatagcaaacacaaagtaaaagtaagcgaataacaaaactgactaattccccgcaaaaaaaaaactgactaataacccaatggaaaggtcactgatcaattttccattttaaaaatcataagagaagcttactcaatgtatgccatcggtgcagcatcaccaactcgtatcctagttcgcaatagtctggtgtacccaccagctcggttcctaaattcaaaagggacaaaagaatcattaggatcgacctaaaaatattatgaccctatgctaccagtacatagcgttctagtattacaattttgtgatgcataaaatcctacaccttttagatgcattgtacaaagaccatggtaggcattttactttattccttatgtgagatgctaacatgacatatttttaaacagtggtagaaacaaatcaaattgatacacaacacatgaaggagttttacttgtaacggtaggctagctctgtaaatagcttatgaacaacatcatctccccgaacaaaagcagaagcacgtcttgctgcatccaatgtgccctataatttatgcaaataaaagataagtttctggacgaatacctttaagaatagacttaaataaatcaatgcaacattccagccagatcaaaagacgtttaaggtaacatgcagaatggcacaatcacaggaaggcttatgtagcatcgactccaaaacaagaagacatcattcagatggatcgcctagtatgtaacagaaacttgagacaatttatcagacaaccaatcattgattagctatatgacctgaacatttcaaccatctcataacgaagagagaaaataaaatacaaaagtagaaaactcatttgaatctgattaaaaccacgatgtaaaacattactcacaccgtcccaaaatataagcatttctaattttgttcttgatcaagtgtatagagaagaatattaacatctactaccatgtctaataggtaaagtatgaaaatatatttcataatggatctaatgatactcatttgatatcgtggatattgttgctttctttctataaggtcaaacttaggatagtttgagttaggacaaaatcagaaatgcttatatttcaagatggagagagtaaattgtttccatactgccattcttgtgaagacacatccctacatccctcaatagtcaattcatctcttgtacgaaatttaacagtaaacaaaatgtcacgctcatggaactaatcaagtactcatccatgcttactagttactcgtactacagaactgtgtgcgcggttgtgcaaaaaaaaatgcggcaatccaaagctctacataggttcatggatggcactaaacagtaatttttttcaggttatagttctatggcaacaggagaatgtttcacaggtagcagtttttacctctttcccgagctgcaccatctgatccgccttgcgccgcacctccttcgcctggaatcaaccacgactcccagcacataaatccgaggcgcccccactctacaaggtgttcgaccagatcctaggcggaaaggagagagtacgtaccttggcgacggtggtctcgattcgctcgtgcttcacgagctgcgacaccatcgtcctgccgaacagacatgtccatgactccgacacacacagagagatgcggatctcgcgctcgagagagaaggatcgaggccaaatggtacctgagcatggatactcggtgggcggcgtggcggccgagcttgcggaacttccccatggctgcggcggagcagagcgacgagcggcggcggcggcggcggcggcgagggttgaggggtttgggaggtggaactcggttcggacctgtccactccgctaggtttgtgctcccgcgccgacggccttttcggcccagtgggcctcactaaatcccccctccttcgtaggcccgtgagcttgtgggccaagcgaagcaaacacgagagattctaaaggtcaagctatacaggtcagcgaagcaggcaggacaagcacaaaaaggtcgttttggtgagctcgacacgagaaacacgctagttctacacccgtatgtagcaccgtacgtactcctatcgcccgcggcattagtatctttcttgcgctggaactatcatccgttattacagctgtgcctgaccagcacaggagaaagaatgatctctatgctatggaccagcagtgaagcgtatgcgtatgcatgctcaaattcgtcggcaaactgcatgacgtgttaaggtgttacgtttgtttgctgttcacgaatcgctgatgatttgtcgtgctggggcgcctcttggcctcgtgacctagacgtctcatgttttcaacgcgcgcactggtcccgattcaatccgcagtgccgtgcaggcagccacaagcccacaacccgcacaagcttccagcctccgtttcacctacgcactgagccactgaccgacccgacctaatacgttcggggacatgtgcgacgaaccgatacggacagacgtcgacctacgcaaatattaaaaggagaacctgtgcgtacggtgtcgctcgctgcgcgcgtctcgcttccgaattccgacacacctcggctgcgtgaccggatcgattgcatacctgacagtaggcacgcatggcctcagacgaatcagtagaatccgtactgaattactggtccggtaatcaggagtactagacgagtagtagaccccagtaatcagcaggcttcaattaccggggcgcggtaaagaacaaagcgcgaaggctgcggccgggatcgagacgcaggagcgcggcatgtgagtgaaaagaaaaccggcagcgcgagctgagacgccggccggcgcggatctcgatgctcgcggcgaggtgtggcgctggcggtggcgggcacccaccgcaccgcaccgcccccatctccgtgaggcaaacgcagcctcctctctcctctccggtttcgcgcgcgtacgccgtgctgtctcgctgtccgcgccataggctacacaccccctccattttgccatctcgtagtcggtggagccttccccccttgtcctcctccgctgcaaaaccctgacgaagcgaaacacctctctcgcctctgctttcgcgtgcgatagcggcaggcagccgtctcgccgacgcgtggggcctcgcggtggtgggtcacgctgcttaatggcccgtgttaggttaacgccgggtgtttgccgctgctgtgtgttaatcagcaggatggtccctgtcacgtggctgggattagtatcacttgtcgcgtcgctgatctctgtgccatggcaaagcaaagcaccagggcaggggaggggcagggagtttaattgggacttggaaggaggcccaaatggacaggacagggattgcagccttcccatgcacgcaaatgcttccaaatattaatactcgcagcatcagcggggaaacccaacccgtgctccaaggcttcacatgcacggcttatttgtctacggacacatcaggcattaagagacagcaatcagattaacaaaccatccaggacttacagtgcactgggagttggactcacagagcgttagcaagagtcttaagagagagggagaagtcctcgattggctcactgacatacgggcccagcgactagtcttggtcagcgtcgccgcgccccatacgtgtgggcctcgttagtcaaacgttttcgcttaaaagaactgctttggcagcgccgaaccagctgccatttcaccaccctctagagtcccccacaataattacccacccttaatccactggtctcacccccacactgcaaacaccttaattagtactactactagtcaacatcaccggtaattaagctctaggtaccagtacttaacaataggacagtctaccatacatcagtagtgatacacaatgcagcagtgtgttgacttcaagaacctaaaggagaaagcaactaaccagagagctagtgaagcttttctattactacaaatcctctgatatcgctgctctcgcctccatcaacccacactctgccccagctctctcacagctgagctggtcctggcatcgtttgaatgccactcatcactgcctccgctgcgccctcctttgcaccttcccctgtgtcgcactcgcgccctttaagcgctagctgctgagcggtgacgacgacgcctgcagccttgcattgcagctcgctgcatatagctcagggattattgctgggggcagcagcagcagccagcaagggtaggttaggttgacgaggatggcagtggtggtggctggcagcagggggaaaggggagcagcagcggctgccgtggcgagaggcgcagcaggaggcgaggtgccccgacatggcgccgtcgcggccgccaaggccaaggccggggccggcgagggccgccgtcgtgtactacctctcgaggaacgggcacctcgagcacccgcatttcatggaggttgccgtcgcctcacctgacgggctctacctccgaggtacgtgcgtgtgctcagcttgatcgtctcgtcgtcgcgcgtttcggtttttcttttgtttttgttgctgcattcgccgccgttccgtgacgtcgtcgtcgtcgttgctgtgcgtagatgtgatcgaccggctcgacgcgctcagaggcaaggggatggcgcgcatgtactcgtgggcgtccaaaaggttagtttttttcacgaacttgttcttgttgtggcttgcttgccagtgaggtgcaagcgagcattggacatgggatcgtcctcaatgttgtggcaatattgcaggagctaccggaacgggttcgtgtggcacgacctggcggacgacgactacatctacccggtggctgggcgagagtacgtgctcaagggcacggagcggctgcacccgatccagctcccgctgctcgacgcggccgccgcgtcgtcctgctcctcgggctcgcaggagacggccacgtcctcgccgcccgggtgggagaacggcaccggcgaggcgcgccaaaagaagggcgcgggaataaacacgtcggagctttgtgagtacagggtgtacaaggccgaggaccccgccgcggcggccgcggacgccgcgacgcagaccgaggacggttaccgcagcagccgcggtagacacgcccagcgcgccgcggccgcggcggcgcaggaggagctgagcagagaggagacgtcgccgccgacggcgtcgacgagccccgagacgctcgaggcgctgatcaaggcggacggacgcgtcatggcggccgtcaccggcggcgggaggaccagggcgtcgtccgtgctcatgcagctcatctcgtgcgggtccgtctccgtcaagagcacgctcgcctcgccggtgatggctcgcaccgccgcgcactaccgtccacggccaccgcgcccacctacactcgcgtcgaccaccaccgagatcccgaactaccgccaaaagatcgtcgaggacaaggagtacttcagcggtagcctcgtcgagacgaagcgctcgtcgccggccgacacgtcccaagacattgccgttctccggcggtcatcctcttacaacgccgacaggtacaccaatccatccatagctggttaattagtcgcaaaacatcaatgcaaatcaatgttcaacgccagtatccaaatcggtacgaccagttagttaccatgccgtagcagtttagaactccatttggttggttgaatggttgcctctaaatctctcgtagagtcgtagttgtaaggaataacacatgaactggtactgttgcattgaaccatactgccgtggcggcagttaagaattgctagtgcggcactgaactcctctgcaaatgccattgctgtacatgcaagatatgaggagtagtgtacctgattagtggttgcgttcataaatggaagtaggtctcgcggagctgtctcgcacagagccgacgggatgaatggggaatgtcagggacggggcttgaattctcgtcccgccctaattaatccatgcgagccttcatcgaaaagccttgattagctcgttgagagccatatcgcgtcaatgataagccgcactcaatcacgtgtgtgacgaggtgagggatcggagtaactaatgaatatgacgcgagctcctagcagcagtagcaccagcctttgtcagcaatttgaagtcattgaactctgctttaagcgtggtccagagccctaacccagaacctgataacgtagttatcatcatatctgctgctgcacggcgctcgccgttgcttaaaaagaacccaatactactagccaggctagcctgcctctgtgtggcgtcatggagtacgatgagaatatgatgatgatgagttggtgatatgatggtatgctatctctgcctcgcggcatggcagggtgcagaaggtggagccgtcgacggaggccgtggacatgcacgacagatgcatcccgcggaggcccaggggcaagaaggacggcggcgcctacctcatctccggcgggaacgggcagtacgggagcaaaaggcacgggggatgaggagtttgggcttgggttcaggcttgcgccggtgtggtgatctcatactacctattgtacgggatgataattccgaaattgatactcctatatgttagccattaattatgttctgtatatgcctctagtgactagcctctgaccactgtctggtgtcttgggttatatcattttctggagaatgaatgcatcatttatgtactaaagaactatttctggagagtgtgcaagtaatctattaggaatacaagcactgatcaaaatcttggacttctagtgtattgggctcgcgtcagtgttacatagtctagcccaagtgacaaaatatgagttggtgacttgggctcacagcccacacggtttgtaatagatcggttcacagcccagactaatacgattggacttctaggaggtccagatacgcctggaaatgttgacctcctccatggaatggaaccatggattagcgttttcgcactttttcctctctgatcgaccgtttcttactttcttgcgggttgggaaagaacacttcctattacgatcatggaaacaaggatttttcaaggatgcaaaacaattgaaacaataagctgtcagtatatttatactagtaaattggtattttacaaagaatcaaccacaaccgaccaactaattaatcaacctatttgtaattttgtacagaagagaacaaatgaatagaattcctatcttacagttaacaatcatttgttacaacttacatgctatgatcatcacgctccaaaatttagttctttttttcgatcaaatttggtaaagaatccatccaccatatctatgtacagacgccaattcaattcacatgtatatctatcgatgcaacttatacaagaaggttaagtaactcaggctccgagccgtcgccggcgtcctccagcggcgggtagttcaggtccggcatgggctccggcggctgcggcacggtggcgccgcccgagtcgtcggcgtccgcgagcacgacggtcgtcgtgcccgtctcgcccctgtgccggcgcatgtggccgccgagcgcctgccccatggagaactcgaccccgcacacggcgcactcgtggacgcgtgccctgtccctttcggccgccgccgccgccgccgcggcggggtcgctcagcagcttcgcctgcagccgcgtgtggctcgtccggtgcccgcccagcgcctggaacgacgggaaccgcttgctgcacgtcttgcactcgaacaccccctccgtcgtcgacgacgacgacgtcggctgcgacgccgacgctgcaggcgacgacagcgagagcagcgcgctggcgtgcacccgtaggctctccatctccttgctctccgcttcttctctcgtgattgtcattacaacaaaccaaagaattccaagtaactttctttcgctcttaatgacgagctaaaaattcccttcacgttggcggacgtactcgttttatatatagagagtacgcggttaatatgcgctaatgaggtgtgatagagtcgttcacgtcaaggttggtgcgcgcgggcgccaaactactaactagagccaagcaagcaagccgcatgagcgagcgaggtagcggtaggaggtagctagcgcgccaggcttggccacgaagaaacgtgacgcggtcgcgctgctcgcgtacgtgtgcatcacgtatgtgcacccgtggcgtgccccgactcgggtcggaacgcaacgaagcgctcggtcgcgcacacatggtttatcggttgggctaaaagtttgcttgcttttgcgcgctttccagaagccgatcattcacaagcctcgtcaacttcaggaactcgcttctgcagccgccgtttcaatttttttttaaaaaaaatcttctcctggagcttccgttttcgactggctccaacagagtgcaggagaatatatcagcaagtgggaaacggaaacgtttgccgcgacgtcacctggcagttgtgtgcgagcgaaaaaggaacactacactactctccgtgtgctcacgggcaggatacggatattcgtcacgagttgatgagtatccgtccagtcatcccacttggctgtccatctcgcttaatcgtgtgcgtacattgaccatctatctggtaactgtacgtacatatcttgacgaatcgaaagtgcacgcactggccattccgtcacgtcagtggacggtgcaacaagtcgtcatggacacccgatcgagctaagctagtgtatcgtgtactgataaatattcgcgcgtttgatcgtgggaataaatctactggaagaaaggatagtgtagcgcgcggcggccgtgtagaccacgtcggcgagaggagcatgcgaaccggcgaacccgcgcggcggcggacgtgacgcgtgcggcgccacgcacggggcgtgaggcgtgtgggacaacgaccacttcgcctgtacgtgtggcgaggcatataaaattccggaacgaattgaaatttaattgttcctcctgttgtttcagttgattttctttttccgcatacgtgtatttcttgtgccgaaaggcgaaagcagaatactgccagtacatccggaagctatttgatggagtgcgcttctcgcgtaccggacgcgtgctactgcaagtcggcaaggtagttacgggtagagtgggagtatatacaatccactggtagaagtcaacttggagctttatccagaaactgatgtggatgtcagtcatgctgatgtgagatactactactaatgtcatccccaacctagatggtttccgtgcccaacgtttaaccgtccgtcttatttaaaaaaattatgaaaaaaaattaaaaagacaagtcatgcataaaatattaatcatgttttatcatctaacaacaatgaaaatacgaattataaaaaaaatttcatataagacatacagtcaaagttggacatggaaactcagggtttacctttttttttgggacggagggagtagtgctttaggctgtgtttagatccaaacttccaattttttccatcacctcaacctgtcttacacggacacaggtcgtctgcagtactgcacatgcagtactgcatgtgcagtactgcaagctgacatgtgggccccacagccctcgggcccacatgtcagcctgcagtactgctgcagtactgcaggggatctcaattggtcatacacacacaatttttcagtcacatcgtaccaatttcaatccaaacttccaactttggaaggaactaaacacagccttagtttccaactttttcttcaaattttaaacttttccatcacatcaaaactttcctacacacataaacttctaacttttttcttcaaactttcaatttagtcaaactttcaattttggcgtggaactaaacgcacccctagggcaagtagttttcatacttgccatatcatataagcactatcgccgtgtttagttccaaaataattcttcaaacttccaacctttctatcacatcaaaactttcttatacacaaacttccaacttttccatcacattgttccaatttcaaacaaacttggaattttggtgtgaactaaacacaacttatgcatagaaactatatatccaatgaatgatgtcttcagattaaattattatctaattatctctcttctctctccttttatccaccggcctcatcttttcgcttatgattatgcttatcagccaaaatttgaattttcaaccttaaatttggagttgattttggagtttttccatcatagtttatttttcagcctttgcttttaaatcgcttagaacatgtatataaaagttttattcacagattattttttatttgtaaatatgatgtttggcttattccaccaaatagccaaacgatggggctgcacatatcctcttgttttcattcttggttactgtgtagagatagtttcttgtataagaaatagtttctttatttttttatctctctccttattaattcttttgccacatggacagtagatgatagggagatgatagggagggtttgggatcgcctaatactcgtattctgaatttctggatgcttagcaactgtggtagtgtggttgatagggcagttggtaccaactctgcagtaagtacagtcaaatccaaagaagtaggtaggtactgtacgagagaagaggggaaacgatcaaaagaagggaatgctaacaaatatactcccatatgctcttttttttttattggatgcctatagtgaaatctgaatgcttgacttgcgaatggatttggccttaagcaattccaacaagaacggtggatttgatttgtaccttttgtagaccggccgtggttgaaaaaacagacagactagagagaagactggacactggaagatgcagtggagactggaggcagacagacggcggcgcgtatatgcaacagcaaatcttacttactccagccatgatttgtttttcattgaaatccagcgatagtttgcctggcttgaaaacaacatcatgttacttttcatttgttcaagtctacatccagaactcgaaatccctgttttttttatgtgagctttgagataagggcagaagccaattctcgacagtactgcggtcaaccttcgcgcggctcacacgtgcagcttgaacaaccgcgtgaacgtatgttgacatggaattcaaaaccctcgcaagaggaacgtggaaattgagcgatgaacatgacatgctctactcagttttttttaaaaagagacatgctctactccaatagagaataaaaaagagaaaaaagaagaaacgagacgaaaaattcatcaaggtcggtggattgatgggctgacgagaagggacgaggttggattggaagcgtcaggcctagtggaagaacgcacatcggcaatgctataatgggctgtactatatctctctctctctctctcttcgggccacacgtcatttcttggaataagttcactttgggtctctctatttgtcgcccagtccgattttcgtcgcttgaccgcaaaaccaggtacgacccgtcccctaacttacgaaaatcaggcaaacgagatccctcggcggttttgaaggcggttttggctgacgtggtgcctacatggcttgtttgactaggtatccgtctcacgtggtattgacgtggcgcttacgtggtaattatatctcagaaaaataataaaaagcttggccccacatatcaactgcacacaaaaaaaattaaatgggccccacatgtcagcctcactcctcacttcttccctctcccttctctcttcttcttcttctccttcccctctctatcgcaacggacgacgcgggtaagcggcggagcaggcgagctccggcagcggcggcgggcatggtcggggctgccccccgaccggagcgccgcggacagcgcggcgtaggcggtgggtgaccggagaagcgcgcgcgccgggcggtcggagtcggcgagcacaacaacgtcggaatcggccggcggcggaatcctcgagctctccgacccacgcacacccagccccaatggtggtggtggtagcagtagcactgcgactgcgcgcgtccccttccacctcccgatacagccaccgccggccgcatacatcgatatatcctaagaagcaatataaactagctagcttcgagagatcgatattcaacaatggcgtcagctctgaccgcctcttctgcagtgctcgtcgtcgtggccttggtggcgaccctcgccgccggcggcgccaacgcggcaaccttcaccatcaccaaccggtgctcgttcacggtgtggccggcggcacgcagctgagcccgggccagacgtggaccttcagctgtcggccgattccgacgtcgcggcgctcgccgactccgaccgcccggccggcgcgctcgcttctccgtcactcgccacgctccaactccaactctgctcgcctgctccgccgcccacccgcgccgtccatgcccagtaaggggagagagagagaggggaaagggaagaagagagagaagggagagggaagaagagaggggtgaggctaacatgtagggcccatatgggccccaccattttaaaattattttttgtgtgcagctgacatgtggggccacactttttattattttccgagttatagttgccacataaagcgccacgtcaataccacgtgggatagagacctagtcaaacaagccacgtaggcgccacgtcagccaaaaccgacctggggcgaaaatcggactgggtggcaaatagagggacccaaagtgaacttattcctcattctctttgttcagcccacaacgttaaatgggctgaatttattcggagatggcatatggcaaaggaataagttcactttgggtccctctatttgtcgcccaatctgattttcgtcccttgaccacaaaaccagctacgacccgtcccacaacttatgaaaaccggacaaacgaggtccctcggtggttttgaaggcggttttggctgacgtggcacctacgtggcttgtttgactaggtctccgtcccacgtggcattgacgtgacgcttacgtggcaattcaacccgaaaaataaataaaccttgtgggacccacatgtcagtttcacacagaaattataaaaaaggtggggcccacatgggccccacttgtcagtttcacataagatttataaaaaagatggggcccacgtgggccccacctgtcattctctccccttttcctccatcgcccttcgccgcccgcgcccgccagcggttaccgacgacgcgactccatccgccgccgcagcccagcgaccggcagcgtcgcctgccttcctgacccgccgcggccacgagttagtgcaagcgcacccgccgtcccgccgctcccgccggtaaggaggttcccctatttccatgctgtatcgaagagatgcttcctccctgctccccgtgccggccatggcaacagtctcctcttcttccctctcgctgcctcctctctcctggtccttattcttcacgatctccgtgtccttcatggcattcgtgatctctgcagctggcgtctccacccgctgtacatcctccacgcggaccacgccgcattcttggccacctgatacgtcggcgcgtttcgccggagtcgctgcctctcctttgccatcaacgggagccttgtcgccatgcacggtaacggtgttgccatcgccactgccgccgtcgtccgccgtgacaacctccaagttctcgagttccttccgagcccataggagtagctcatagcctcatacgcatatacgccgggtacagacggccgcatgcatatgtgtcttcgtacgagcatatatatgcatgcatggagatgaccagctatagcctctagctagcttcttgttggtttgccgccaacaacatgcagacatatatattagccaaacatgtgtctatggctgagcacactcaaatgtatatatgccattacgtgcatgactcatgcatgagtcatatttaattcattagcttgcttagcacattaacgttgttagctacctaatttacctgcttcctgcaaccagccactaacaaaaaatatgcaagcgcggcggaggagcggcggcgggtgagtgcagcagtgggcaaagcagcggagggcgagcgcggcggcggaggggcggcgagcgagcacggccgcgggcagagcagcggagggcgagctaggccgaagcggaagacagtggatgggatggggagctcccccgtgctcggccgccaccaccgccgtgccccagcgggtgccccacggcgcctgcggcgaaggcctcgaggccgtcgatcgcgccgtgagcttggcgggcaaagactcgacgaggaggacgaggtcgtcgtccctgccgaggacgcactcggtggccgggaagagcaccgccgcgatgtcctggacgacgaggagctgcctgtccgtgaaggccaacgtggggcccaccagatgtccctaaagacggtgtgaaactgacatgtggggcccacgtgggccctaccttttttataatttctgtgtgaaactgacatgtgggtcccataaggtttatttatttttcaggttgaattgccacgttagcgccacgttggacagagacctagtcaaactaagccacgtaggcgttacatcagccaaaaccgcattcaaaaccgccaagggacttgagctgcctgtccgtgaaggccagcatggggcccactagatgtccctaaagacggtgtgaaactgacatgtggggcccacgtgggccccaccttttttttataatttctgtgtgaaactgacatgtgggtcccacaaggtttatttattttttgggttaaattgccacgtaagcgtcacgtcattgccacgtcggatagagacctagtcaaactaagccacataggcgccacatcagccaaaaccgcctttaaaaccgccaagagactttgtttgcccggttttcgtaagttgggggacgggtcgtacccggttttacggtaagggacgaaaatcggactgaacgagaaatagagggacccaatgtgaacttattcctatggcaaatgccctttttgacggcccgggaacggcaagctgacctgtcaccatccgatctttctgagccgtttgatccggcttcctccattccgtggctcgctcttgtcattgtcaatgctcagcagggttactactgctctcttgtggctattccgggtcattaatttccaaattgagctactgctgattgtgtacctatctaccccatcgtacagcaaagatggggtttgggattgttggtatatgcccttaagaagatgtaccaatatgtactcttttggtgggggtacaggctattggtacctttctttggttgtagcaccaacaccaagatgatgtataaagttttacatgtataaatgtaactgggtatataccaaatactttttttcttttgaacccaaattctttatcattgccacttcacccatacatcaattcgcctctatcctccgattgacgaggtttctctaacatacatcagagggacatgtgtctctaacgtgtagttttcttatgtcagtgatccatatccctttgactttatgtcacaagaaagacttctattttttatttataccttttgttgctagcgcatcgtagaacccaccaagaaataaaagaaaccttcacgtgcgagacaagagataaaatgctctttttgggcaataatgcctattgcaacaacccatccatttattcaattttgtagccatgtgtggaagtggaaattgttcgctaatttgtatactttcacgtggtagtattgttttagtgaattgatatgtattaatacttcacgccattaatatatcaattaaaaaaatagataaattgtacacttctcatttatgggagcgtatcctatgcacacaagccctcgcgtgtacacatcgtgtacaccaactaaaaattatcacaaaaaattctaggaaaattcatacatgtactttcaatagtattacatctacgtgtaaagtcgtatcttcaaattcattctacatagagaataacaaaaaagataaaattctgacaaaattgcaactttaaaactgtcagattttttgtttttttgttacggctaaaatataatgaatttgatgttaagattttaaccctaggtgtaatacaattaaaagtatgtgtatgattttttctagattttttggtgacattttttagttggtgtgcacgtgtgtacacgtgagggcctatgtgcatagtatatgttgccctcatttataaagataactgtgccgccgcgtcaaagatacacaaagctgcatccttcctgtttgatagtgtgacggggaaactcactaagcactcggtgcaatgcaatagacatgaaaaaaaaaactgaccacatatattaattgtaaaggcattttatttgtaaggcaaacaaagccacgatacaattaaaaatattttagaggcatatgtaccatatcaacataatcaaatatcatagttattcaatgttgcataatcggaattgctaaaaactgtcgcaagcttttttcaaaaaactttctaatataactcaatgtaaccataatgtaattacactatacttacactgagttacatcgaactcagtgtaagtatagtgtaattacattgtaatatctatataacttagtacaaactacaaagttacatatattttttaatacttatacttttatatatatatatatatatattgtagttatgtaaaactatattataactatactgtagtcagatttgaaagatcactttaaaaatttacggcagtttttaatagtcctctgcataattatataagttggacaatactttctgccactaactctcatcacgtagacatacgtatccacagctaatgttttgggatttttttttggaattgctaaaactctgtcgacagaaaatcttatctcaaattttgcaaattttagatcactggatatgctttacgattcgtgctcttcttctctaactccggcggccacctcttcttctctggcgccggcgaacccaaactccagtagagggccaacgaattagggtcctggggtggggtgggggtgggggagggggagggggaagaggggggagttcgccggctttagagggatggccgtgggaggtggcggatcaggcgggcggtgaggcaggaagtggctcttcctgaagccgcggggctgaagactgtcggtggtggccaagcgggcaagaaggggtaggacgaagccggcctgcagtagcgtcccgccgccggcgacggggaagacaacggacagctcgccgccgccgacttgaggcaaatgagaggagagggggccggccggggggggggagcgctgaggagcgccggcgcgtgaggaatcgggagagaagagaggatttttagggtttgattgcctgcacgaatcttaaagcaatcgggtggtctaaaatttgcaagatttttgaggggttttctatcaaatgatccatagacagtcatatttttttttctatcgccaatcagcttgcttagcacctattccttcttttttttttgccgggccagtttagcgcctaatcgtcgacggacgacgggaatatcagagaaccgtatatcattccgtaacaaatcatcgtgggggccgggaatacccaaagattccgtggtacgaccaccgcacggaccggcgaccaaccagtagcgtttgtcccgtcgacgagggcatgcgatgcgagcgccgcggcgagccagactcggcgatcggaccccgccccgttttgccgagtgatcggcgggcgaagtctagattggccgtccagtttggtggcggccaccgacggtgtcccaacaccgtggcggttcgccacctagccgatcgagccccatagcgacggcgtgggcctcgtggccggtggccggtgggcaagccgcactacgaggcacagcgtcaactgggcagactggcagctgtggatctgaatgttttttctctggaactttgctgcaacgtagaattgtagaacttcgacttgaaaaatcgttgaaacccctgtgaagcttattgtgaacttgttgtcttgttgataccttgccaaactttctgaaacctgctacttttttcatttgagaacattgaaacctgctacttgttccaatgttatcctgctggctaagtggctagctcgttgatcccgattctcatctgtcaatcaaaattggcacgtactgaccgaagtggtaatataggtagtcttacaagcagaacaagattgacacgggacgaaatggaaaaacgtgaatgttaattagggaatgatctaatattcaataattagaaggattgaggcttcgaatccagatcgtctagcccaccactttgtagaactagcaggaagacccatagacgtttctctcacgggacataatagataagtttcgatcagttgagctatagctgataagaacgtatagaaataaacaagacaattaaagatattttatggattgtactattagcggtctaaaacatggctaatgataggccggccatgataggccaaccaaatttacttaagactgagaaatatgtacaaatatataaagttttgacttcaatacgaagctgtcgaagtaaatgaaagttgtcacatgagcaacctccaaaaaaaaaaaaaatacaccgagaaattactctcttatatatttctgaaaaccccaacctccttccaaatcgccacttcttttttaattgaaccaaacatgaaacttgtcgagtgccgctggttctgaaacacacgcacatttctttccttccaaaccatccaatgtctaaaaaaaacatggctaaagctaagtttcagttaaaattttgtgattgataacaagctgacaattaaagctcgaagtgtgaatctattcataaataatattggtatctgtagtcttttcaaaaaaaatattgtcgcctgggcatacggtgaggctggagatacgggaaccatgcccagacacgatgtgctgcatctgaatctagtcataaatgacataagagagaaccgaaataagtttcaaacacacacgacatcaagagactgtagcataggtgttaaccaggcttgagtcgcttgaccctgattaaaacaattagaagtgaatatactgtgcataagaaattatgaacaattgtttttcgtagtgattcattattttgatttacaaattgatactagaagaaatgaagaatcgcacatgattcatttttttatataactgaaatggttctctgttgttgggcacacagctaataaatatttatgactaaaatgtcttatactccgatcttcctgaggaattggaagataaaggtcaaaggtgcataaacaatgccatgatgtcaacaacgttgattaacatacggtctactgaacatttaacattatccgtatcactgtatatgttgtctatataatcaaatcattaattagttaaatctatttaaaatagctcagcagaccacacatgtgagtgatttcttctgttagagtatgtgttgaatgtgtacaaagtcaattgtgttttaaaatttggagttataataaatgtaagatataattagggtcgaactctctcgtatagtttctcttaaatagagaggcaccatcggttgtaatcgtataacgataataacatagacgagggatgattggtcggcgtcctatccgatcgatggtcgtggataacatgatacgttgtaattatgctagatcagataggagtcttgtaattaatgcaattgggatgatagattcctaatgtaaccttatttatactagtattatatactatcaatgtattgtactgtacacgtcctttttcaaataaaccttataagaaaatactgtgtcttggtatcgttattatgtttagattatttatggtctttttaaaatgtttggttacttatgttgattttggagccggttttaagatatgtatggcacttaaatatgacgtgtaaagatcatatatattgcaatctgtgctattagttaggcacaatcaagattagcagagggttcatgcctagcaaaaaagttaagcatgagacatttccggtggatttggatatgttcattagtggggcctaagaaagggaccagaaaacgttttcgaggtgatgtactattcccgggaccgtttctacaaggttttgtttccttttttacccttgaatttttctccagaagttgggtgtgaatccattaaccaaataattagaacaaaccaaatggcatatttcattgcaaaattaccccaaaaaaaagggttcttatgtaaacgtggcagatagctacaccagccgatctacacgtgaccaaatcaaggttgttggttcattttcgtagttcataagacatcaggtacgtcggtgtttaatatttgcatacttgcattacaccatggcgtgaattaattaagtacaacatatactataaatatgcttcagtacattttcacatcacttgtgtttgtacatctagtgaaaccaatgcaagctaaaccaaaacatctgttgatcaatcaaaatgctgatgttcttattcagggggtaaaaaaaaatccaatttaccatcccctccttaaggtgtgtttagttccacgtcaaaattagaagtttgactaaaattgaaagtttgaagaaaaaagttaaaagtttatgtgtgtaggaaagttttgatgggatgaaaaagttgaaagtttgaagaaaaaattgggaactaaacccggcctaaattaaactgaccgagcgtgaaaacaacgagaaaggaagagaaatgtgtaaagaaacccatatatagcagtatagagctaccttgtaagcattgtccaagccctgcagatcacatgaaacagcagagcatcatcagttctatcaccaggaacagcaacagagatccccaaaaaacatcagtcagttatacaaatcccttgggcaggttacccaaacactcctcaataaaggtattttttaccttgaatttttctcaactaatttgcaagcttatcaaacaaaagaatctcctctctttctttttttttctttacactacagccctgaggagaccacctaataacacataggtagataacaaagagcattccatttgacctaacccatccatcctgcccaagtctttccaattctccaagccctgtgttgcatctgcatgccatctcatctcatctcacattcctcacacacaaaaaaaaaaaccagaggctaggctgtgtgcagattgcacaagcacatgagttcacattttgtaaaaaaaaaaaaaaaacttgttggattcttgcatgcctctgggcctgaaaaataacggaagcagaatagtctgggcaacagctgctgctgcggctgcttttgtttaggcactaaaacaactgggtcttttcaagtctaagccattgggggtgagttttgctttggttggtttgctcgttttttttttcttttcttgatctcttctcctccttccggggttcgcgttcgcgtcgctctcgtctcgtctcgtcatggcaccactgaggggagccaagcggcggaagcggcagccggagaaggcgttgccggcggcggggcaggcgatgccggcgccggcgcccggcggggattggtgggacggcttcgcccgcaggcttgcagcaggtatacgtcttgccgttcgttcgttcgtctcttccctgtttgcgagcactgtgctcctcgtccttaaccatgtccatgcccgttccctggttccttggctcgctgtaaacctcgcgcccgcgcaccgtaaccctcgtcggcggcgagtaatgcgtgcttaaccccctcgcgcgcttgggattgttcgcgggcggattccgcggggttagatcagggagacccgccgttgaatttgcactgttcgtgcctgcgcggtatctgttcgatgcggtcgcttaatccgcccgtgcagtgctccttaatcagggtggttactgttgcaaatccgctgtttcggtgggctttgttttggaggtggtgggattgtacggtgctccgaggcagcgaaccatctcgggcgggggggatgttctggattggagaccaccatggatgtcgattgctccgagggtatgagcaaggaaaagcttgtgaatgccgttgctctgatgggtatcgatcgagtagaccgtgtttgggagaagaattggttgtgccatctgtggttttgttgtttccttctccaatccagatctatgaagcctttggtgcaatggtattttggggctagaaatttacgggtgctgttggcttttgcccattgtgtcaatctaattcagaataggttggttgactgttcatgccttgacattgcaagaactaacttcttttctctttgcaacttatgaagtaacttcattttgctaaggggaaaacaacatctcccggagaacaattagtctgtacttgccatcgaattgctttgcctgttcagtccagaattgtaaagtgtagcatatgcgttttttttaagtaattagctcatctgttcacaggtagtttccccaatttcatcatccgattggctgttaatatttttttttaaaggaaacacgtgaggggattgggttccaatagattgactggcaaatccagaaaatgattagtgtggctcaaaggtaggtcggttgaatgatgtgttccgagaaatggattcccacgataagtttcttgaatcttatagtacctggtaccacagcaaatactgttttataattcaatgtgatagatcatccaggagtatagattcattaggcctctctgtatggtgttcaagtgagtctttcagagatcattgggtgaagcagcccatacaagtacaatttagcttgaacaaataaagtagatttgtatagctatttgtctggctgctgtattcttattttgatcatacatgttcttacaaaaacatagacaatatatttttgaattcttgaagtcgttagtgatatttattctgagcttccctgattgctgaaatgatctgaaacactggaaaacattggttttgaatgcctacctatcctttatgacaagtgacattgttagaattttcaaattttgacaagagtgacattttgaacaattagtacaaacctgagcatcaagtgtgagtgatttaagaaggtagatacaggaatgatagcattctagtcatctatttaacaagggcagtgtcccttctactgatgattcttctaaattttgaatcgatattcactgtattgccaaaacagctaaaccttttctcatataatatgctcagttcattcatgatattgctagtattgttcattttctgttctcgacacttgtggaccatgttctattagatttgaatctcttctgttaaatttgctatcataaggtttaccccgtttcttcctctgcccttctaatttcaatatgaggagaacgaatcgaattctttgaatttcaatatatctgaattttcccttttatgctttcaagttccctgccaaataatttatgatatgctcgactaacgccactgcgatctttgactatgtcttatgtccacaggacaattttccaaagactgccaaaactttgagtccgtcttcaagatgtcgaggaagacctttgactacctttgctctctgattagtggggacttcacaagaaagacacaaagtttcagaaatttcaggtttggagacaaggcaattctaggcgtggaagatcaagtaggtgttgctctgttaagattgaccaccggtgagtcgcttttgagcatagggaaccgcttcgggatgaaccactcagctatctcaaacatcacttggaagtttattgaggccttggaggagcgcgctgccaatcatcttaagtggcctactcctgaggagatggcaaccgtcaaatctaagtttgaaaagattcagggcctccccaactgctgcggcgccatagacacaacgcacatcctcatgtgctcttcagctcagcctaacagcaatgtctggctcgacggcgagaacaggaacagcatggtcctgcaggccatcgtcgatgccgacatgcggttcagagacgttgtcagtggctggcctggcagcttgaatgactcgtgcatcctgcgcacctcaggattctacaggctctgcgagaaaggcgcgaggctggacggacaaacggagcttccaggagagccagctgggtcagtggtcagagactacattcttggggatgcaagctaccctctccttccctggctgatgactccataccgtgagaaggatctatctccggcgaaagccgacttcaacaagcggcacgccgcgacgatcatggtggtgcagggtgctctggccaagctgaaggagaggtggcaggttctcaagggagagctgtggaggccggacaagcaccggctgccgaggatcatctacgtctgctgcctgctcaccaacatcatgatcgacctcgaggacgcggcgaggggcggcatgccgccgtcgcacaaccacgacgacggctaccggcagcagttcagcgatgtcgccgacgtcggcgcggccgcgctgagggaccagctgtgccagtatgtgagcaggattggcagcagtttgccggcgtgattctggtcgctttgcttgattacttttgtctctttttgtttaccttgacatgagatgaaacataccaacaggtgatagaattgtaatgcgaattttggttactttcgatgattggtcggttttgatagcaagtattctgaaattagtcaaacattattaagcaacttagctataaagaataccattcaaattccaaaccaggccgaagtaaatgtatgtagtactacgtcaaaacatggcggctgtatactgaagacaatttggaaactggctcgtctttgagcagaaacatgttgctacatggttactgtgctcgattacagccaagatcgacatgaaaccacaagagtaacaagtgtgccgaccacaaccttcttaggatgacaatgatcgccagttaagctgcacctaccactaacccgtggcaaatgttcaaaggacattgcaaactgggagtactgatctgctaacagagacactatctgaggcttgctcatcgtcaacctgaaggatgacacgccatcagctgaaaatagatctcgcaaagtgttctcttgccgttgctagggcactgcttaacttctgcatgtacaaaaaagaattaattcacttgggaattttctcatgttggtttggtggcaattacgacaccatgattgcatctcattgtgcaattgcacttaaggtgatgcgacggcttgccatacctgctcagtgagagacccggatccttccaatccatgacctgataccttttcaagaatcgcctttgcatctgtttccagaacaatcctgcaaaacccgattgtgaagaaacaattagtagcgtcaatcaataactacaggttgtcaaatgtttaatatgcctgattgtagatgttctacattagcatagcatttgtgcaaatgtttatctgaaaattggttggctgtgaactgagcatacccaacaatgaactataaaaatattatagataactgatagctgtcaatgctgattttgtgtaaaattctggctcaattctcatcacctaaacaaggccagagtgtagtttctttacattaaccaactagtgcctaacctcacatttcagcaatacaagcccaagaccttgtctgttgcctttgatatgaacgtaaaaatgtgatagttatcaaaactgggcttgttcaattgatggaaagcaaaggttagcatattgcaatgcaaacatagtaattaccctccatcaacaacttcgtcaaggcataagaagataagatccaagttttcaagcgcagcccttctgtgcactttgtttctgaaaacaagaaagagagttgttaaaatagtatacagtactgacaagcatttataatggatgttaaaaaagataggagtgtacggcacaggaaatgtccacacctgagaaggtaatcaatagcttcagagaagccctgaagaacagatgctaaaatgagctcattctcttcatcacctccagttacaaaaaagtgtagatcttggatgaacttgtatacaacgaagtaactgtcaaacattactatctcagctgcaaattgggaaagaaaagaaagaaatcactggatgaatatagttggatgacttgaactaaacaacctaccatgcaaattttacactcatgtgcaatgcaattattctaaaatcccccaaaatgaatgatcaaccaaaaataaggcatttcagatgacacaggcatcgagatcatttcatttgttggaacaaaaattcatttttccgaaacttgaatctttcagtcaattttaagaaatgcaacggaattcatgagcagtaaaaaacagataacctgttattctataatataaggttagtattccacagcaaaatctggtgataactctgccaaaattcagaaatcgaccaattaacatctcataacaagcaaaccacaggtttacagaagatgagccaaacaatggaatgatgctcgaactggaagatatgtgtatgcctctagaatattccacaggagtcttacaataatcaacaatgccatattgtgagatgctaaattgctaattgatgttctcagggataaggcagttgttctctacacaagtagcacagagcaccttttttttttgaaaaaaaagaaacaaacattgttttgattcttccagaacagaactagaataaaagtatattttaatcaccttctgttctagcgctcgttttctgggttttagcaaagaccgacttctcgaaagcttgcttcgaggacaaagagggccagtcatcgctgtagtacttcaccgccacgcgcttcccttcggaatccagcacaagaatgttcttcaccgaaggacaggattcctgcacgagcaaacgatcaaagccaaccctttcaagaaattatttccagacagcaaaatttgggaaacaaaaacataaaaaaaaggtcttattacgcataaaagatatggaatggcacgccgagtgaccaagaactccggatttttcaccatctgctcttggtcataaaccctaaacgacataactagaccgaagaaacagagatgcgcgcaattaaacatcgtgagaggagagactggcggaaggaaattaccatctcggggaagcggatttgcagtataggggaagggatgggcgcgatgccgcgattggctggtggatttgtcgcggattgctgcgcgagcgaggcgatggcggaggggaggagggagcgagtccgcgagaccaggacgaggacggaggaggagaaaggaggcgagtgaagcggatttttccttttcgggtacaaatccgataactgcaatatcatgatccggcccaaagcccaaacaacggcccataattattgggctggttacagacttacggttaagaaaaagataagaatatcaataaataaatccttcggccaggggcgttagagcccattcaaaaaaggcattgttttgaataagcgaaacggcatatttgtaaacgtaaattaatttgtaaataaaatttttatatacgtgtttttaggctaaaaaataaactttgattaaaaagaccttaaaatcagcttaaatttaaattttggccgataagtataagtataagtataagcgaaaagatgagacctaaatttttacttgattatctacttgattataggaataatacaatattttaagataaacttaacaaatgacttagaataagtgctggttttttttcttgagaagtagcatagagcaaataattcacagcaataatttgatgaagtagcagggcttaggctgtgttcgttgtgctagttgaaaaccttctattctcttccagcacggaaaacggagtacaatagcacatgattaattaagtattaactaaaactaacttaaaaaatagattaatataattttttaaagcaactttcctataatttttttttaaaaaaacataccgttaagcagtttaaaaaacgtgtgcatgaaaaacgagaggggagtagggaaccctacaaaagaacgcagccttaatgggcctacttgattctcttccatttttagtattgctaacatttttacaatggcaaccattggcaagatttggctattgcaaattatttttttggcaaagatgattgcttggattgctggcaagattagttagactagtaacggaaaaaaaaaggtatcgccaaatttgtggtagcaaaccaaacaagtggcaaatgttctggcagagccaacctttttggtagggttgaatttggcaaataaccaaacagccccaacattttctcttagcatatccttggtcctttctctatctaaaattaataaatagatcagatacaaaaatattagggcatgtgctatacttgcaaaatgtcctgccaagtttcaaatggtccatagatccttgcctcattgggttctttttctggaaactcagcttggttgaagagagctgtcaaccttacacacttaatcagcactcttagctaacctgaaacaagacttcaatctcagaagcaacttgttatctcatcttctctctttcatcaggtaaggcttttcagcgacaacttgagaagtactgcacaagctagcttcctaaagtcgtctactccggcaagtaaaccgaataactctgaaaaaaagaagctgcaaattggatcagtggcgaggtcactactactagtccttcccgtgtgttgacttccttcccactggatagctaagtcagtacgtagtcgactgctaatcaagtcagaactcagtaaatcaccttcaaaagcagcacggtatcttctgatcttgatgtcttgattgcattcagagttgcagacacagcaacagctgggtagttaagttttttctcttgacctgggcacatcctggtctgaaacaaaaggggttcaagggtattttctactgaaaagtagtagaaggaaacgggctagttcaggttcgacttgtgcacatgttaatcggttaagaatagtagtataacgaaaattaagtgtgaaatttatttcgtctcgaattgctctttgaaaacctgaaaatactgggaagttggctggcttgaggatgagttcaaggaaaagtaagacaaggacgatggtgttctgcttccacagcctgtactttgggttggaatcgagtagttgcagcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20517 - DNA, 844 bp, Oryza sativa
aggctctcacttaattgtgtgcttcgcatgcccaatgtaaaaacatctctcatgtagcattctgcccacttctcccttactttatatatactatcaagccatgtttgtttttgtactttctttctcatagcatcaaaagcttcttcaaacttcactttatcatcatggtcatacatgcaagaactgaattctgtaagcatatttgtttcactgttcctattactaggtaaatgcttggtggcattttgcattatatgaaaagtgcataatccatgccatgcttctgtaaatacatgctcaattgcctttcccattgcaatatcttggtctgtgtatatagttctatgttgcttttgattatgtgttgccagaaaagtatcaaaaagccatttgaatgactcaaatgtctcatcatataagagggcagcaccaaaaatagcagtttctctaaaattattgaatccagtgaatacaccaaatggcctatactccctgtttgtttcaaaagtagtgtcaaaagttataacatcaccaaaatgagcatagtcaacaatcattttagcatcagcccaaaatatatttgtgatttggtcttcacaatccagttgtacagcataatggaaagatggattttcagtgactttgtcctgaaagtattttaacatacttacttgctttccaacccccggttaaacccacaaatttttttttttaaaaaaagacgccccctctccctttggtgcttagtatgcaaataattttgtgatcctaacgagtataactgagaattgcaagatcccaccaacatgtctactagctaattcatgagcagctttgggtccaa

SEQ ID NO: 20518 - DNA, 28325 bp, Oryza sativa
  unsure (1)..(28325): unsure at all n locations
nnnnnnnnnnnnnnnnnnnnnnnnnnnnnnnnnnnnnnnnnntttgggcaaggacttgtgcgctttggttgtgtttaggacataggttatcattcaagcgtttagtaattgtcttttactctttggcatacgtgttcatatgcactattgtctttaattgactgtgtctaatttattcacatgttgtttttcttttctttaccaaaaatgtacaatgaggaataactccaccataagctttattttttttatgattaaccgattctctgatattaatttattggtatattacagtcgcgtcgcatgcaaaaattatatcgatcttcacagacgagcctataaacacgactgcatgtgaagatcgatgtccgcatgtgcagcttaagaggccagatatccgcatgattgggctggccggtgaaatcctgatcatagatgaatggccctttcttcaagatgcctcctattcccaaactgtagttttgcgtacgctaaagtttatgttggcctctgctgtttctccgtcagttcacattcttttcagccaactttgctgctgagttcaaaagcagataaaggagaatatctaaaaccaagtgagtcatagatatatcaaaatggcttgtggatcgatcgaggaccttctttgtcagcctttttaagataacagaagaagatagtggaagcagcttcaaaaagaaaatgaaatagaatacgtaaaaatacaccactacttatgacatttaactgtgggtggtagaattataaccgtgcttaggctgaacggtgtggttcttttctatacgaaagttgttttaaaaaatcatactaatttattttttaaagaaaattatctaatacttaattaattatatatggtaatcataagtccctccattttgcatgttaaatagattagttctcaacccgaggaaatgaacacagcctaggataccaacatctaccagtgatatcttcttcccgagtctttaatttcttctgaataaatctaattagaatatggccttctatttatcctatatatctataaagtttatccctactaaatatagttaatgttaattctctcttctctcatgaagccacatcatcttaattgtttgtagcatttggatgattcatcaatactgtaaattgcatctcttcacatcatctcaattgtttttagtttttggatgattcatcaaggatacaaattgcatctctttcctccaaaagacacattatacaacccaatcatttataacctttgaataattgataaaggtaaaaaaatatataaatacctgaaaaaaatcgtagaataggtaagaaagaaagttttaaaagtcatatatatattatattatcacacaattctttcatattatattatcacgcgcgaggtacccagcttgttttttttaaagctaacactcaaaaggtctggttatttccacctacaaggcagtggaaggtttaattacacgtgcaatctatctacatacagtagacagaaaaataaaaaaaactcaaaaaactgattatttttactttgtatagatcgattaagcaattacaaagctactgccgatgcttgtacattgcaagaaattagttcatatgtcatatttgcgatcactggtagatctccttcagtgcaaagtaactgtgctatgcccgtgcatgacaggccacccttttcttaataatttcctattgcttctcattcccacacaagatatatgctatcatcttccatgcatgtttcaaatgatgcaattaagcatgaatttatgtcaccagaatttcatcacaaattgttaaagaactgaatcttaaatcttccaacgtaattgcgaagtgaggcaatgggtttggtaagagagtgagactagctcaggtgagggcaatgaggtatatatagactaatgagagggacaagcttaaattttcttttaccctcttgctattaattgatagaatataacccaatggtccctgcacgaatggagaagcgacattagccattgatgactgatcaggagctagcgctatacatctattatattattaaaacagccttaaaagaaagcaccatgttcattgtgggggctagaaatttccacattaatagagaaaaagaaaaaagagtccaagtagaaatacaatctaaaattagctaaaattcggaattaaaagaaagcaatattgaaagaagagtccatataggaacttaatatgagattaacaaaattcagaataaaaataaaataaaatccaaaattaggcaaattataaataactaaaattggtgataaaaattaaagactattgaaagaaaagaccatctaaaacacatgacaagattaattaagtaactggcctatacaggagcatagtgctggcggttaatgcgacatctaaaaacttgacgattaaaaagaaggacgacgggcaggttgtgaagcaatcagtcaagacggttagcgggacttctagaaagtaaaaaaataaaccttaatgataaccatgtttaatttttaaaatctcaattacaataaaaatgagaagcagcggacgggtcatatcatgtccgacgcgtgccctagacaccacagtccaaagtgactcagcactggcgtcttatccatatcctttcaactccagactagccggggatcccccataaacttgtttcatttatgtcagggcatgctgcctcacagctagctgtcgagcatgcccaatttcccatcaagttctgaggtcgtgtcctcctacgtttaaagaaggttacgtttaaagaaggttgattattctcggatgagctttttgaaggtgtcattgatggaataatatcccaagattatgcatcttgtacatttggatgcccctctagacaaaaggatgcgagtcatactagtaccaaggtgagcccggggcccggggcccggagcaaggccgggctcgaggcaaaccttagtttatggggtgtttggttcatggccacactttgacacaccacacttgtgacttccacaatttgttagacatgtgtttagttcactgccatagttgtcccacatgtcgtagactcaatttttttgtcaactttaccacactttgtggctagcaatttatccaccatacttttgtagctgccacaacttgcctagcgttagttgtggcaaagtgtggccggtaaccaaacacaccctacgccttcatgcttggttagtatcgtcactcctttttcccgagtaacatgtgacttgtacgggctatggtgagccttgggcccaagacttggccgtgcccgaggcaaaccttaactcattctcttaagatatggttcttgcatgttcctacgtccctcttgctgaggaccgtagaacctactagggctagggtgagtctagggcccggaacagggccgagcccaagtcaaaccttggactatattcttaacgcatattgaggtatgcttgggacccaaactaggtcccatgatgcttttcagatttttgagttacatacgcaatattctccctaagccaggggaaatcccgtgtatgaaatcttagatgggcctggggccctccagagtgggcccctaaccttgtcaccctaaagttaccgttttatttttaaagacattctgagcatgctatttatttgataatgatccttttgctagataaatggatacactggttccgatttcaccgacacatattagagtacaatagtgtcatgaaagatttcaaatttgttcgattcaaaattactgcggtcatttatcacttaaatagtatgtgtttatcacaaatatgttaatttttttttttgcaaaccgttcctaatgttaagtacattgtccaaaaagtatgtgtcttttcagaacatataactggttaaattctaaaggggacttagtgtttaatgtagcacattcacaatgtatgcctaatacagaagaaaaaaagttggcctctatctaactagtacaccgttcatcttttgtatcgtgtttggtgcattctgcttcagccatgctctattcatgtttttcattccttcactcaccgtaaagaaacattctcttgtcacaaaacaaatccagtttaacttagcagaaatgctcaacgacgcaccgaatgctctaattattctgaatatattgacatatgatggcgtgaacgacccaaagaggttttattagaactatgatcaaatctggctaattctatacataggggtaccattgagctagtgaaggaagagagagcgactagccctgatctacactagtattctgcattgaataaaaatgttgtaagatcaacgtgtgttttgattcttattctgtgatgaataattggtatatgtgattattggttttgatatttggagattactgttgaagtggttttggatataactgttttgtcggttttgttgggaccggtcagaccgggcggaggttgccggttagaccggcttgtgttgagcggtcagaccggctagccgacgatctgaccggccgacgctgtgtcggtttcggtttcgggttgtttctttggatatccgtgattgtttcatggttatggcttctagatggattctatacatatgtaatactgttatttgctactaatgagtcaagttggggatagcttggtctcggaatatggtttctttgtttgtttcctgtgtaggtgactcgatgcctcggagagtatttgcggtgatggaccgggagtcggcttggtggtaagacgatgtccgtggtggttagatatcatgcgggatactaaggctaaagttgatgcacgtggttgatggagattccatatggcatacgatggaggtattgtgtgcgtatgggatgcggagttgaatttggaaggagtccaaatttggtatgattggttatgtaaagtttgtgtcttgtactagagggtttcctaaggtgtttagggctcttagtatgagtttggttcgtggctttaggctgcctacctcatgtataaatagagggggagcgtgaggcttcctggtatcgcttttgtatcgcttttcagagcgtagagttgctagtttagttagggtttcgagtttagttgagatttttgtaagaagtgctgttggtgtactttgtaaacacagtgagaagtaataaagttgtcatctattttgagagttcttcgatttgggtttcaccgggtttcgacggtctaaccggtgactcaccggcggtcagaccggtggcaaggcggcggtcagaccggcggcgcaagcaggcagcggcagacgttctcggcggttcgaccgatcgatctacatcggtcagaccggcgcatccacttcggtcagaccgcgatccatcggatttgagggtaacttttatttccactaaaagttttggtttttggatatatcaaccattcacccccctctggttggcttagttcttatgattcgatcctacaaatgtaagttgtgttagatccagaaaatgtcggcattgagaatcaaatatcttgtaaattattccccactaattgtatagttactaccaagtctctcttctcttatgggatagcgctgtaatttggtcgaggttgacatagttctacaagcttccctgaatctgcctcccacagcacacgtcacaacacgaggtcttttggagccatagcgcgcgcgcccacatgcacaacgtagaatatgccatgaacaactgaaaaacctgatgattgccccaaatggtccaataaagctaccattttatcctaaattgccttccattcctattgcttttctctgacaatgaacgatggagtaagaatgtaccgtttcctttacaaataaactactagtatttgtattgagatgagaaccaatatagatgaagcagagggggtgaggggctgggtgtatttaaatgagatatagtgtgcaatataattaattatatctttaggctgacttctaagctagatcattaacacatgattgattgagtattaattatttcatacttaaaaatggattaatataattttttacaaattttttacaagtaaaaatttggcacgaaacatatatactattgcnaacgagggagtagctccctccaaccttagaaacaaaacccagctttagtcttaccacatcccgttttaccaaatacataataacgtacaatattattaagaaatattttgaatttgttagagtcaaaactactctggttatttattccatccttgatcagtctgttctaacatgaatatgttatatatttttttgcaaaatctttcagctattgttacattatttcctaaaaaatatgtccctttgcgtagcattatttatgatgggttaaaggctaacgggtagttggtgtttcagtttagcacgtccacaatgaacacccaatacagaagaaataacatatgtagtgagcgtttttctatcaagtacaaccttcatctttttcttccttcattcttatttggtacaccttgctcggctccaggatgctatctttatctccttttttttcgcttagaataaagaaacattctcttttaacaaaacagatccagtttaaacctgctaaaatatttaacagacatatacggaatgctctattcattctgagtataatgtcatggagtcttggacaacccagagaggttataatagcacgatgatcaaatacgactagttacatacatatggctgccagtgagtatatatggccaaatgggcagcccggcacggccgggcctgagccgaggtcggtcgggctggcacggcccgacctacacgccgagccgtgccgtgccagcccacgggctgcacacacggcacaggcatggcccaataatactcgggacgtgccgggccggcccgaaggcacgacagccacatcgtgcttctccacgggagattagtctattattccttcctaaactctatgggttgtgtctatatggctgaaaataagtctactttgtattcttcttgtctttgggccttgccttttatggttaagtaagcctattttacgtccttctactatttttttacgatcgtgctgtgccgggctggcccatcatgccgagggagcggcccaagcatcagtcggatcgtgccgtgcttggaacgggccacgaccctcgggccatatggccatctataccagtgacctagtgaagctagagagatcaacttggtcacaaatagctatactctctctctttaaatgcatgcaaaggtagtcatatttgatccagacaaacgcgggcaaaaggaaatcttatattcttttcaaattattcgccaataactataattaatggtaattcactcttcgctaatgaagtcaaccgtttatattctatagatgatttcttttttttttttttgtaaattgtttttctacaccccattaagccatatgcacatcatctcaattattctacctttttctataacaccatcttattatttttagcatttggataattaatctgtcatgtctcatctagtatgaaagtaatgtcatctataatatggttttagtattggaagatctatagaagttgtaattttgtaaacaaatttctcacaactgtcgacacatgctctttttcaattgagctagtatggtcagacgtaaatatacacttgccttgttcaacaaaggtacatatagcttcttatgtagagctctgctaggtcatggacaccgagaagatttgctctcagcatcgaatggataagagtacaaccacaatccttccccttattcgcaccgaaggaaacaacaatgacccaatcaaattaagaatgagcaaacaaaacggaactaatttagatatgtgcatgtttccacaagtgcataccatgtaccatcatacatggatggaaacatcaaaaaagatgcaaatctattctcacagagggaataaacagaaaagaaaaacttacacgagttatacatcaaaccacaccctaactttggtgcaccacttaactagcttctaccatgagaaccttcctctactggcgcttacaaagctctggacaaccccatcaagttattgctagttgatatttagcacagatggataacctagtagtttcccatggcctccaactcctatagaacactatgatcgatttaacataaaaaatgacaataaatctcttacttgattaaattcttgtagctgtcttacaaatatcgtttggcgttattcattggaactagacttcaatagggcaaagggaagaccatgggttcgagatatatagtgagtgtgtgaacaatcttggagtgttaactcatgagtgggtataagatataaagacatacatgacgataaggaactagggtcctcatcttcctatagatattgataagtctattatggagactcgacgttcatgaccaaaagactccgataaagacgatcgaacccctcgtaatcactatactacagcttccttggttttaacccgagccgaaacacaattaacctcgccggtaaggctatctcctacaagtgaatcgagaacacaagcaagagagtagaaaacgaaatctcataaattggggttccacaatcaaaaattacgctgaaactgctatggcagataatctaagcaaaaccctaccctaattcatagacacctattgaataaatagatttggtcaaccaaggacccttagatgcatccctaatggacttcaacatgatgcgcagcccaacgggcctaaagacggtgacacggcactgaacagattctggacgctctatagttccaatggctctcattgactcacatggaattttgacgtgagactgggcatataggaaaggtaatcttgcactctcgttagctttccataaatatgtagaacatcaaaaacatagtccgaatgagttatggccaacgattttagtgtgggcttatgtattttgaggtgggctcgaacttgatataaattgctcatccatctccaagcatctcttcgggagcttcccgattcttcctcgtgcttatccaaaggagtgatgtattatcacatacacaaaacatatattcctaacagtaacaattgctgctcaggtttacatatactactgtggcaattaattaagttttacatattctgctctatgttacaatttaatgtttaacttacaacaacattaaattaatgctgcttgtttcttcatccccactaaaacaaaaattaatcaggattcattacagcacgaaggctgcgttttgacaaatcagattattacatttgaagggtcaatacaaaaaatcaatcccctgaaaacacgcaaaaaaagaacaggggcaatattcaccttgtctaggagtaataccgttcactctgtttaatcctagagaaaatccatgaaatgccattgacaagcaccctaatcccagaaatgccatcacagccatactgctgttaactcctccccgttaagttgtatgaaaagacaatcttacccctgggcaacctttctgctcaaacatcaacattttgttttgtttgctctcacaacattattttgcattggtgcatatttttaaattcagacatcattattttgccatcaatcaaattatttcaaaattaaattcacaaattttggcatcaaaattatttcagaaattttgctatcaattatcagggttgtgatatgagcaaaaataggggcatcaattatcagggcaatacacacagaaagtaccaattatgatcaacatgaattttcacaatataaagggttcacagtacttagcatcacaacccaatataaaggttcacagtacttagcatcacaacccaatacaagagtactttgcatgcttaatacatcttagttcagacaatacatgtgacagtaagaaactcaatcaattattctcaccttgcttctagtccccattgatggactactctgcttgcttctagttctcattgctggattgtcatgtggtatttcattattcttcctccttttggcaggtggagtagtagcttgtactattggggatggttttctcttgatcttcttgtctttgtcctccttctcatccttcttccccttccccttccccttccccttccacttccccttcttctccttccccttccccttccccttggcaacaggtgcaacaacttgttgtagtggcacaatggccatagagctgaaaaaaatcgttatttagcaatcaatccatcccctcattttcattctccccttcactatggtccaatctatctacaattccaccaccaatatctcattcacataatgcagtacaaattcttcaaatgaaaccaaacaaaaggaggaaaatggatccacctgagagggatgtgccacctactgggactattacggcgctgcctgcgacctcctcgccagcccctgcgaccaccgtaccggtgcatgcagcccccgcgtcaacccctgtgctgccgcttgccacctccttgccgcccgtcgcctgagagctcgctgccgacgcgccgccgcgtgcgagccacgcgccaccggctgggcccgcacgccaccgcctggtgtcgccacatcggcattgagggccgccacgccgctgcctgggtgccgcgcaccgctgccgggggcccccgcgccgccgcctgggagcgctgcatcgctgtcgcttgggagcgccacctcgccgccgccagggagcgccgcatcgtctctgcccaggagcgccgccccgccaccgcccaggagcgccgtctcgcctccgccggggtcccctgctccgccgcctgggggcgccgcatcgccaccgtcgtcgcccatcggttaggtttagtgttctctttttttctccaatttttttcttttaccgcctctggatagtaaaatttggagcaagagtaatctggtcattttggtaaaaaaaaaattctaacggtgtggactaaacggtaagttgactgtgatggcatttcagggagaaaaacacttgtaagatggcattttccggaagttgcgcttgtcgatggcatttctgagattaaagtgcttgtcaatggtattttatggattttctcatcctatatctttttctacttccactattaaaatgagcatcactctctataaaaagtaaaaattaggagtagaaaaaataaagaggaatgactatgtgtcaggtgctcaagagtaaccaaactcggtccacttgcttttttggaccgttagatccaaaatcagagacgcagataaataaaaaaaatctcaaatctaatccaagagtccacgacaatgaccaagacttaagagaaactcaatttcctgacaaatagacacaccataaataagaacctagtaattttatttgccatggatgattcgatgaaatagtgagcaagaagcgccgtgaggagagaacggcaggactggaaagtggaagcggttgaacgaaatctacgtcgattcaccgtcaaacagcagtcacttttgtgcctctgctatatactggtttccatgaaaatgcagttgtttcttcagcacatcatcaccgttgttgcccaagaagaaacctaacgtaaccttctttcttcatcattggtcgtaaatttcatggcaacaatacaatgcatacgattcgattataatttagttacactttgatcaaatgaacttgtcgatgaagaagacgggaaggccagccagcgtggttaatcgacatccatgtcgccgggccggaatttgactacattctgcgggggcatggctgccgacaactccaaagttgaggcatcttcattctcttttttaggggacaatggcacaggagctctgcctattcattaaagaaggagagtttaagacacaagagatcacatccaagaggtgtcacaattagggaaaaaaaacgaaacctgcagcactttgaggaagtgcgcaggcactaacatcaaaaaccggcgtaaaatcatgtaagcattctgagcatcatcatacgctttgcacatgctaataatggaatcaaccacctacgacaccgaggcatcttcattcaccatgatcgttttggtgctaaccttggcaacgaggccgtcagaaccaagcggcacaatatagagccacaataatcccaatacataatctgtcagccattttagccttctctaatacgagcgcatggtcgaggacaccagcacactttacgaagatcaactaacagatttagctcacacttctgttctgcaactaatattaaagcataccatgaaagggtgtgagagtaactatgtacaggttccgtattgccttccattcctatttccttgttctgtaaggagagaaacaatcgggacactctcttttgtgtgttgattgggtttatcgtggaatgagatgttgtggtggactcactggactggtggtatatatggacatgaaccaaaggtaccccatatttaaaagcaacatacactggtggagaaacgatttttactcccggttgagaacccccatatagttccggttttccaaccagaagtaaggatctaggactaaagatcactacctttagtcctgggtgagtcccggtttgtgttaccaaccggcactaaagctgtggtcccggttggagggtttttttctttttttttcttctctctttctttttcactgttcttttgctatttgcccaaatcatctcatatcaaacattcataccaaatcattcacggcatcatatcagatcaaacattcagaacacacagcaatatagttcatccaaatcattcacagcaatagttcatcccgaatcattcacacaatagttcatccccaaatcattcacaacaacaacatagatcaaatcacacattcaacacagattgtatcaatcaacacagatctaatcgcacattaaggaaaaaagaaaaaaagaaaaaaaatccatggcagcgccggcctccaccgcctgccgccgcaccggcctccgcatcggccgctgcctagtgcagccctccacgcgaggccgcagcccggccgcctcccctttcagatctggcggtggctagcctcctcccctccggatccgccgccgcccggccgccgcggcgcgaggttgccttcaccccaccgtggcgcgattccgcctccgcctcggcccggccgcagccgcgcgagggccctgccgctgccgctcggctggccgccacggcacgaggcccccaccgacgctgcccggccgctgacaatggggaagagaggggaggaatagaatggggagaggaggaggaagaggaagagatgggaggaggaagagataaggttagggaagagataaggaatataatttattaacttcttgatctcgcgcacgcctcgtcctctccaccgcgcatgccgatcttttgttccggtttaggctaccaactaagactagaaatagatctatcaagccgggactaaagatgatagggatctttttttccggttggtaatgggactaaaaatagatctttagtcccggttgggaacaccaacccggactaaagataatctttagtcccgattttattataaccgagactattgttgattttggctgaccgatcaaagatggtttctccagccgtgatagtttggacaatgtgtacgtgtgtgcagtataactttctattaacttcatttttaggacacaaagaattgcaaactcgtacagtgttatgaaatacatattatcaagaaaggtttataattttctctctgcaaaaaaaagagaaaggtttagaattcaacaaattcagtttattttaacgcaagtatagtatataaagcaaatatgttcaaccgtagttacagtgcctcaataaatatagatagaacctgtccatgcagcttggagcatccgacttagcacggtattcgcatttactgctaattacatttttcagtgtgttagataacttcgtctatctcaataaacactaatccaatctctcggttgtgctataccgatagttaaacaaaatctgagtcactttattggaccattagatccaaagattccaaaatcaagggtacacaaaatttgtaggatcgaacagcaagaactaagccaaccatagaagaggtgaatggttggagtacccaatcaccaaaacttttagcggaattaaaagttaattcgatgatctgcggtctgaccagagtagatgcgtggtctaaccgcctggaagccatcggtctgaccgccgtagttgcttcagtttgaccgccgagatcagctgctatcgcttgaagttgccgccagtttgaccgccgttaccctgctggtctgaccggtcagatgccgtcggtctgaccggtggtgtctcaccggttggaccgttgaacccgagcaaacacaaattgaagatctctcaaagtagatgacaaatttattacttctctctatgtttacaaagtgcaacaacaatactcctcacgaaaatctcgactaaacacgaaacgctaactattctctcaactcaatgctctctaaagtgataccgggaggccacaccctccgtctctatttatacataaggtagacagcctaaagccacgaaccaaactcatacaagaagtcctaattcaccttggaaaccttcccatacaagaaaccaactttacaaactccaatcataccaaatttggactccttccaaattcgacttcacatcccatacgcacacagtatttccatcgtatgccatatgaaatcctcaccgatcatgtgcattgatctttagcctaagtatcccgcatgatatctaaccattcggacgtcgccttatctccaagtcgactcctaatccatcaccagcaacactctcccgaggcatcaagacacctacacatgaatcatacaaagaaaccatattctgagaccaagctatctccaacttgactcattgttagcaaacgacagtattacatatgtatagtatccatctagaagccataaacacgaaatatccacggatgtccaatcaaataacctgaaaccgaaaccgacacagagtcggccggtcagactgcgggctagccggtctgactgcactcatagtaccggtctgactggcaacacctgcctggtcccaccagacccgataaaacaatagcacctgttcatcacctgtaaacccaatcattttcaaaaccacttcgtcaataatctccaaatatcaaaccgataatcttagatgccaattgttcatcacagagtaagaatcaaaaacactattgattttacaatctcccccttgatgaacacattggcaaacccatcaaaaatgttttattgtttggaaaaaataaaaacaaaaatggtaaaaagcacggagtgctcaaaaattcaaaagaaaacttctctcacttttgaaaagaaaaaaaaatccccccttgacctgaaaaacatgcacttgtatcttcttttctcccccttttgacaatgatttcataagtataggaattatatttattaatattcaagacctttgcatacatatagtacatcaagtcatgtgttgcaataaaaggaagatgaacccatctataatatagcaagcatgcactaaagtataatcatataccaaagattttacaattaggttcaaatcaataatcaaaattcatgatttcatatgttttataatgcaacatctttacaagcacataggttgaaaaataaacactatacatatatacctattgcattcatcactctttttcaaatcatccttagcacaaagcaaccaagataatttttaaaattttatttgagactttttgctcatattttctctcaattatttcgggtacgtcctcgtcgtcgagactgtttccaaggattcggcaaccattaactttgctcacatcaaatacgttcttatcgtcaagactgtttccaatgattcggtatttattttttctctcatagatatttttttcttctagtgcacaatgagcaatttaaaatctatttgaggaatgacaatttaataaagcgtatacataagcatttataaatcaaaccatatgctagcattaatattgcatatttgcttaattcaagtatagaatttaagtgtcatgcattatctcccttcaaaacaatatttaagcctcataaaaagactagaatacatacaaactgtgctagagacaaataaaccttcaaaatattgctagcatgcacaagaatataccacatgtatataaaaaaaactcttttttctcaatttttcttattgtcaaattttgcttgacaataccataaggtacaaaactgccctcacaatctcatggattcgtggcgaatcgttcaggagagaggcgagcagagccagccctgggcctaggcgggttgtgcgaccgcctagggcccaggccgacaagggggccatcatcaccaccccaccccctactcccatgcaggcccgggcaggccctgggcctaggcgggttgtgcgaccgcctagggcccaggccgacacgggggccatcatcaccaccccaccccctacccccatgcaggcccggccggccggcatgcccaatactgctgctggtctcaatgtcactaggacacgaggaggcagggagctccgcggctatcgtcaatctcgagaattgatcgaggcgtcgagggtgtgcagtgcaacgcgacgtttcgtgttctcgctcctaatctcgctctctgttttatctcacatcttaattaacgcggatcgactcgccgatgaaccaccaggaacgacgacggcgcgagcaaaccggcgacaccgacgaccacgcgcctgcagccacgccttgcccttgcggccttgctttcacgacaatcatgattaacagagcagactagatcaaggtgagagtcttctaatcttatttgcatctatttatttcgaaaattaggttatagctttattttctttttgttgtttaattaacttcataatttcaggtattagaaaatagagtgttgcctaattagaagcatctgttaggttctcctaaagggaacaaaagaaaatgacaagaacagttcgttgaatcacataaattattttcagcttcaattttcaaataatgttgtttccggcgatactcttgagtctgaagatgtcaaagtggatggctcatggtttagctatatgcaaccatgagaagaatatcttggataacattaatccccaaattgttcttcaatattttgcttctaaaaagttcccaagaagttctttttaagaaaaacttggatatttgtggtcttctatttaaggtattcacactattctatttttcatgctcttttacttgctattatactatcaatatcgtttatagtgaacaaaatgccatattgtaatttgcaactactaaatttattatttatcatgcttaatacaagtaaaagaatttctaatcttaagggcctgtagcatcgagtttgcctagggccctcgaaatgttaggaccggcgctggaggcaagattggatttaggaattttggggaagaaagtttgaagaacagaggaaggagacaaagatagttgttcgattgctttttacttcgttagctttcccctctcagacaggaggttatataaatacatcgagttcttgggccaatgggccgttacactcagcatagcccaattaggcagcacaaatgagacacaagtctaacacaccgttatacggccaccagtattgccttccattcctattgcctgcttgttctgtaacatgagagatacaatctaaactctctcagtgtgtgttgggtgggggtacgaagagctgagatgatgtggtggactagtggtatgtaatgatacgctcaaaggtacaccatagttaaaactctctcacaatgtaagtcattctaacatttcctatattcatattgattttagtgaatctagatagatatatatgtctagattcattaacatcaatatgaatgtggaaaatgctagaatgacttgcattgtgaaacggagggagtattaacttttgtctgtcataacacatgtgtaattgattaaaaaatttagcagcatttttttatgcaaacaccatcttaccccacgtccagtgttgtgaagtacatattatcatgaaatgtttagaattcaaccaattcagcgtgttttaacacaaatataatatgttcagcgcatttttttcaaccgtagctacagtgactcaatatatatagagggtacctgtccattcggattggtgcttgtgtcctcatcccccctaaaacaaaaattagtcaggattcactacagcacgaaggctgcgctttcacaaatcggattattacatttgaagggtcaatacaaaaaatcaatcccctgaaaacatacacacgaaaaaaaaaacaggggcaatttttacctagtcttgtagtaatacccttcactctgtttaatccaagagtcccactccggtgctttctactcggagtagaaattaatatgggccattggtcatatttaattgtagggctgagatctaattctactcccactagtattagtggaagtagaaatatggaagggtgttttcgtcaagagaaaaaaaatctcgtaggggtattatcgtattttttcggtctcttactcaccctatccttatccgattcctctcatcaccacttcccgtcgccagtccaccccatccccaccttcgccggcgtccatctccctcgccgcctccgtcgcctgtccagcgccgtcgccttctacactccctcgccgcactcgcccttcctcgccgccttctccaccgccagcgcccctccgtcgacgtccgcctccccgcctcccctgatatcggcggcttccctccgtcgaagcccttcctcatcgccctcccctccttctctcgtcaccacttcccgtcgccagtccaccccatccccacctccgccgccgtccatctccctcgccgcctccgtcgcctgtccagcgccgtcgccttctacactccctcgccgcactcgcccttcctcgccgccttctccaccgccagcgcccctccgtcgacgtccgcctccccgcctcccctgatatcggcggcttccctccgtcgaagcccttcctcatcgccctcccctccttctcctccacccgtgtctcagcgccggcttgtagcccccaccgtcgccgtcctcctcccccgcccccttgtccagcgagtcgcgtgacgtagtcgcccctccacccacctccgccggcgggcgacgagtcctcttcgccgggtcacctccccgcgccaccaccgccacgttatcctccccatggaccgacgcacccttctccactccaccgctgtcgccatcgacctagccgcccccttctctgaagtctgaacatgcccttggcaactgatttaacccagtgtaagcgatactctattagttagtaggagtactactaactgggtcatattaatcacagttgaccaattctattgtcttgaattgcagttttttttggttaattttcaattttttccctcttcagtgttcagatactatgcaaggaatcgagaggagacagccgagcttcaggtacattctgaatcctccaatcttaatataccaaccactactgttatgattttgcagataaagattgtttgttcttgaatccattgtattgtatattgattatttgattgaatggttgattgatccaccagatgaatggactgtttgaggactgcatgttggctgcagccgttgcttcctgtttgatatggcttcggtattgcttccatgcattctgacctatctcacattctgcatatgtgcttgaaagctaatgcttggttctgttttatttagtgcctcagtttgatttagtacaataaattaagcgctcaattgttaatagtctttcaaaatgattatgcagtcccttttcttttccagacgtgcatgaatctatggttggcttaaaaattatagttgaatgggcacaacattaatgttcactgtgtacaaaaaactgtggttgtattttgaattttgtacatgatccacgacaggtaatctgcattggttatttggtatatttgtggagcatattatagatcaagatatatgtgaactaatagcattttaaaattaaaatttgtccagatcaccatatttgcatgaatatttttccttcaaagttggtccattttgttcagacaggacaacattgcacttaatttttttttcatattatggttcaagtgcagatattgtggattgccataacactatcaccttccaagtgcaaattagcactgagatttctgggttgatcagtcgttgtgagtatggaattttgattctatgttcttctatgattaccaggctttggaaggatgtaatctatgatatatacaggtggtgatcatagcatgatagcaatcaaattccacagtgttggtaggaataaatttcacaggttgtttgttgttgaatccattgtattgtatattgattatttgattgaatggttgggagcagggtcagtttgcaagacggtggcatgcgcgaagggtggcatgcgcgaagggatccgcatgccggcgaaggggttatcggtgttcaggtgcgacattgtagcagacgcacgtcggtgacgtcgacagctgactgcactgagtcaccccgaagcgtaaggtttcatataccgctccttctcaaatggattgaaatatgaactatgaatattatctcaaaaaggcatcaatgtttgggatccataaaatacccaagtagtatataaattatttaataagggtaagagagcatagtaaggtaattgtggtaaatgtatgacagatgatccatatatgtcgtggttggtagcagtggacgatctttaatgttgttcagttcggagttgatcaaaattccggctaagtcctgtcgaaatgtttttacttccttctgcataatgtaaagggagtgcattttaaatggtttttcgtattaggaagcagtggtgcaaaatatgaatagaggttgttgtagttacctgtagttgaatttttaggagataagatccagtccaatgctccatgaacttaagggtgtacaggccgcatgagacgctacaagaatttagtcgttaggataacacgtttccgtatttgaataatgtgaatatcatgtggaagagtttgagtcacccacccgtctccttgctttggcaatttttggactttgttgtactcccattcggtaatattgaaatcaggccaatcgtgttttaactgtgggtgctgattctctgtcccgtataatcccctctcgatagctagcagctgggaagttttgtgcaacgttggtacggttaaaatatagcaaaaccgatttgaattatacaagtggaagtgtatcgcttaccacacgccttagatcgggtcgatctttactgattggctttgcgagcgaatctagtatttgcacctcacgtcgcttggcgttaagaacggctaggtaccagtgtgtatctttaatattaattgggaggaaaatctgcagatgttcaacagtaagattgagtcataaattgaattacccattacatagatagcttaaataagtattaccatgtcaaatggtagatagtcgcatgccatatctctaatccatcgtttatctcgaggttcgcttgcttcgacatgcgctccctctacatttagtagacctgttttaatgcccatctctaggaaggccttgccatctcccctgattcctttctctttatagcggaggcattggatgtatgcatccatgacctgaatttgagtttagttgagttacataacaaatatagttataaaagaatagtaggcttgttaataggcgaacttacatcatcattcaagaaagctggttgtgttagtactttcatttttttccgtttaacctccacttcttcaatatgcaccatcactttgttatcgtcggtgttattaatgtaggtaatgaaagggtcttcttttttagtcaactctacataggtacgacaaattagtaatagatctatataaatgttaaatggttaggcattaccttctgaattttttaacggtgtctggccattcgtttttgtcttattttgacctcttaaggcgttcttcggtgggcctttgtctatgatttgttgggtaagatcttccttctcgatgtacactagaaaagggtaagtcaaatcagtaacacagaaacatagaatataagttaaaatttatggatgatgtagagagttcatacattcagatatttcatacggtgtttggttgttttgtttcctctttttttcacaccgtagttcgtctgtgtctggcatgtaagcttctttattcgtttgcgcttgaaaaggaggaaagttagtaccattgacatgagcatatgtaaatatgaaatagcatagtacctatcgttttctttgtctgtgcttgggttcttattatgtccttctttttaccccttgtttcgtagatgaagtcagtccaattagttggtttgtatgttcttcctgtaggacctgtaagcctcttcctgctttgattgctctggttactgttgtcctgttaggtaagaaagtacacgtcagtattatgataagatgtagtaacgttagcgagagaaataaaatttagtttaccttcgtttcacaagtcatgtttacattttggtttatataggactcttcgttatgatttgatacatgctccctgggatcattttgttcttgttcaacatcctgcaatagcgtcaatctttttttagcggtgtatatatgtaagtaataatgattaacagtctagcatatgatgtttacctcaaacacatgcgtactatcttttcgctttgggcattttgaatcattttccatgcaatctagtatcaatgatcgcatacgtggccaaaaatcctttgtgaaatctttgaaattatcttgtaaagtttggatgctttcttgtaacctttcttgtaaagtgatgtcggctgatggttcagtggatgttatagagtgtatctgaatagcacaagttagaaaaggatgtcaaacatattttgttaaatagagttcgtattaaaaccccataatatatacctcttcagaagtgccttgaaaatcttcattgctatgtgtttctgagtcattgtcgtgcgctttttcattggggatttcattgcaatgtatagttcccctaatatcgtcgacaacctatttttagtgaaaaaggggtattagagattttacagacagttgatataattagtacatagtattaaaaatgagatagttaccttcccttgtccaaaaaggtaagaaattcgctttttttctttttttttatcccagtactgaattagtggcctttgacggctagaatgatatattgtcgcagccaatttatctattcgcactttttcccaataccaaatctgcaagcatttgaacattagataatgagtattgctatgaaaatatgttcatgacaattttgtaaacatactaaattttgaaacgaacctgtaagaggcatacgttcccctcaatgtttgttgtcttctctctaaattttattatgcctttcagtaactgattcagtgttagactagaccagtttagttccctcattttgtcaacgtcgtcgacgagattgagatattctgagcgcacatatctttgagttgtaggacatatgaatgatccaattgagaaaagaataaatcttcgaatgaagtggtcatcgtagctcgaggagttgattattgcttcccgtaatgcttgtaaagtaattgttgtttggccttcctttttgtacaggttgaacaattctggtttattgatttttggtgcctcaaatatgtcatctccttttgatggcagtccaagcaaacaatcaacatcatcgagtgtcatcgttacgaaggtaccattaatattgaatgctttcttctccttgtcatagcttcttgcaatctcattgcacaagtttcggtcaatatgtatgttgtcaatctttagcaagttgccaagacctgaaccctcgatagcttccttttgacgtggacttagatggagtattacctcgtacatggcatgtggagagcaaactagagttccctgattaacagaaaagataataaaagtttagtccttgtgaaaatttatgcaagtgctcatatatacagcagccataaatcctaatggtgcactgtattgcacatcataaggtactaatccatattaattttcttaacatgagaaccaatgtgattgaagtgaacaccttattaccatttggggtcatataaatcataatgtactatattcttgctgatgtgataattatgcaagcatatttttttttgtactatatctttcttagtgggggtggggtgggggtttggctcgacagggatttctgaacatataggatgaaggtgttagtcaatataagagtgcgtaattggagacaaagcattaattggttcacgggaaaatcagggttaaggttgtaaatgtatttcatatttatctctgcaagattaataacagattttatatactaaagtacagttgcaaaatgggtataatcatagtatacttctgtcctgtttttgcagttccctctagtatgtatgtgtggaacaatacgaagaatggtagctgaatccaaggatccagatctctcaaagttggagcttgtacatgtaccagggggagctttagcatttcaacttgctgccaagttctgttatgggagctttagcattactaaaaaattgattctatatacgctctgttaggtgggaaaatcagctatatgttgggtaacaaaagtgtatggtgctgcagtatgagttaaacctgacccctttaaactgttgcctgtattatcccatgtagcaggcccatatttcttgggacatctcgccatggtgttttgtctgtgaggctgctacgtcctctatatccattttttaatcataaactagtcaattatataacattgcaaatccatgtctagcacctctgtgttgtatccaccatattagccggaagctataatgacgtactgacaatatgaagcaaatgattgtgattgtttttttagtacgtgattttgtatacgggaataaatgaatgtttgttttctggttttgtgcatgaataataaattaatgtttttatttgttcaggtctctggattgcaaacacagattttgctttcactgggggacctttcgagccaaatttgtgaaacgcaaaagatgttgataaagatggcccatgataacactgaatttcaggaaaatatgaatgatagaatgacaaacgttgaacacattcaacagctacaattacagcaagtcacggtacattttctgaacatttatgtttgttttttccacatggcaaaatgctttgacacatatctttcttttgtgcaggatataacgcatggagaacaacattttccaaggaaaagatacatcgaggtcgagtatcctagcactataggaaagagggttcgaggagtcaatggtagggccgttgtaagtaacaagaaatttgattgttacaaaagatgcttggtagacggtaatgatgacttcgattttgtttgcactacggacgaaacacgcattgcgttgcgtatattgtgtgcaaagcctactgagacgataatccatattgatgacgtcgttttgacgaaggccgatttggtatgtcttgtacagacttatccgtatgacaattatgaaaaaaacattagcacaaaggtacgcctatgcactatttttgcaaaaagtaaagcaaaatcatctctaagtaatgcttcataaattgtattgttgatgcagatcattaaggcgtttgtcaagcattttggacaaagtagatcaattaaacgacataaacatatgtaccatgcctacttagagaccccgtcagttgtgtcaatgcttatcaagtatggctattatgatggtgttgagctaggaaacactgatgaaaatatgtacaaatccgctggagtcagctatgtgaataatgatatggtaaaatcataccttacaaatttgaattcattatattatttaactattttgtaaattgtattgatttgacatacagatttttctaccaataagaacttcaatagaccattggtacgtagcggttctggactgtaccagaaaggaggtgtgtgtccttgactcaatggacacgactgaagatgacttgaaagaacttaagtttctggtactttttccccataaagtgttagcattatcagtgcaaccaagtttgtagaatattaattatcacatatttatttcatgtagatgaaaggcatccgcaaatgtgtccgacttgtcctcgatgataaaatagtagagaaccctctgtgggacgattacaatgttcaagcttggaaaatcaggattagatataacttgcctaacaaaaaagacaggttagatatttacaaccctgagagatgactttgtaaaaaaatttatttcggaataattttacatctactcgtactcgtacaggacatccagtgggctttactcaatcaagttcatggagttatggacaggagattcactaagcaaacaattttatcaggtatatatgttgtacaattagcacggaagcattcctatttatttcatttaaaactaataatattgttgtcaattacacaggaagacatagacagctacaggagaaaacttgcagcaatcttgtacatgtctccgtcaaacaagcttcgaaacaatatctgttctacctcaaacggaaatggtactgatggaggaactagggcggcagacgtatgattgaataagagttctttacggttttgataatttcagctcaatgaagacatattgaacatgtcagaaattcatggtgactaataataactgaggcattgtgttcgattaattattgtcatatacagctacaattttttccctgaaattaattgcactgttttggcttggtgctgttcaagacgaactgtatttactgcaccgatgccttttgattattttcagcagtacagttttctatttcctacaacacatagttggtatatctatagacaaaattaacatgaacaccatataacagcttaaaccatcacgtaggctaaatataaatcacatagtgcatatcataattcatcaattaatttagcttgttttcttcacatccttttcaagagggtataagtcatttaatgacatgtaagtacgtaatatacttaggaagtgcaatatttatacatgtcattgtcagacaatcatatctcaacaatccattttgagatgctgaaaccaacgcaaccaaactgaagtactgaacatcgcatgagctgaacacgcaaacttgtgatgaagtcatgagcatgaactctaaaacacagttcagttgaacaggccggccaatgacaatcgcatcagctactgactttggagatgctgtgcagcgatgggcgccattgacgatgccgggagtgtgtcgccgagctgctccgttggccgtctatatcatgctgcgcaaaccgcgataggatgggcagcagaagagtaatcagaattcagaacatggcactttgtcaaaatttaataaagtttaggagactttgcaatcaaatcaaattaaagataaacctaaattatgaaggctaaggtgttcaatactggaatgtcaagctaatgagattagatcttgccaaattacatgctattcctgacagggaaatgtagatggctagaagatgaataatggtcttttgcaggaactgaaaatccctttcttgtcgcaacaagacatttgatgtttattattatcacccataaactgtttcaagaattgtcggtgatttttttaaaatttaattcgtctgaagttttggaactgacaactaggttcgaggccttagtggagcacttcacttttctgaggcattcatagttcatacaacatgtggacactctgttcatgtaatcttggatatttaggaacatgacagtactattacttcaatctgaaaagttgatgtgacagaaaaaataaataaaaccaagatgttgacacaccataaagtaagcctataaatccaaacttatcactgctcacaagtttgtatgattg

SEQ ID NO: 20519 - DNA, 4659 bp, Oryza sativa
aagtagttagcagatcgttctataatcatcacaggaaaaaggtttcctgaccaaactactagtgattaaaaagcttcccaagtccagcagccatatgcagttgtattgtaccttataacttacaagatctgattaaaaactgctgcaatgtttctgcacatatggaaacgcacgcctaactttcagaagagattttacctgatgcacacagcaaaatgatctgttcccatgcatgcagtcttgatggctatagaaaaggagtctgttcttcacctattgctaagattggagccactgaactggtagaaataggaaacagtcagcaaacgaaattgaaatggattcagaggagggtgtaactagaagaatacccccccctccccaaacaaaaaaagttttcagtattaatggcacaagtaatcttgtgttcttgccatgatctgtctcctgattacaagtctcttgtctgaacctgaattgttaccccagactatgttcaactaagactacgtacaagtatatccttcccaataaagaaattctccatatatcattttaaaactatttcgaatttccattccatggaattcaaccaggaacagtaacatttgattgaacaataactgtctaataaagtttagttcacagcatttctaatccaaaagcattcaccagcggaaacacttaatatgcacatcttgagaaaagattaaactaatccaaaacaaaaacaatgccaataatacaaaatatacaaagtttgtgagacacaattaccttattggttatttgtgtgcaatgtctcatggaatggccttcgtctcttcgatggagctccttttgccctaatctcttcaggatcaagtactctcttctctaatggctggttactagacaaaaagtgagttggcatatgaccaaaatctccggccacgatgttctcatcggatgacgatcctttatccaaaatcccctttaagaaatccatcgccttttctgtctgctcagggttcctagcggcctcgaagaaagcatcactacctagatttcggaggctacggtaccgaaccatgtgttcagaccacacattaggatcggcattcctgtctgacctaaatgccgcctttgctcccattgtccacctatccacgacacaacaacgagggatggtgtcaaaaccaaggaacttgactacaacaaaaatgtgtgagcaagggatgtcttcgcactccatcttccgacagtgacattccacaccttccaaagcctggcctttaaaagaaaccctcacttcatcccacacctcattatcgtccttcaaaccaacaacatacaatgacgaaccatcttgattagtcccactgatgacttcaagtcctgcaattagccgtatctgtgcacggactttcttgaacacgactgcggtgtatatacgggcagcgtctttctccaatgggtcggcgtctattctacaaaaagggaccgaattggtagacttagcgtccaactgagcctccttcttacgcaggccttgtatgcacaacttaacatgtttgactaagcacattagtgacatgtttctctttagaagggtgtgaagctttgagttcagtgactcactacgttggttgctgcgcatacccaacaagtatttcccatctgtataggcagctgcccatttctcccttagtcggtacatcagagcgatccattgttcatttcccgtgcctccattctccttaaaatcagcccaacgtctctcgaactcctcttcatccatactctcataaattaattttcttagctcgtcgagttttggcttacgaaggtgacgactcatattctcctctatatgccaagtacacaatctatggtaagcacccggcattaccttactgatagccttcgccattgctaggtcgccatcggtaattaatgattttggatgcacttgacgcattgcctccaaaaaagtctcaaggagccaacagtaagagttgacagactcatttgatagaattccgcacccaaaaattgttgtacttctgtggtggttaactcctatgaaaggaatgaaaggaagattgtacttgttcacacggtaagtgctatcgaaaataacaacaccaccaaaagcagcatagtctaaacgtgattcagcatctgcccaaaacacattcctaagacgcccttcctcatccgtggtgtatttgaagaaaaattctgcatcttcttcttgcttccttgttagatatttcaacacatcttcagcatcatgacccttgatattcttcatctcgtaccgcgtaaagaaattataaaggtccttcatcacaaaaccaacctcgtctaactcatcgtggttattctccataacctccatgacttgaaagggcctaaggccactcatgcgaagctcgaccgcttgggctttcttagaatcactcatcacacgatgaactcctaaaaaagcaacatggtctggatttgcaagttcgtgcgtatgttggttatcaaactccttaacaaaccacacccccttctcctcgttccgctcaatctcaagcttagctaagcaaccgcagtgggtcagtgcccgtggctcccttttccgctctgtcctctcaaagtgcttcaactccctgtacccttcacatgagcatacgaattgcctccatataatttcaccgtccttccgtttaaggttgtttttcctcacactgaaacccttcccctttgcatagtctaaatagaatttgtaaccttcctcctcgcttgaaaaaaccacagtacccatcattttatactcttcctgatcctctagctcacatagctcgaagtcattatgtcagacctcacctacggaaaagtacaaaaaaaacaaacagatcaagcacccaaatataagcttacgtcctttatacctcataagtatatataaaaaaagaacaaccatcaactgcataaatacattgccactctaaactattgagcaattactacagttcctccacaatggctgcaaattttgtatgtacgataaattgttatactaaaatacattttctgaaaatggttgttcagagataatttttcttttttcatttcagctgtacagtcaaattttgtgttgcacatcatccagtagtttcagaactctgtttcttttttcagcaccactggagaatatatgcatttgtgtatttcacaatgacttcggttacatgctcctctctgataattctaccattgtcgaaacccttaaaaaaggaagatccgaaacggagccaggtcattgcagcttattaagacctatttgtagtcagatcgttgccacaattcctgaatctcttttgcaggtcatgtggattcctatggacataatcaagttagctgacaaactagcaaaataagccaagtccaatgttaatgcagcccctgtctatttttgtcaaaatatatcgcatttgtcttatcctaccagaagatgtcatgctaaatcatatctaaatatcaatggtcagttcgctagggcagcaagccatacatgcacagcaaaatcaatttaatattgttcatatttctttcaaaaaactattgttcttcagtttcatcgttcatacttgggggacggtatccacacctgcgatgcgaaccgaagatgcgaaccaatgcgatacggacggcgacggaggcgggcaaggcggcgaggttgggggaggaattgggggacggtatccacacctgcgatgcgaaccgaagatgcgaaccaatgcgaacagaataaaacatcccataccaaaattacccctaaaggatattagaagattacttacctgccctttaaaataaagggtccagattaattctactcgaagtagaatacttcaagtatattgcaccggagcgtcgccctaaattcaaaccagatgatagcagtgacaccgacgagggcagcggactgatctgagaagactctcaaacaggagatttagagtggtcctgcaaatgtcccactctccctctgttcattccacttctcaacctgagacaggaaaagctaatgatgaccaagaaaaaaactaaagtgtggttcttttaacagctaaatttcctagtcatgcacaacagtaataacttgtaaaacacacacacacacacacagagggcgagccaatgcggtacagttaagaactaacacacataacagtcgttgacaaactgagtaaatctccaccgtattctatagttcgtttatcagataaataattttgcacaagccacatcgttcacaagaatcaggtcatctttattgaatcctaatgattcaacattggcagatatgtttttcactcaaagatgcattttgcacttgctactctgtaggacatgttaacatcaccactgaagcatcaaactgacagaaacgaatcaaatatcaatgtgtataaccaaatataccgaagggaatgtgctgttttctacttctgaccagtgatgtgatatgaaaacatcgatgggaaacaactaattttatggactggtatttacaaaaacaatagcttttaaaatccagaagaaaattttcagatttagattcagcaattcaggtaacacattagtcccatttcggcaagttcaactgctattgaactgaaa

SEQ ID NO: 20520 - DNA, 20256 bp, Oryza sativa
tagttacagtgcctcaataaatatagatagaacctgtccatgcagcttggagcatccgacttaatattcgcatttactgctaattacatattgcagtctgttaaatagtgaactgcatacaataatttcatcaatatcatttttttatccaatctctcggttatgctataccgatattcaacaaaatctgagtcactttattggacctttagattcaaagattccgaaatcacaggtgatgataaaaaatctcaatgctaatcaagggtccacaaaattaaccgagagtttaaaaaaatcaggcgcctgattcattggaaaagggagcaagttgtgctgtgaagagatggtggcggctacgttggacggactcagcgtcaatctctccgtctggatagcagtcacttttgtgccgctgccgtatacagatttccatatggaaatgcaatcgtttgttcagcacatgcattgtcgcctcttttgtccaatgtataaccttattcatcattggtggaaacagttcaatgcgtacagttcactgttaaattttaatttataattttagatacacatggatcaaatgaacttgtcggtgatgaagcaggggaaggccagccagtgtgcattattggtatccatgtcgccaggcatgactttgactgcattcgtgccggctcacggatgctagtgcagggttgacacatcttcaccatcagcttttcatcactaacaacgggaaagaggcaaaaagaagctagcggcagcacgcacaatccacgatgaaggtactagctaggtattccacgatatctaacttataccattataccattataccattatatgaccactaaaattaaagaataccatgaaacggccagagaacggctatgcactggatccgtattgccttccattcctattgccagcttgttctgtaatatgggagatacaatctattaaactctctcagtgtgtgttgggtgggggtatgaagggctgagatgttgtggtggactagtggtatataatgacacgctcaaaggcacaccatagttaaagcaaacatattttagacacaatctgtatatttgcgcagcatatctttctattaacttttgcctgcatagcacatgcctaatttattaaaaaatttagcagcattttttgttttgcaaactccatcttaccccatgcatgcatgtccagtgttgcgaagtacatattatcaagaaatgttcagaattcaaccaattcagtgtgttttaacacagatataatatgttaagcagtacattattttcaaccgtagttacagtgactcaataaatatagaggatacctgtctattcggattggagtatctgacttagcatggtgtataattacttttctcagtgtgtcagatgatgtgtccacagataataaggagtctatcactactatagaaaacgtaatcagtgccggttgggaaagtgccggttttgaatgagatcggcatctatttcttttgcccacaaagatgccggttctagggtgggccccgtagttgggatgcgtactaaaaagatgtcggttttagattaaaatcggcatctatatctgtcagggataataggtgcttgttttgtttaaaaaccggcatcttttaggtgataaaggtgccggttcttgtggtttgggcgggctgagggggggggggcgtgggcgggaaagacactagaggtgctggttttaccacttccagcacctatagtgccgacttatattagctattctgtagtagtgtgtggtgtcttcgtctatttgaagatataccggtccaatctctcgaatatgctcatagtgatattgactatgtctttataagttcagagtgtgtacatgagtatttacatttttattcggcttcgagaaaaatgtaaatatactatttttgtaaaaaaagggttaagggtgattaacatagcacgtgcataagttacacatccacgacacaagcagtaacatgtatttgtcggattttatatgactagagcatccgtgatcttttcattcctcctcgtatataatggtttgtgtactctccttcttcaatgtttgctcattcatttttgcacttaaagaaatgacatattattctctcgcaaagcagctcgagtttaacccagttgattcaacagacatacggaaagcttgatttggtataaatataatggcatataatggccaggacacccaaacgatatcagtacccataccatcaaatgaggctaaattaagtacacatggctagtagacagatctgttgtgtttttgtgtactgattatctagctagctagtacaggctattcaaagaagagttaagttgagcttgagcataggaaaaacatcatctgtcgaggctgcatcggtagctattccacattgtcatattgatgtcgccacggattaggctttagtcttgattgttggatgagctgagttcattacagatcaatattggcccaaattagatttaatgtctggcctgaactggatctgatctgagcatagtttgagtcaagtgacattgactacttttgctgccgtagtaactttccttgtaatcatgcaatacatttccttgtaagaaacagtacatagatgacataatagaagccggtccaaattttcctgaccatattttctataacaaaaaaaggaaaaataatttatggctcttatatacattgttgcttatcatatttctttacaggagtgcgctggagatgcagcatttgatgatagatggtgcagcagcagcagatgcaattgatgatagatggatgcatatcacttcataggacgtgactatacagctagtggtagctggtttgtctaaactagctaccactctatctatgagaggcactatccacctatacttcaaatacaattttctcttaaactactcatccgatctacgatccaattacaccgttgtgttcgtaacaattaaatctttataacaagatctcacatgattatattttgatgaaaaataataaattacttttataatatatctaaattacttttagatttcactaaattacttcttagacatataaaagtaatccaataaaccctaaaagtaatttatatatattatagaagtaacttataacaaaaggaaagtaactttaactaatacattttttattggacgtgactacacagctagtggtagctagtttgtactccatatagtatctccttttaacttgaactatgcaaaagttacttccaattaacattgaagttatttttaaaaattgttaaacttatgtgtgttgatctttgctgattaaatttaatttctagataaagtcatatttttatccctacaatgaatttacttctaatgtcgtgacaaagttacttccgttttgttttaagttatttttataatatatgtaaattactttcagactttattgaatttacttttatatgtctaagaaataatttagtcaaatctaaaagtacttatatatatgataaaagtaacttaaatatataataaaagtaatttacaaatataaatattttttcatcgtaacataatcatgtaagatcttgttgtgaagatttaattgtaacgaatataatggtgtaatcggattatagataggataagtaatttgagagaaaaactttgtttgaagagaaaattaacatgggggagaaactgtagcctttctctttgtgactctctctctctcaaacaggaattacgtgtgcgtgtggttggagtggtttcatctcgattcttattcagaaatgcccacgcagatggactccatgatgacgcgagcgatcggatggctctgccagcgtcgcacgatagcgctaaaacgagagggctctcgaattagattttacgcacttcatagggttgtgccttttgtagtgaatttcttgatccttgtgaccaagtcacatcatgtggcattgtgatcttttggtcgatttatattgtttagattagatgtgaggttttggaatatgcctttatgaattctctttgtatgtgtttgatgaatgtattgaaattcggagtaatttactacttgctgaaatctgcagtgaattgctaccgacagatgaaattattaatggaaattgatcctgttttggaagggtgtcagcagaagtactatttctccacatatcatctgtcatgaaagattcatctgtgggttaaggtctgcctgtcggacaaggattatctattggtaaagctctagatatcatagtcagacaatatgtcggtaaacggtatgtctgtcgtgaaagcccttcgctggctgagtgttttcagctacaaacacaatctgccgggaaaggtctctacccactgatggtgtgacgctgtagggacctttgacgacagatggactgccgctacatttaggacatggtgtggtgacatggaagctagagaatgtgatcggccggattgtgcgatccatgcatggcagctgtgataaggaaggaatgaaactgagttccttttggccaacagaggtttttgcagtataataaatcaatgcggctatagtttatttccttatgccctccatccctattacaatttcgatcaccgaaaaccgcatgttgatttatgttgtatggctgataggaagggaacaaagaaccttgtgagcacttggggtatatatatagatcacctccggatatgggtgcaatggtggtagttggccatatgaactttaaaatagtatcagagagttgaccatgtagaacagataaatagcatgttggcctcatcagaggtccacacatgttttgaagtactaatagtaagtttgaaaacagtacaatattttactagagtaagtagtaatatcataaacagactataaatatcatatgaagcacggaaaaataacatagtttcaatttgttagagaaaaaaagtcatactgtcagcagcctactgccgtcatcaagatctgccaatctaatgcccatgtctaaccctctactgggctcaaataaaatgtttagaaaaggataacagaatttttagttccctttgatggttttagttgtatttaatagtaaaccgaagaaagaactctaacaacccaacatggacgaaacaacaacagtactatggtatttgatgagtaaagtagttgcaaatttagtgctagaagattggaaagttgacacgtagatgttactggcactcacctttggaaagaagagataggtagttagacagatagtcttggtgtacaaaatacaaggtgccctagatatgtatatctatctcagcaagaatacaacaaaccatgcatatacggaaatagattctcaaatatgtgaagaatcttgagcaggtaacggatgactcaccaaaaaggattcaactacatattccgagttgaggacaatcatgacttctcggattgtctcctaacatttccttcaagttctacaaagacaaggggccacccaagacgggaggggtaaaccttttcgagaaattcacaattccaacaagtcaatgtttcggttatcgtgaagaccagctgccttgaccacatcggcaatatcctcggtttagaatcttgccaacatatcacataggttagatcagtattcctttgatactttataccttgtatttcttgacatattaaacatataaagcagatgtagtgttaatatccattagggaccctaaaccagaaaacaaatcctagtctcctacaatactgttatgttctcatgagcactcttggccaataccctatatacatgtttatcgtagtcaacaattggtgtgtcaggtaggggctcacggagtattcaaagggttcttaaagacatgatatccagatgcaacttctctgatgaggttttctattgacaacattgaatcaggagaaacaaacagaccaaagatcgtatccctccaaattggagatatcatagtcccaatataatattaaaggactccatccatacatgtccaatccgtgtcagaccacctagattcatatatcaggatagatctcatgagccctctgcccttcaaggtctttttggaacaaggtctaagaatgaggtcggaggcattgaaaccagccaggacagggtaagaatattgtcataggtcaacatgttgataagtaacctgatgagaatcccaaagatcaagatgtggtggtaagtggtaacaaccaatcatctttggatgttccatcaccagttacccctcaaccaaacatgacccatcttcttgatatctgaatgtccagataaacaaaaatcaatatatccctgtctctgagaaatgaaaggcaatacatataacagttatgggagcaaatgtatctataaaaggtacccgaagaaataaatgaagaatacacgaagtttttaaaaatgatgtcattaatttgaatccaaacacgcactagaagggataccatcatctcaatcgggcggtaaaccccatctcaatcgggcatggcgtccgtcacaggctagaagtcacagatgtgaagagttatctcaatcgggcaaacggccatcacagatgaatctatctcaatcgggccctaattaaagcccgtcaccgatagctttgacccagacgaccaatcaaactatagcccatcacagatgaatctatctcaatcgggccctaattaaagcccgtcaccgatagctttgacccagatgaccaatcaaactatagcccgtcacagttgaatctatctcaatcgggccctaattaaagcccgtcaccgatagctttgacccagacgaccaatcaaactatagcccgtcacctactccgtcacctactaggccagtctttttttgtcctcactcgtgtgcacccacccccgggaaattcaaacttcccggtcggtcacccatcccgaaattgttccatgccaaacacgcttaacatcaaagttctttggagattggcttctggaaaagtagttgtaacttgttgatatgagtattctattaatcttattaagccctaggccaggatgtcaaaatggggttattaaatgatttcaaatggaaaagtcaccaaaatcaaagttgcagaactcattgaggtacaaaatttttattttggtcatttctccatatgactatttaaacaatttgaaatttgaaattcagtgtttgaaaagttcaaatagaattttagatcagtgaacgacttcaattgaaaaagtcatcaacaataaagttttattttggttatttttctatataacattttttgaaccgtttgaatttgaatttgaaaatatgacaacttcaaacaacattttcaaatactaaataatatcaactgaaaaagtcatcaacaacaaagttgaataactcatcatgatctaaaacttttattttggtcatttctttatacgagaaagtgatagtagcattatttacaaaattgacaaatctcttatctggtttataaattataacacatatatgtaaaagttgtgaatactattactaacattttgtcaaatgaagaaataacaaaaataaaagttttagatcttgatgagttattcaactttgttgttgatgactttttcaattgaaatcatttagtacttgaaaatattgtttgaagttgtcatattttcaaattcaaattaaaactgttcaaaaaaatgttatatagaaaaatgaccaaactaaaagttgtaaatcttgataagttatacaactttgttgttgacattttttccatttgaaatcatttattactcgtaaaattattttgactcataaaataaattattatactgcacttaattattttgctatagttcaacttacaaatataaacatttcatatgaaaaatgaaaaaatagtcatcggtgacgggcattagttaatgcccaatagagattaagtgtatagcccgtcactgatgagtcatctgtgacgggcctagttgttatctcaaacgggcctcaagttgatgcacgtcacggatgatggtcatccgtgatgggccacaacttgaggcccgtttgagatatggaatgttatctcaatcgggcctaaagttggtgcctgtcacagatgatggtcatctgtgacgggccgcaactttaggcccgtttgagatatggaatgttatctcaatcgggcctaaactacggcccgtcacttataggtgtcatccgtgacgggcttaggttttatgcccatctaatatgtctgtgcgaccatatctcaatcgggaacttttcggcccgattgagatgacttccttgtgacggtccgctatttcttggtgtattagagcctgtcacagatagaaggatctgtactagtgacgatagcttacaacatgtattgagagatatgatatctctaggacaacaataaatgcaggaatacatattgaaagattaggtcctgttactatataaatggtgctattgcgatgccaaaataacacatcgaaagagttgatagaaagaattggtcctcattaagatgcaacctgttaatactggtatgaggggttcataccccatggctatcgtaattatggcgcttgtggcaatgtttgccatcttctcaacctgtcatgcaggtaagcactagtatttgcacacaattatttatccttatttgactcatgaaatggaacagaagagttgaatctcagcattctttttcgataattgtgggcatattttttaacactacatattttgataaaacgtgtttgaactatgaattctgggaatgctgacaaattttgatagttttgtttcatatttcaaacaaaaaattgcacatatacggacaaccaaatatttctgtatgaaacagtatatattttgagtttcagaagttcttgcttattagttaagaatttcccctgattctcagcaaatgtagaaggaaaaaacaacctaatatcagatatgtttgaaggtcattttcttgtgatatatatatgcctaggtgatccttcatattgcagcactaatttcctccactacatatgaatcatccttgttgcagtgagtactactaactgcattgctctttactgtataacagagagcaggctacactgtttcaaagagtcaactgcttcacccaaaagtgcagcgacaaatgccgtgattttacacagattccggaacgttcctattgcacctttacacacgaaacacaatgctgctgcccacttgcagatagccaaggtcttgccagtgctaaagtcagtggctctgataaagatgatattaacattattggtagaggtggaggccacgaccgcgggggtcatggtggtggcggtggcagactcgctggccatggtcacggtggtggcggtatccctggtggtggtcaaagtggtggtattggtgcccctggtggtgggtgcggaggggctggccatggtggagcagtgctgggggcggtcgtggtggtggagcaggaggcagccatcgtggaggtggtggcgcccgtggtggaggcctctctggacgcggccatggcagcggtggtgctgggggtagtagtggaggtggccgtagatctctacctggccatgggcatggtggtcaagggatgaaccaagacggagatgtctcttgattgagaagttagttttctgtaataatattgagaattatatataaaaacattacatacatcagtcatttttttccattgtcaaaaggtgcacctcggccaatttttctttctataacccagagtctgtttggtgtgtcactgcggaagaaatagtgtactgtagcattatctagtgtagatagatcgagcaaggtagacatgagaagatggaaaaatatgtagcacaacaatatatgtaatacaaacttgaagagtaccataggatcaaaaatagacgtatgagatctatccatgtcagcctgcgtaaaaattttactcccagtaaaaatgccaagttgtttgtgaaaatgcatggttcccaatcaccaaccatatgtgaaaatagatttttacatgtgattttcttaatagaaccacttgcaaaaatattgctatttttttacaagcgaccctctagaagcactgcctaatgaaaatcatgattaaagtgttgtttctccatggtggtgtcaacagtggattttgtggcacagtcgttgggagtaacaacttaggcagtggagacgactgaggagatcaacaactgcgatccaagggctcgcgtgacattgaccaccgcagcgagggatggaactagaagtggcaagtgctgcggcgcgcacaacattggcaacaacagctcaggggcgtcaagcatgctggctccagtggatgcgagttgcagaggaggttggtggcgatgcttgttgatcagcgacgacgtcgacaacgtcagcagatcctaggtcgcctcatccatgatggtgcgtgagctagggttgctggtgagtgccatatttaggtattgtttcaatgtgaatttggggactccggtgacaatggcatctattttgggaaaacatttgtgaatttcctattccccatttgaagaattataacaggtaaagtgaatttagggaccttttggatgtgaatttgggaaatttttaattatttgattggatatctacttcaaaaccacaattacttgaattgaattacaggaaagttgacttttgagatagttcaacctttgcaaagaaaatatataatttcccattgccaatacatgactcagccttgttgagtcatcaatgaacccaagtgctcagttggtcgctcgatccgatgcaaatgatgatgacgttgtcttggatggctagtttgcaatgatcaaacaccgaagatagtgagagtgccaaagtttaaatcttggatggttccgatcccgagtctgttttatcgggtctcggaagggagggtatattttgggtacccgttggtttctatgccaagttggacatagagtaggatctgtaggaggcaggaccaactctatataagggacaagaccggttcaataggagaaacaatctactcacaatccaatctagccaattaaatcgttttatcaatattgcacctagttctaacctagctagttcgtccatccttatcgatttgcacagtaaatcatacaccttcactgcgagagtgcaaaatacctttgtaggttttcccgtaaaccttccgttcgcttatgagatgagtgtttatcgcttgttctatctaaatcttctcctgtagccggtttaatcttctccataaatatataaatttccataaatttataataattagttttatttacataaaattcatgcaaaatttgtatattcgaataatttttttgatgaagttttatgttccaaattaacatagaagattgcattatcatgaaaactcttaaagtttctcttgttttccatcactaatattttgggtttcttcatatgtgaaaaattatattccactattaatttttaacctgtttttccctctacgtttcattcccttatgttgttggtagagagtttataacctgttttttaacctgttttgttctaaatcttctcctgtagagaaagttttattggtagcttggcacatatttggaagcaaatgaatgacaaaattatttagacaaaacacctttggtccaaatttggaggactctttacacgaattaactcattctctcagtttgcctgaatcgtatagagagtgaaacttttttgatttgggctaatgccttcttccaaaacatttcagacaactcttgaagccttactttccagtattcttccatactcctctcattcccatttaccatccctatctaaactttgatgttacaattcagataaagctgtagcaagggtgtattgaacatgtagctaggttacacagtctgtgtcaaggttgccctttacacatagtgggtggctcctactctctcacctctcttctttcatctacctcaccttgcatagcaggtgcttaggggcttatgtgacttgctcttatctagtcataactcttcacctcagctactttccatgacattaaatacgctacatctagttcatccattctcaattaaccatcactagccgtcaacccgtgcattgcagggttattgtgaatgacagaatattaaaatttcactggataatgataaattatgttgttaaactcataagtatattttgtttaaaagaagttgatacaaaacactttcatttaaattatagtggccaaaaacataattagtaatttcttatataacccattctaatatttcttctattactttatgttttttttgaaattacataatttcaaaatttagtattaggaatatagatttatactcgttttgctgtctcttgtgagcattctgctatataatagtttagcaattttgaattaatatgtacagaaacaaacttggtttggagttaacctttttcacgatttgatgattcctatattcgtagttattaaatatcaagttgtattccatgtggagtagtctcaaatatatatagcatcttcgtaatttagttttaaaattcctaattaaaaaatattacactcagtttgaagtcttaattattgttttatcgtgattaaagattgttccaaattttggaatcaacaatggttctttcatgatttgaaaataacaaaattcgaaagtaatatatatcgtcacacatctgaagtataagtcatttccatgttttaataattttgaattttggaataaatcactacctgtattgtccttgtgttggtctcctaatttggtactatgctcctgtttttagatacttgattttaattagcacttttacatcatacattaaattagtatgctaaattaaaatttcgatgaaatcatagattcactgaaacaaatgtatttggatgaagcatggagcagatttgttagcgatgtatgtttaacttatctggaaaaaggaaatgtccacttaaaacttgttattaatttatagtgaactttctcattagcaataaaaaagatcagcaacataattaattctttatttcaattaaaataaaaaaatcaagaatatcatatcacatgatgtgggagtttaattaacgggatacctttgtgcattgtagatgtaatgatgaatcatcttatatgcatcagtcgattgtagatgcgatggtcaccgatggataacctagattcaaacagaactttggatttatggatgaatatgtaaacacctgaatttaattatagggtcaaatactcaaatcgcggcatacccgagtcaagatttatgtttcagatggacacacaattacaaacgaaaattaagtatagcacatatgtagaagtccatgatcacgcgcatcatctacagatttccaggtagcttgagctgctaattaactgctgagatcatctgcagatttccaggtagcttgcgtttctaattaagtgctaatcttaaattaatttatagttagtttagatgagaaacatgtaagaaacaactgaatgaaaccctaaaaagattgaatcagatcttgctcacttgagtattttaaatagccatcgtacctgcagagatcaatatcttggatcgataaaacatttcctcgccaatgcgtccggtcgacggagttcctcggctgcagggtcaagtagatcgacgtagcctgccgtgttgtgatctcgtcgtgtgcagcgtcgagtccgactgctgagaccgatatgggcacaatttgtagaccttgaaggaagcccgtatagattgaatggtggcccggacacgttttgggctttaattaaaggtccatgcttataatatttaatctacggtcataattttatgatctagttaatcaatggtcagattaatctgtgatcgataaaacacttcctcgccaatgcgtctggtcgatggagttcctcggctgcaaggtcaagtagatcgacgtagcctgccgtgttgtgatctcgtcgtgtgcaaagtcgagtccgactgctgagaccgatatgggcacaatttgtagaccttgaaggaagcccgtatagattgaatggtggcccggacacgtgttgggctttaattaaaggtccatggttataatatttaatctacggtcatgattttatgatctagttaatcaatggttagattaatctgattaacgtaagagctccgaaaagtgtccaattagtataggtatagaggtatagatatatttttttagttattcccaaatgatcattgatgctacctaaatttactaccaggttgacaaatcaatcagggtttatttgcttatctcatatttatctaatacatattgggcctaattcttttgtattttcaggacatagggtatagtagagaagccatccatgtgatgaatagttctcaaattaggtgggcaacaagtttggttccgactgttaaccataaaagagcaatggagcaatatctcaaataatatatgaatcacatatgaatctataaggtatatactatttttcatcaaccttctaattaactttcgatgattaactacatgatatctggagtgttgatgtcatctcatatagtgctgtatgggttaactggacgcattgacgaatggtaagaaactgactgcagaagaaactcaattgttagctaataggacgaatgtacttatgatttttgctatctgtaaataattgaaatcatgatcaagttgttaacaattgtatatgcaaatataagctaaacctggggcaattacttttgttttatggtgaaatagcaacctggtgttcatatggctcatttactacatttgtattttttttctagcttggtacaaatttaatgcttattagcttaatccttggtatggttcgtgttggtggacattgagcgcatctccttcagacacatgcttggacgctttacagacgattaggagttggcagacgcgttagagcaaggcgcttgggatgcctaaagattctaacttcgtggtgttgagatttaatctgtttcatgaattcttctgttttgattggatgttaagttgtgtttttgctgtttcatggttttatcaacgagtttgaactggtacatggtacatagttgttgaatagtcccacattggttgtgtaagggtaagcgacctaataaataattgtgggagcccctcacctcattagctagctttttagggtggggaaggccctttacgatcctacaattgttattagagcctaactagttcaacatctctggcccgagagacatagtgtgtaaaggcctgatggaccgtgggtgcctgcaagccccgtataccttagggaccgtggggaaacggtgaagggctgagggacactaatgtgtgtgaaggggagattgttgaatggttccatattggttgtagaaggactagagacctaatatataattgggggagcctctcgcctcattggccagttatcatcctacaataatattgtttggtccacatgaaaaagtacaaggcggaatttttcatatagtcttaaaatacgtttttattacaaagatcaggggcggacacatggtgcgacatgggggtacagttgtacccccaaattttttggtaaaaaaaattatatataatatatatacaatacttgggccaaaataccagtaggagcaatcttaattggtggcccaatagcccacaaagaaaccctatcccagtatcccctccctctctgcctcggcaccacccacacggcgtatcgcttctaaaaaaaagaaaaagaaagcgcgagttcgagctgagggccatgaggagcggtggcggtggccgagcaactcgccgcgggcagggaacagggccccggcgtgccgcgccagcgctaccgcggagctcctgcgatgctccacctccgaggtgggacggcccctctgatccggctcctcctctcgccccttctctcacgcccaaccctaacccggctatggcgcccttgttgccggcgcctctcttgctgccgctggtgccacatccgagggagcaagagcagcaggagaatgctgaggaaggagaagaacagaggccgaggccgacgccgacaaccatggaaaagaaggtcagtaaattagtgtctttgtagtttgtattttaatcttgtcctccaattgattgggaaaaattaagaattgagcgattgattgatttgttacacacataattttgtgatttaggttgtagagccttcaaagaagaagaaatttgtggatttgaaatcaatgtggggtagagctgaaaagaaactgaagtctatagttgatagcaataatatttctgagcattcagctaggaggaaagaccctgaacctgctactatacatgcacctgcaactaaagagattgggtgtagtagagcatgtgaagttggatttgcacaaacagaaactcaagtgccctatgaaagtatagaagtatcaagacctcaagatgtagatggcagcatagaagtatctaaacctcatgttgcaaattcagaatctgaagaggaagatgattggctagaagatgttgatgaggatgttggttttcttccacatgatcctggaaagaggattgccatctcagattatagtgtgtatcagcaagatgaagtgaggatgaagtatattgcacttgggccttgtcgaccaccactagagcaatttcctcaaagaaattgtggaggtaaacgtcgtttcatacatagcttgtttgataagtatagttggcttgaatatagtgaggaaaaggatgctgcattctgttttgtttgctacttgttcaaagatagaactaattatgttggtggggatagttttgtgaatgagggctttagacaatggaaccatcatgaaactaatcttgccatatgcaatttaatttttgtttactggatatgttatttaaattttgctttgagatagatttgaatttttgcctgacgtacacaattatggaattaatttctgctggttcacaaaaaatatatgggctgcacatgcctaaaatttgctttgagattgatttcaaatctttccttgcatacatatatttatggaactaatcttttttgtcaattatggaactataatcttcgttggttcaagtttcacgataaatccatgtattgcacgcgcgggccataggaagtcctcaacttctctcgttgtgccacgtggcaacatgagagcgttttgagggagccacgtggctgttagtagtgcacttaatctagctcaatagaaatatgatatgttcattagacctaatacagcaattggtgagaatttaaggaagagaagcaaacatgataaggttgtttatatggcccgcttaacttactcacttaagtgcctgagatttcttttacggcaatggttggcttgtcgtgggcataatgaaagtaaagaatcactcaatagagaaaattttcttgagcttctaaattggttggctagaaatttcaaagaggtcaacgaggttgttctaaagaatgctccaaagaattgtaaaatgacatcccctaggatacaaaaacagcttattagatgttgtgctacagagactactaaacttctcatggaagatcttggggatgagttttttttcaattcttgctgatgagtctagcgatgtgtatcaaaatgagcagttggcactttgcttgcgttatgttgacaagaaagggagggtggttgagcgctttcttggtattgtgcatgttgagaatactacagctttgatacttagagatgctatcaagaatttactaatgcaacaatcattgagcttgtctaaagttcgtggtcaaggatatgatggggctagtaacatgaagggtgaggttaatggtctaaagaagctgattatgaatgaatctccttctgcttattatgttcattgttttgcacatcaactacaattaactcttgtggccgttgctagggagaatggtgattgtgtttggttttttgagtaacttgggtatttgttgaatactattgggatttcttgtaagaaacatcaaatgctttgagttgctcaagctcaagagattgtagaagctttggaattgggtgaaattgaaagtgggcagggtctgaatcaagagatgggtttgggtaggccaggagatacacgttggggatctcactacaaaacagtgcaacatattcttattatgtatcgctcaatccggaaggttctactacaagttggaaaagatcgttcacaaagcacggaagctataaaagctcaaactgcattacaatcatttgtgtcatttgagattgttttcatggcacacttgttgaacactattcttggatacacagatgacttaaacacagctttgcaaaggagggcgcaagatattgtgaatgcggttgagctcattgttttgacaaagatgcaattggagatgttgcggcaagatgatgggtgggagaattttttaaaaaaagtcacctcttttttatgaagaacgaagtcaaagttcctcagatggatgctaggtacaagccggttggaagatcaccaagcttctttggtaaagtgcagaatcttcaccgctttaaaattgaaatgtttttgagtgttattgatagacaacttagagaactaaatgacagatttgatgaggtgaacacagatttacttgtttgcgtggcttcattcaatcccactaattcatttggttcttttgacaaggaaatgttggttaaacttgcacaattctatcccaatgacttctcagccaatgacatcatgcacctacctattcagcttgatcgttttattattgatatgcgtagagatgaaaggtttagagaagtgaacaccattgctgaactttcggtcaagcttgttgatacaaataagcatatcaattacacacttgtctacaagctactgaaattggtgctagtccttcctgtagcaactgcaagtgttgaaaatgtattctccacaatgaattatgtcaagaacaagcaaagaaatagaataggagatgaatacttgaatgattgattggtaacatttcttgaatgagattgttttcaacaagttcctgatgaagacataatacgtcatttcctgtcaataaaggctcgtagagtcaagttgtaacaacttgtgttgatttttcagaacatggacaggatgtaagtatcttgaacttggaaatattggctctatacttgaattattttttgcaactgtgaataactacatttatattttctttatgtagcacactatcttatataatatatgttgctgatgggtatcattcaatggcattttcttcctctgtattggatccaatctttatggtggtgcagccatacgcaatggttagttgtgtcttctgacttctgtactatttttttattcattgttcactataaaacatttattgtaagttatgtatggtattgaaatatactttgtcttaatatatgcatgcttgtgcttggattgaatgaccattagtggtttgagtttatttttaatgttgaactagtttcttggtactatgtacatagtccgtagactataacttcgtacccccatcgttgaaatcctgtgtccgccactgacaaagatgtcattgatctgctagtgcatatctagatggcgtatgtacatacgcatcaacccgcaaaatatgatcaaatagatcaatcttcagttaagtctcctgtttcgacgcatggacagcaaactagtatatgtaaatatttgctgagatgctacgcagatgttctcatagtaataacataatacgttggactaggtgaactccttatatttgtcaaatcgctgcataaaaagaaaaaaaatcccaaaaatgagcacttgacgaaaatggcatataatctgaacctgaggaaaacgtatctaaataatggaaagttcatatttctagtgtgatgtaatttagtactaaggattcttaatgattttttaaaccgtcaaaaagcacgaaagtagaaaataatggaggggtcgagttgctgaacaagaaaatagtgttacagggtcatatttggagatagctagctataagttacggaaatgctttttggcgattgctcgccctggggagggg

SEQ ID NO: 20521 - DNA, 16369 bp, Oryza sativa
attaatgtgtgtttgattattattttgtgatgaacaattggtttgatagattattggttttgatactttgtgtagtggtgctccttgtgtggacccggtcagaccgggcatgtttggtaggtcagaccggcgtgtgtgcagtcagcccgacggtctgaccagtcggctcgatgtcattttctgttttggattgtttttttatactcataattaattcatgtttataacttctagatgattaatttctatacaaatgtagtaccgctgtgtgctattgttgagtctagttgggaaaataacttgtgctcagatatgatttcttgtttgattcatatgtaggtgtatcttgatgtctcgagagagtattgccggtaattgatcgggagttagtttgggagaagatgtcgtttgaacaatctggatatcatgtgggatttttacactaaacaacaatgcacgtggttggagaatatttcatgtgacaagtttgtgtcttgtacaggaacgttttctaggtgtttaggacctcttgtacaagttggattagtggttttagattacctatctatggttataaatagtagatgtgttgaggcctctagatatcgatttggtaaaaattaagtttagagaaaagttaggtttcgagttgagtcaagatttctgagagaagtgttgttgttacactttgtaaacacgaacataggcaatataatttaatctcctttcatgagtcttcgatttgtgtttttgatcaggtgtgggtggttacaccagcgggctaccggctgtcagaccgattacattgcgatggttagaccggccgagcaactgcggttggaccggtggcggctagagacaatgatggtgtgatcacgcggtcagactgatgcatcaactctgctcaaaccgagttccatcagctacgagggtaacttttagttctgctaacagttatcggtttttggtagatcaaccattcaccctctttgattgattagcttagttcttgatgtgctacccaactgtctttttattggtgcacgaagaataaacttctcgagtaaaaattggtccaagaatgtcggtgaacctgcggtaatataaattatcattcatcactgccggctcatggcacatggtgatgtgcgatgtgtgatatctctaggtcatgcccaaaatcatgaaggcgtagcaattagaacaactaccatcagtaatatttatgttggtataattgtctccaccgacgcaaatgtttttttatgcatgcttttaatccttttatattatatcttgataaattttatggttgctgaaaggtatcagttagggttatggataccacatacctgatagtagttgactaaatctcggcaagacccaccacataccatgtcttatacggaaacaaccttcgaatataggaggagttccggataaggaaagacaactagagctctacatggaaacgacaagtactactcggattgtatgcatattggtttcactagttctatttggacaaggagacacctatgggtataaatacaatgccccctaggaggagaggggacacgaaacaatagatcaatatacaagccaacataagccaagacaagccgccggatatcaacatcagagataagcctagtagtccccatacggtacctacgactaccgtcaagagggatctaacgctatctctgatctcgctggacgtggattcgaggaggaagactactttgttgtcgactacgtaacagcacttcagactgccatgtcgacaacagatagataggctaccccaaatattgtactggtgtgattatggtaaataagagcaacaaccggcttcggccaacaggagtagggttattagctgacaattcaggggtccgaacctgtataaaaatcctcgtctccatcttttttactacaatctcgcatatatcctagtaccaacgatccctatactatgcaaataccggaatcgcgacatcaaacgtcgccagtggcacgccaggtaggggattttggtgcttcaggattttgacgagatgggttcaagagatggattcttcaacagcaaactactcaacgacttcgtatgttgggtgatatgacccgaacgaagtacgttctccggcggatcgggatcatcgtcaagttttgccaagtcatcgtcattgtggattttttgacgagggatacttcaactactttggatctgagaagtctaacctagccagagtacgtgccccgacaaggtcagaaccatcgtcatcaacagttcgatctctcgagatcgaccaagcctctagatacacggcgtaccaaaagatgtcagaccgtatgatgtcaaacgagtacgcaacaaggtaattggtagattggttttttaaattaatctactaatatcgtagatacatccagcatgtatctacaaaggtacgcattattatatatgcaatttatggtacctacttttcagatcatacaatattgtcagatcaataattattatgtttacctagagcatgttttttatacaatatctattgtgtgagcgtttccgatgttaggccaactatagtctaacactgggggctcgcactattttcttctgtataaatcatgcttgtttacggtttacataatccatgatatttaatctgctcgttatatcctaataatactagaagatccatgcagttttttgagtacatactcgatattctctgctatatatcttgccttctagaaaatatttttcaggaacaattgagcactcgagtaggttgtggtcgagtacaccccattatccagaacgatctcgacaaatgcagagtcgtcgtgccatacctaccaacgaagaccgacaacctatctcatagcaccggccatagctgcgctattcgagaaaaggttgttaacggataattcctcgtgaacgttatcggcttgatcacccgatatgattgtgaacggacatctggatacgctataagttaggtatgtgagtcatgctggccacatgagatgcacatgtaataaaccaactttagcgcccctacaggtgattgagagactcctacttcttgttcttgaaccagtaggacgtagcgatctctcacgccttaacttccagtggtcgaggtacgactacagcaatagcgtagcggtccttgcaccacgacctcaaatggtcgacgtacgactacggcaatagcgtagcgaccctcgcaccatgacttcagatgacttcggatggttgagggacagctatgactagtcttcgaccggcagcgtagcggtcctcgtaccacgactacaaatggtcgagagacacctactcactggttctcaaccagtcaatcatagcaatctctcgtacatttacttcaagtggtcgagttaaggctagacctggttctcgaccagcggtgtagcgattctcccactatttccacttcaaatggtcgagttaaggctacacccggttctcgactagcggtgtagcgattctcccactgttgacggtcgttatcgatcagtttcgaccatcaatgttactaaaacaggagagaattagtgatgcttgcaatgcataaatatgttagaataataatattccactagtattaggtctactaaccttttgcagagaatgacaataaagtgaaggaaaattgacatcaactcagacgatagatcaatcggacgatatcgagaaccagacttgtgtatgaatgggccaagaacgcagacttgacacgatgaatcaggccaaaattcacaagtctacgaagtgaagcagtagagggggccaccagccaaaatgtgggctggttgggccggccccaggttcagccgaacctcccatgaaaccgatggatgcagggttttgagggaacggtggagattcactcccaatggcagttggagggtattactgacctttccaatcgccataaccgtcattacctacctatttaaggagttcactctcttcacttcaacacacacctcaagcaagagctctctcattcctctcaaatttagtttagtagtatctagctagtggaatagaattagaataggaatcaggagtccggaagtcttcggaagagttcgggtatggctctagtagctttcctttcctcttttgtaagctttgtacttttattagaatattcttctaaatacatttctggtattgaaatactttccgagtatatgagtacctactttacattatgttcatgttatactgaatatatgacactagtggagataggcacatctatgacaatctacttttgtcatggaagacgcgcaaatcgtcataaagtaacttctatgacgaatttatgacgaaatgggattcgtcatagaagtcgcgtcacatatgtttttctatgactaaacagtagatttcgtcatagaaatgcttatatccatgacgaaggtgctcgtcatagaactgctttccagctggctaggacagacgtcgtccatgccacgtggctatcacacgtggagtccatgttggctgtgatgtggcggatgacgtgtacgccacgctggatcatcatctcccgtacgctagagccaagtggtagtcgtatttaacgccacgtgttggcatttggtatgtccacgtggtggtgcaagctgatgccacgtggtcgaacgtggtggcgccacgtggcagccatattaacgccacgtgttggcatttcttatgtccacgtggtggtgcgcgctgatgccacgtggccaaaggtggagacaccacgtggcagtcatatttaacgccacgtgtttacattttatatgtccacgtggtggtgtacgctaacgccacattgccgaaggtggaggcaccacgtgctctcattttgaagcgccacgtgtacatatctgatttgtgacacacgtctttacctgatgttgccacgtgttgatttgtttggatgacacgttagcacagtagggatgaaggcccgctcattttttttttcttagcccagcccatttggccacatacttcacatattgttgtggcccatcccactatgagatctaggaaatttttagcattcacccatttcaagcaacaattaatcagaacttcgcagcacataagaaaataggcccaacatcaagattcatcacatggacaaacaatcagaacttcacagcacattacaaataggcccaacatcaacatatatcacatataccaacttcacatagcaccatattacaaaaaagttcacagaacctagcacacatatgttcacattaagtccacaaaagtttgccataggatgacattaagtccaccatagcaccaaacatcatttcacataatcaagtccaccacatgacaataagttcacagaaccatcaaacaactaatataagtagatagagttcatcacagtgcagaagatcataaaggagactaggacagatttaagttaccctgggaaaggctcaagatacgtcgaaggagcaaattgttctcttcctgctgctgcttgaactctgccaactccttttgagtctttgccagtgcttcatttgcaagatttgcttgttcttttagttcgacaacttctgcatggagaatggctgaactttgcttttcagctgcaagttcttcctgaagtgctgcttctgtcggtgtcactgatttcttggagctcatctgcagaccggcatttttcagaaacgtggtattggagttgtcccgagagagaaccttggacacaacttctgcactagttcttggtgtctcaccatcaggtacaggttcttccataatagctttcatacttgactgcagcaatgattgaacattagctatgaaattagatacatgaaaaactggctgctgcataacacattcaaaatactggcagctgcacaacacattcaaaaagtcactgaaaactgatggaaagctaccaggaagcacaaactagaggtaaggaaacttgtatagaatgcaaatttaaccaaatttgttttccataagccaaaacagaaacaaattatatgagtaagccaagcattcccatatttagaaatattgcattgccctcttaactgtgaaagagaccagaaacattttgagctctaactatggtagaatgtaattattttctatctagcctctagcaacaatgcaggccaaatgcttcttgacagaatctaggatactgttttagcatatatcagaaggctgactttagactatatttgattagctttcatggcagcttttgattgatggaacaccttggtagctataaaagaacaaggttttcccctcaactactttcataaaatttggagggggtgcaatgttacttagcgttggttattttctattcctcctatgatgcctaaatattttccctagaaaccactaatgtttagaaagaaaatactagtgtggagtacataatccctcataattaagtttacttttccaagttacaatgaaataagttttgaagtagtaaaggctgaaatatgttcagtcttatgttcatatgattcaaaacctcaatacatgcaaacaccactacaacagcttaggtaaaaatgaattttcatgaatcacaccctcaaacccgggatattgataaaaatacaaactgcaaccaggatcaattgatgaaaaaatgtttatgtagcttatttggcattttaacccaatctcaacttatgttgtatatggtaagttgtcttttccagcagctacaaatttagtttggtatgtattctaacattgttagagtctataaattccattaagtctgtaatgatcttagctgcaaatatctctgcacactaaggacagaaattatcctatggatgtaaatataaaatgagctgaattaataatatgttggcataggtaacaaggaattgagttcaatgttgtaagaatatacagagtgacttacaattgcatctttggcagcatcacttagacctttttccctactggtatggcagtcctcaaaggcatccacagcatcaagctctacaaccttgttcttctccttctatttcagtacagaaaatgcagatcaattattttatatatctattacattagataagtggttcttaactacaattaatgctaaaagataatgggaacttacgtaagcgtgcaagtgtgcagcatagctgcgagatcccgtagcctgatggaacctaacattaagccggttttgcttgttctgttcagagatttgctacaaaagatgtatgtgttagacatagtcgcaagtataaaatgaaacaaatatgtcattagagatgacataccatattctttggatttgaccactttgcaacaagttccagccactgttcatcagtcatgctacttatgggagaggtagttctaatctcgttagcaggtactccattgaagtaggccttcttcaaattataccgtgtttgtcgtatccctttctgcaatacatcagcacaagcatcccttgttggctggtgtttttggttaatggccaacctgacctgatggtttgaattgcaatcattaaggagtaacactaggtcatataatagatgaaatataaaagaatatagataggctcttacagataacttgcccatgaagttgttaatatagccttcatcatccttgtactgcttccaatgagggaagacatgaactttagtcctaatgataacaccagcctctgatgcaaacttggcagcttgcaccggttcatctggccttttcttcccttcggcaacagcaatgggcattcttcccatagctttggtcatcttgtcaagcattattcctgcagttggtggccttgattttcttgtgcctcttcgtataggtactacagagtattcaattacaatgttagcattcatcaaatagttaaaaataataaatttctcttcgttgaactaacttgccttcaacatcagaattggtttgctgtgcaggttgctcttcatggttggcatcatggctcgggggcctgttcacatcattatcttgaagcaaatgtccactgcccacatcttcatcaccattgttttctgtttctggaggcagttcttcatggcattacctttaccttgtgctgctatgagttgccttttcgctgaccttgttgagactccaggaggcatttcggttggagcacccgccctcactctctttgatatccttactcctggtggcatcttgaaggtaggtttcttcttcgtcgcacacttctttcgtctagtttgtcgagggtactacaataataaacacaaaagttgtaagcatgtgaataaattagcaacaatcattaaaaaaataatcaaatgctgcacaaattaaatgcggaaaaattattgcagatatcctagccccccccacagccaagatagaagaagcacctcaatcattatggggacgggctgctccggttctaaatataaatcatcatcacactgaaccccttgttcatcatcttcagggagaaactctgatgtatcagaaccttctccatgacttttcttggtgcctgagttttttgtctttgaagatgcatgttgtgtttcgatatgtttaatagtggcagctatgtctttgatgccaagttcatccatccttcttatattctgcaagattttctcttgccgcgttctttcatattcgttttgtgtaggttcttacatgaatacacatattttaatggtcagaatactagatggcattttgatggcatttcctaagcatataagcattttcagaaatagaaacaataaagtatctaggcatttgggatgaaaaaaaaagagaccatgctcatcaacattggggatttaatgatcaatggtgaaaaacaactttacttcaatatctagtaaaaacaacagggtgattcacttttccattttaaaagacaattttgatgagaactctggaaacacttttacagtgaacaacattggtcatataaatgatatagccattatatcattctctttcacctaataaactgtatctatatatacgactaactcaaattattggtacattcataaacacaaacaaagcagaatctaaataaaatttccattgttgatctgaaatccacactctggaagatgcttatggcaacttgaggcacaaatttatttgagaatcaacatagcatgattaatttaaaggtgcgcctgaataacacagaaacaatgccatatgcagtagcaaactagcaatagcatcaactgttattgtagatagtgacctcaatcggattgcacacagaaaattcttaatagaagttggacggcaaatcaatccacatgatgtataacatctaatagcttgagacagtacacataaacatctgagcttgagacaacaagataattttgcgtacctcgtgctactggacgtcgacgtcttcccatcggctaggtacggcgacggtgcagggaccttgtcgatggggtacccggctccggtgcggcggtaggcgtcgacggtgttgtgggagatggcttcggtgcggcagtagtcgtcgacggggtaccggctccgatgcagcggaagtcatcgacggcgtagtgggggaaggatctagtgcagcggtcgtcgtcgacggggttgcagcggaaggcgtcgttgcggcggctgtcgacgacgaggaagtaggggacggatctggtgcagcggtcgtcgtcgatcggtttgcacgggaaggctccggcgcagcggtcgtcgtcgacggggttgcgggggaaggctccggtgcggcggtagtcggcggcggctctggtagagtggcgccccgatggtgtggcggctggatttggggattagggtttggtgggtgagaggctttgtaaatatatagtggttgcacaaatgcccctgggtgttgttttgctcttcgttagatggaggataaaagtgacatttcccattctgatttgggcaaatgggcggcaatggaatgttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccatccgtcattagcaactgtttactgcagcaccacatagtcaaatcatggcgcaattaggctcaaaatattggtctcacaatttacacgcaaactgtgtaattggttattttgtctacatttagcactcaatgcatgtatctaaacattcgatgtgacatttttggaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggtgtctttttttaattaattggcacctatgacaaattaaaggtgttggttttttttttaaaaaaaagaaaaccaacacctatagtattggtgtcggctcttctatgtcgcgttttccatctactccctatccacgtcgcgaaatttgccgacgctttccctttcccgtgtgtgggagccgccgccactgcactcgatggatatgatcagtgatagggaagggtgctactaaccgggactcgtctctgctgtggacgtctaccacaggggcgcggtcatcgtctcccatgtcatcgagacctccatgtcatcctcgtggttgctcacctcgccattcaccatcgtcaccgtggaatgcaagaacctggttccagcctcggtggcgtcgccggtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaatctgggtgaaccggtcggtgtttgtaggaaaaatgttggaccggccggttttaatagaacggaccgggtggtttggaccgacttacccctcattcttatcggtagaactcacatataacgagggtacaatcgtaaatcaacacacatataacaacggattcagatccaaaccaaaccaaatcgtaacaaaaaaaaagagcttcctcctccatggcggtgagaattagcaggaagcgcaggagcccgccgacgcgtgggctggggacctccacgacggcgtgctggagcgcgtcctggcacgcctcccgccggacacattcttccgcctccacgccatctgctgccgatggagcgcggccgccgcgtcaccacacctgcggccgcatcccgtctccgactccgactgcatcgccgcagtagcagctggtccaggtgccgcatctccaaggctgatgctcccagcgctgctggtgaagaggacctggtgctggccatgatcgagtagcaagcttctggtgcttatgctgcttgcttcctggatgtgggcgacaacagtagcttgagaagaaatgatacttctttgtacagcttggtgaattcagattgagatcgtgaatgtgaataaacttatggctgattattgtgttattttgaaaatgtgaagaccatatttgtgtcatttttttatgtcaattgaatatgacaattaagaaaaaagtgtaatgctttgaacagatgcttgaagtgtaagttgtgtttgtacagattgaaattggtttttgctgcttgaaatgtcatggtctgtacagttttagactgatatgcagtatgtcacttggaacaaatatatatgtacatcactttgcatactgtttcaccaggaaacttactggattgcccaaaaaacagaagtaaaatattttctcttctcctgaaatttttgacccaactgcttcacatattgttaggaatatgagttagcaccatgaacctgggaaagaaatcaaataaatgcaaatcattgctggtaacaactctgttcttaaaattgctagctcagaatctcgatgtgtttcagatatgcaatggcaaatgagttcacagaataaatcagttgtgacatctcagttacataacacaaaataaatgagtttatagctcatcccaattacatatgacatatcagatagatgacacaactcaagatataatttaatcatcatcggtgtcttccggcatgtcatcttcagcgttcccattgccactgtcactacagtactgcaatattgtgtcatctttatctgcatcatccctactgtcttcagtcaagttacttggttgttaaggtcttctaaattagcttcaataatagtaacttctccatcttcctacaaatggtctagatcctcatcagcattaccttcatgcacttcatgttctgtatcagaacaattatcatcttggtgtacatcaaaaatgtggtcatctttttcagacacattatacatgttcctatgttcgaatttctgcacaattcgccattcgttgcccaaagaggtgtcctgcaagtaaaatatcttcttcgattgagttgctaaaatgaaagggtcatccttgtaccaaaatgattggatgttgatggatttgaaatgcccgtcatccctaactcctcttgtcttgccaacttgattgaaccaatcacaacggaaaagaaccaccgatcgatagatatctagatcagagttatactgcaaatcaagaatctccctaaggacaccataaaattcaatgttatccccttcatgtgtaccatcaaccattacaccactattctgcgtttgaggtatttctcacggtcaacagtactataccggactccgttgacaatccaactctttactcggagatcaggaccacatgacaatgcaaatagtgcttcactgaccacccctggattttctttcctcagcttccagatctgatatatatatatatatatatacaagaaaaatacacatgttattcccaatttgaaatttcatcaccaaaaaatgatatttttgtaagtgtgtgtcacttacatgagtcttaaaccacctagcaaatcctttttcaagtcttctgtcaacatcatgtgcatcttctttctccaactcttctctatgcatgctgtagcaaattatgactcaacaattaggaaaatattatatttaatacaatacatgtgaaataaacctacataaatggtgcttactccaaatatggttgaacctcctcacagttatttagcacataccaaactagcttatccatgatttcatcctccatgtactgtatcctagtggatcctatgagtttaacaccatgcataaaaacagagctgttaccatccaatggcccatccccatgacgggcgtcccgattaaatctagtgtcaacatcctccatgtaccttgaacaaaatgtcaaggtgtcacttgctacataggcctcagtaattgatccttcaggcctagccctgttccgcatggaattcttaaaggtgccaagtcgtctttctattgggtacatccatccaaattgtacaggacctctaagtagtgcctcatcaggtagatgtacggccaagtgcaccatcacgtcaaagaaggctggaggaaaaattttctcaagtttgcataggatcagcgggatgtcttttttcagtcgtttgaggacatctatccttagatttctactacacaattccctgaagaagttaccaagctctgcaattgcttcgtatatatccttgtccacaaatcctcttatgccggcaggtataattcttaggagaaggacatggcagtcatgagttttgagcccctgcaccttggaaccatctgaacttatgcatcttgctaggttggctgcatatccatgtggatacttgacacctttgaggaagttacaaaactcaattctttgttccttcttcaagacatagcgagcttgtgggatgcgaactgagttgccatcctgctgtaagtgcaagttatgtcttatgttcatatcatgcaaatctatcctcgaattgactgtgtcctttgtcttgccctcgattttgagcaatgtgcccaaaatgttgtcacatatgtttttctcaacgtgcatcacatcaagattatgtggcagcaacaaatctttccaatatgggagcttccacagacttactttgcggctataaattagtggcccttcatcctctccacgttttcttttcttacttgtatcatgcttacccggtctaacatctttcaccttctctaactgctcgaggacctcatctgtgctgaattttcctggctcaacctggttttcatggtgtccatcaaaagcatggcttcttcgccaagcgtgtgtccttggaaggaaacgacggtggccaaagtagcctatcttatttcttagtgctcgtgacaacggatttttgtcacaatgaatgcatgcataataaccttttgtagttcgccctgacaaggtgcttagagctggataatcatgtatgcaccatagcacggcggcacgaagattgaactttctagcactgaatgcatcataagtactaacacctatccataattcaagcaattcttctatcagaggctccaagaataaatcaaaatcctttcctggagatgttggacctgggatcagtaatgacataatgcagttcgatggatcgacagattcccatggtggtagattcaaaggcataacaaggacaggccacatgctatacgaattgctcaccttgccaaatggattgaatccatctgtagctatggcaagcctcatattccttgcatcttctgcgaaagttcgatactttctgtcgaagtccttccaagcctccccatctgctgcatggctcatttcattatccactggcttccgcttgattttgtgccactgtgtgtcttcagctgttcgttttgatgcaaatatcctctttaacctggataagtggaaactgcctcaaaactttgcgaggaaccttcctgtcgccaaccccatcttcccatctggattcaccacatattgggcatagatccatattggcatattccttccgaaatagcacacaattattcttgcacacatggatcgacacatatccaaggcccaattcacgaagatatttctttgcctcatcataagattttggtaattgacattgagggaatgccgaggacaacaacttcaataattcagtgaaagctgtattgctgattcgataatatgacttgatatggagcagcctcacaagaaaggaaaatcttgaatggttagatcctgggcaaagtgcctgcttcgcatcttcaagaattctagcaaaccttggtggctgtccatcttcctctgccgcagtgtatagttcacctattaactctggaactccattgtcatcctcggattcatacccgcccacatctgtcccttcattatggttagtttcatgtacctgttccaaatattcgacatcttctgtatcaactaattctccatgataaatccactgggtgtatgttgatgacatcccaaaaatatgtatatgatcatgcatttcttgctgaggcagtgaagtgtggttaagacacctacagcatgggcatggtatgtcaacgtgttcatcaaatctttgtccaacaaattccatgaactgtttcactccctccatgtatgcaggtgtgaattgtctcccatgtatccaagttctgtccatctgctttggcatgttaaaaaaagcaattaggcaaacaaagctaatccattttttaggacagaatattttctaaaacattagatggaacagctggttgctacatgacttaaaccatgttgatttgttcataatactctgacttgtttatctgttcatacaacacaaagcataatctttcatagctggacatgcatttcatactcagagtaatgtacttatggaaaatcataccttatatctactg

SEQ ID NO: 20522 - DNA, 30197 bp, Oryza sativa
  unsure (1)..(30197): unsure at all n locations
ccggtgggataaaaacctcctcctctgcgccgtcccggtggctaggatccgcccccactgagctccgcctgggccccgccaccctccctccctgggtgtgaccaaaccctgtgccaccccccccctccctccctgaccaaaccactaggtcgcccgcataaagcattcaatcattcttgtgttcgagaattgaaaggaaaactaaaagtaaaacatcatcagcatgaaagctccttgcagcgtagtggttaagctagaattatggttagtcacaagtcgtgggttcgacccccaagtgctgcagcattttttttagaaaaaagagttcacatgggctgcacagattcacacatgggctgcacaaattcacggactgcacaaatttgggctgcgaaaaaaaagttcacatgggctgcacagattgacacatgggctgcacaaattcacgtggactgcacaaagcatctgctggcccgaaaacgcacctatgctgcatatacaatgtggggtccaataacaatctggatagccacgtatacaatgtggggtctagtgacaacctagatagccacatatgcaaggtgggaccaacagcagaatagagatttacttacaactgacgaaatatatttcagcatattgtattaataaaggagcgtcataagtgtgttacatgaatggtgcgcaccattttgtgacgaaattatctattgttttatgacaccattttaaatttcgtcatggagtttcgatgtctaccctccgccatgagtgatccatgacgaaacatgaaatttcgtcatagatatgctgtattcaatgacgaatttatacaacgtcatgagcaaaacgtcatagatggacgatttcctactagtgtgactagcttatctgggagatgctttggtgccggtatagtgtttgcttatgcaattactctatgtcatgacgatgatattagagtagtatctggtagtttaggcgtggtgtctagattacgggatatcattatttggggttatatattgcggatgagatgtgggccgctgatggtgacagctcagtacgggtattcctccgcgcctatatataatcctaagctaatttcctggggagggtaatcctccgtatttagcctcggttggatggtcttgacaggctgtcgtaaggaactcggcagtcaggggtggcttctcgaagtaccaggagggcatcggatagagggtattagctagtatatcagttaactagaatgtatgtataatatgtatattagaagtataggaatggattctttttcttttttctttccacctagcttagattatttattatgaggatgagtagttaaatgcttgtgtgtcactctacccttagattatcttaacccctgcttagaatatgattatcacaagtaatatataaattattagttgagttctctctacatgatcttcccaccggataaaataaatacgataccattggaatactctcgagtgaaatgctacaatggtatatgcgtgcgcttgcggatgaactctataaccataatataccagaagtatttcggcaccgttgctgggaattatatttctagtaatgtcgttaataaacaccaacacccactacatccacttctattggtcgagttaaggctacacctggttcttgaccagaggtgtagcgatactcccactacccttacttaaagtggttgagttaagactacacctgtttctcgaccagaggcatagcgattctgccactatttctactttaagtggtcgagttacgactactacctagtcctcgaccagcggtgtagcgattctcccactatttccacttcaagtggtcgagtgaagactacacctgattctcgaccagcggtgtagcgattctcccactacttccactttaggtggtcgagttaaggctacacttgattcttaaccagcggtgtagcgattctcccactatttcctcttcaagtggtcgagttacgactactacccggtcctcgaccagtgttgtagcgattctcccactacctttacttcaagtggtcgagttggggctacaactagttttcgaccagcggtgtagcgatcctcccattacctctactccaacaaagttgatatcaggtacacaatatcgccaagtgttttacccagagatcccttaccacgacgacacttagagttgaaaccaatcctactgtccctttacgccgccctggcaaggcctccgaggaacctatgggaactttggctggggacgcctagagcagataaggccttgtcaggtaatacagagacgaacgaccatgtaagatctggttatgtaagagttctcaccgagcatattaaccaagctgtgtaatcggaaattgggttttccaaattcactgttgggggctactgtaagcgctttttcaaccaaggcaggtcaagggtccaagagccttatccttcgagaacgattctccgatgacaaggctgggggctagggagagtgtatgactcaacaaattgactgatcgaagtccataaaagagaagatgctcgtacacaaaacattggtctgtaaatttttatttattttagttttccatacatattataacatgtcaccctttgagcgttcgcttaggggctatttctatctaatattcttttctaagtattgatttcaggaaaattctattcgacattcttgaagactccatgtctctatggttctacaccaagatcgactaaggcgagtacgacaaatgttgacaaggcttcgtcatagattctacgccttctcgatcgctcgagaacggttggtggatctcgacaaggaatacggaatgaagagatggtgtacccgccgagataaaatttcttgacttcaatccaaattctcgattacagcaagacggaagacttagtcgtatgctctgtaccttcttggttgacatcagagattgactcagacaaaccctatacgatgcccgcacgaggcagataagggaagtctaacgttatctccgaactcaccgagaacggtcacgtgagctcgacaacagttattccaaggtctttggattgagaatatgaacttgttaatttgcattgaagtcgtgggctactgtcagggttatggataccacatagctgggaaccggctcatctgacgttgtggaggaacgtcacagcgtaacgtagccgaggcaatccaccgtccaatctaatccaacgcctctctgctcattgctctgtttgttaacttaattagtgttttggagggaaaataaacatggtaactatgtttgccgccaaaatcacagatcgcttccccttctcttatgtgctcctcctaacagaaccttgaattgacaaggtttggttctaatcattactctgcatctctgccacaagcccataacatctcgcctcattcatatcctgaaatcctgattggtggagacaagctgcaaattccgatggaaaaccagatcaatgctgattaaaaccaggagggaaatcataatggtgactagttcgattatgcttcacaataatgttgatttcatcacctgtttactcgtataataaagatcaaaatgatccggtagataaaatcataatggtatatactctgaacaacatattatttggagcatgggttcagagagcatgaaccggcagtgaagtgcaacatatatactagtccgtagtcatacaataaacatatctttgaaaattattatgcatcaatagtttttttttctgtgtgttttcgcagagcaaatcccatacctagttggatacctcaaataggcatgaagttcagcaccttagatgaggcttgtaaattctgggagtactatgaaggtcagattgggtttagtgtcagaaagaggtactcaaacccaagtaaatttgatgggaaaattacttcctgcagatatgtttgtagcaaggagggtcaccgggtagctaataaaagagatcacagtactaagcaatcgcgagctgaaactaggactgattgccaagtctgaataggccttacaatagatcaagaaacagcaaactatgatatatttgatcttgttcttgagcacaatcacatgctccacttgaaggaaacatgccaccttatgccatcacaacgaaagatttctgaagtccaggctttcgaaattgaaatggccaatgattcaggtattggacccaaagctgctcatgaattagctagtagacatgttggtggatcttgcaatctcagttatactcgttaggatcacaaaaattatttgcatactaagcaccaaaaggagctaatgtacggtgaagcaagtagtatgttaaaatactttcaggacaaagtcactgaaaatccatctttccattatgctgtacaactggattgtgaagaccaaatcacaaatatattttgggctgatgctaaaatgattgttgactatgctcattttggtgatgttataacttttgacactacttttgaaacaaacagggagtataggccatttggtgtattcactggattcaataattttagagaaactgctatttttggtgctgccctcttatatgatgagacatttgagtcattcaaatggctttttgatacttttctggcaacacataatcaaaagcaacatagaactatatacacagaccaagatattgcaatgggaaaggcaattgagcatgtatttacagaagcatggcatggattatgcacttttcatataatgcaaaatgccaccaagcatttacctagtaataggaacagtgaaacaaatatgcttacagaattcagttcttgcatgtatgaccatgatgataaagtgaagtttgaagaagcttttgatgctatgagaaagaaagtacaaaaacaaacatggcttgatagtatatataaagtaagggagaagtgggcagaatgctacatgagagatgtttttacattgggcatgcgaagcacacaattaagtgagagcctgaacaatgacctgaaaattcacttgaaatcgaatcttgatattattcgatttttcaatcattttgaaagggttgtgaaaggcaagagggacaatgaactgaaatcagaatatgaatccagggaaaaactacctagaatcaagatgaggtcacccatgttgctccaagcaagtaagatttacactcctgtgatatttgaatgtttccaaacaggatatgagagatctactgtggcatgcactaatgtattagatgggaactaccagttcacagtagcaattggtattctttctgatgatccaatatttgaagaggaatacaatgttattggcaatatttctacagagacagcttcatgcagctgtggtcagtttgagagaatagggatattatgtgcccatgtatttgaaggtccttgatttgatgaatattaagttactaccacctcattacattttgaagcgatggactcgagaagcacggtctggaactattcaggattgtagaggaaagaatattattgaaaatccaaatttggctgcaatacttcgttacaaagttctttctcataaatttgtcaatttggctactgaagcagccaactctgaagaatgttgtattcttattgagaatacactcgatagccttagcaagcaagttaaaggccgaatgaatgcatgccaaagtaatcatgatgctgaatgtgatgagcaaatgatcctagaagcaccaaaagtacatctaagagctgcacggctgaagaagaaccagttcagaataaaagcttaaagagataacgaaattggactaaaaaacagcacaagaaaaacaaaaaagcacctctaaagttactgctgcacatcaatctcctactgtatgtttctttatcatatagattgattttcttgccttatttttttcttattgtgaaaatatatcatatttcttgtagaccttcacactattatgttgcccaggaacaagaagatgggaacatatcggcacaaactcaattaccagcagagaattcttgtagacaagaagatgggaacatattagcacaaactcaattagctgcagagaattgttgtagaagaaatgagaacgatttttagggatatgagttcatcagtagctacactgaactactgatggtagacttctttgtacaattccaattatcttgtattttaagaaattttagaaacgatttgttgtcctatgctaacttattctcttaacaatgcagggttccagtgtagagatttttgatcattacacgactttgtaagacttgttgcttaaagatccaagctattattagaatttcatttattacaatatttttattcagttctgccacatatttgcagactcagttgtgttataaaatggataccatcaatctaaattttttgagctaaattgtttgaggagaagtttcagtgtcctagatgcctagtagatgaatgaagccactagctttgctgttaatcagttaattagcgtgatcatcagcagttaattataactgagtgtctctgacaactaccaacttgcacttaacaaatagagcagtgggcagagaggcgttggattagattggatggtggattgccccggctatgttacgctgtgacgttcctccacaacgtccgatgagccggttcccacatagcagatagtagttgactaaatcacggcaagacccactatataccatgtcttatacggaaacaaccttcggatataggaggagttccggataaggaaagacaactagagttctacttgaaaatgacaaggactactcggattgtatccatattggtttccctagttctatttggacaagggatacctatgggtataaatacaaggccccctaggaggagaggggacacgaaacaatagatcaatatacaagccaacatacgccaagacaagccgccggatatcaacatcggagataagcctagtagtccccatacggtagctacgactaccgtcaagagggatctaacgctgtctctgatctcgctggacacggattcgaggaggaagactactttattgtcgactacgtgtcagcacttcagaccgccatatcgacaacagatagaaaggctaccccaaatattctactggtgtgattatggtaaataagagcaaagaccggcttcggccaacaggagtagggttgttacctgacaattcaggggcccgaacctgtataaaaatcctcgtctccatcttttttactacaatctcgcatatatcctagtaccaacattccccatactatgcaaataccggaatcgcgacatcaaacgtcgacaatatcaatgcaaatttgataacatctagcactggagaagctgagagatacttaattttacagtaaaaaaatttggtacctcttgagaatcactctcatatcttagtccaaaaattaaatgttgtttatttaatcataagaagacttgcagtttagcagtattattgatggcactagcagactagctaactgaaccagagcacaacaatgtgatgtgaggagtgctgctcatctccacaattaagcaagcagatatgacgtgagccatggactaattgaaccagagcattacattgtgacgtgatttatgactaagctagatgtacactgttcatatgctcatggaagttgtgtaacaaacttgttgcgcctagcatttttaattccttgagatttctcactgttctttcttggcaacattgtggggatgatcgggcacggagaacaacctttttttttccattgtgaaattttctgcttatttctcacatcgattcgtgggttcatcaattaataagaagccttcaggatcacattatatatgcttacaagaaggaactctgaagttcagagatgttctggcttccagtgtcattattcaccctccgaggcaaaaattatcatgcatagtgcaataatcaaaaaacctgtgtattgggagctggttgttgtatatacaatatatactccttatgtttcatttttatgacgttggttacaacatatcagaacggagggagagtgtaaaaggaggtaccaatgacaattatcctcttgttaatagaattgaaaggagattgtctgcaaactcagctttcttgtcttatggtgatcgggttgttggtgatatgccctatagccaattataaagatgattgtatcacatactatgtttatatatttattcgacattgttccttgaaatagataactcactattattagttaatgaatatatgattctttcatgggactatttatgttgtttgttactatttctaaaggatccctgatcaaatatcatatgtagaacaaatatgtttaaatgatcagcacatgtattaattgacgatcatgtcttatggatcatggtatagagataccaaattaataatgtggacacgtgttggtgaacatgttgttggatagacccaacatgagatactgcaagagccatatgtgttgtgtcgtcagtgatctcatttagtgttggtgttgaatccttagacctgagattatcatggttcccaacatatgtagtagcttacttagggactgctaaacgctactccgtaattgggtagttataaaagtagttttcgggtatgctatgaaacatgtagtgggatatgaataatcaagatgggatttgcccctcctatggagagatatctccgggccccttgatgttatagattatggaagtgcatggccatgccaaaggtgattgaggagtcaatcacaagttatgtaatctatcacaagttcgagtgaatgattgagctattagaggatggcacatatatagccttaagcttaatcgatatcgtgaggcaaaggggttcatataagtatacactagaggtttagtcgatacgatctttatgtacgtccgtgggtcattacgttctgctagggaccgctgttgacacgtggaccgaagaggagttattaggttacagccaagtgtatatgaacctatagggtcgcacgcttaatgggccggaataaggggattggatggagatccaatataatcttaattcagataaggatccgaataggagtcctacgggccttcgaggcccaagtcatggatccgatatattcgtgaggggcgtgactggtggaggtactgcatcacatgagaaaccctagccgtcactctcctccccgagcaaaaccctagccgtgcacaggtgctagcacatctgcgcgtggcgttccgcccctgtacgtgtggataccggtagaggcgccgctgctttgcggtgctaataggcatgggagtacggcgaggagaacgcacgaggaggagaaggtcgagccggtgcgatcgactacttcctctacatcgacgcgccctacttcgtgaggattccttcgccttcttagcgctttattccactgtgcagcgcgtcgagtggtacaatctatgatctaatacttacatgattcctggtttatgcactagaaaattttgatttatactattgtagcctgcgcgtatcccaacaaggcatactctacttaattcagtttgtcctccttgccaacttgcatgtgcagtttaatgttgcctaagacaatgattgataatattgatagggcaaggaaacattttctttggagaggttcatatgtgaattcaaatagaaaacctttagcagctcaggataaagtttgtaaacctaaagtaaaaggggggcttggagtaatcaacatttctatatagaatcaggctcttttgttgaaatttttggataagttctataatagaaggaatgtgccatgggttgtgtaggatcgaacacaagctaccaagcctaccagaggggggtaaatggtagggaaaaccaaaaacccaaaaacttttagcgcaaataaaagttaccctcaaattgatggaaatctcgacgtagtcctgtcgccgccggtcagaccgctcacacaccgccggttgaaccaccttgctgccgcctgaacccgaagaaacacaaatcgaagaacgctcaaagtagatgacaacaacaacagcactccttacaaaaatctcgactaaactcgaaaccctaactaaactatcaactccacgctctgaaaagcgatacaagaagcctcacgctccctctctatttatacccaaaaaaacccctactaaaaataggtgtagaaatcctattcacaattggactcaatacctcaattaacaaaccaatttacaattactaaaacgaaactacagccggacgcatctcctgtgtcggctcggtctcggtctcctattcctccacgcgctgacccttcctccaatgagccagcaaatcaccaagcaggccgccaactcaccacctgggccggccggtctacaacacaagcaagcccacgtgcacatcccagccgaggcactgatgcttgccttcaaccagtaagccatcaaacatgtacaagtcacaccactcatacatgcatccctgctacagtacctcgtgtactttagcacatcttttcttcgtatttccttcacgaacaccgacacttgcacgtacacgtgaagcctgttgcgaagatctctcccacacggtgtccatccaccgtgtgccatctcgtatccaacttcctcacccagtatccttgaccgtctggacctcaactcctccctgagtttagtcccgattcccaccgttgaccgaagttgaccttcaagaatccagactctagtcaccttctcacatggtatcccgaccgcactagacctctgctcctccctgagcatagtcccggtcctcaccattgaccaaggctgacctcaaatcacctgcacacaatcagacaaaacaaccgtttctgggcacagatatcacaacctgacccacattagtcacacgcactcacaccaacatctacacatcttttcaaactaattcattgataaaatcatttgcacagccaattgttcatcacaaatattaatcatgacaatgatttcacaggatgaacttatctggtcctcttattatgatcaagtagtccctcctttgtcatctctaaaagggtctttttgttggagagatatttgtaagttgatggacttctttagagggattgctagatgcaatgtgggagtggtttaacttgttctttttgggatgatgtttggtctgataatccccatctcagtttctcaatgcctagactttactcatttgggattgctagatgcaatgtgggaagtggtttaacttgttctttttggatgatgtttggtctgataattcgcctctcagtttctcaatgcctacactttactcatttgctgcttacaaaaattcctctgtgcatagctatatgacagctccaatttcagacaattttcagccgcctttgtctcaccaagtttaaactgagtttcaggctctttcagatattattagcactattgacctttcagagcaaaatgatatatggtcctatatttggggtagtttgaagtatacttcccaaaagttttatgctctgcatttttttggctttggaagagtaaggttttctccaaagttaaagtatttggttggcttattttcatggacagattgaacactaaatttatactggatcacaaaaactgttcatagattgtgatacgttttgtattctttgtcggcagagatgtactgaaactttgatgcatgttttctttcagtgccctttctcggtgtcatgctggaatcatttaggtatcttgtgggatagttctctcaggctgaccaatatgatcatgaaggctaaacatggtaacagtgagcaatgcttcatggaaaagttccttttaagggcatggaatatttagaaacaaaggagtggtttcatttttgagaatagattacctttgttttccttttggaggcaacttcttaaaggggacctccttcttttgctgttttaggttgaaagtgagtgatcaaggtgtacttagagattagatcctcttgttgtaatttgttgttttgtaaccctttttttttaaataataactttaacaggggaggccccctgttgtgctcctttaaaaaaattactgattataatggctggcattaccacacaataaataaatagggcttaaattaaacaaaatatccagcggatcctcaactaactgccagggtgtagtattaaacacgtaagcatggcattacttctgatttacacgtcatagcttgcgtagaatattgctcaatattctccgcatgctatatatcacatggccatgtgcacacagagaactagagaaggagaagcgtagtgcctgcatttaccctcgtcaatgggcaccgagaaaactccttgctgtctttataccgtggtttctacgggccgtaactctcgtgtatcatacgagttttaccatccatcagtttttgcctgtcaacttggcttcggtcagcttccagtcggcgtctactcatcgataaacttcaagccaggggcccagtacccaatgccctcgaattcgatcgcatgatgctgattgaaggaactcctctttttggaagagatttgctccggtccaacaaaaaatacctcgaggtatcggtacctcatggtactaaatcatttccgatcgttggacctagctagacaggatgggtattgttagatccaacaatcggaaacgattttgttggattagaggaaatctcatttctttaacttgcaaaattttccagctaatctcatcaagcttttatcatcttgtaggctgttgaagttgatcccacccctcacatgggtttaggtgaaatagactgtcttagttgatactgggttttcaatttcgattttggctaaaatgttagttaaatttcggtattttgtgggctaaaattttctgaaatcttaacacaatttaactgaatttggctaaattcacaaaaaattgagaaaaaccgaaaattttggccaagatattggcttgttgcgcgggtgggggggtctgaaattacagaaatttcgaaacgaaatttcaatccctgagttgatgtacacattagagacacatgggtttgggtactacaagagaagtagaacgtggcatcaaaattctaatatgcatgccctcttctagaaagcgagaggtacaattgacgtggaaaaattattcactatctgcagctcaaatgtgctaagaggattatgaaaactttacagtacaacaaattttactatactatcgaaaagcattgactgagacaggaggatgatgccaaactcagaatgatgaagtaaatagttaagatggatagtgatggatttcttcaactagaagtcaaaattatttgatttctggcagacgttaccagcgcccctgttgtgggcagtttgaacccaaaaacttttatatgactaaacaatttgaatgcacccaggcttaagcaaggtctacatctctagaaaaaagctcagactaggacagcatgctctacctctatagttatcatcagcgttctctacatgcacaggctactcttctttcggatggccaggatggcatgaacaaaagcagttggcacattgaagctacagtgtgcagtagaaccaatcgtcctccacttgcaagcagcgcaattcgagtcgatttctgatgaattagaccaagatcatgacaatgttggttttctttcctctaagcctcccattcttatcacaaccattactatatatgagtggaaattcatcacggttatgtcgatgatcgagaatgagttgggaatttgaggtgctgagattctccgtcctgaagaagtgccttggcagcgtatataaatttcgaattgttgtacttgcacacaacagcttcccgaagctatcaattgtaggcatttaccccttgatgttaggctgcttatctcctcttcgcgtaggacatttgcatcaccatataggactgccgatcgggtcaagctaataaatattccagttctaaaactaaatatatatagaggttccttgctttcaaaataaatattttaaaatcaaaatgtagttacagtctaaaagtttaacttcagcctaatctaaaatggcaagtattatggaaccggagggagtagcgaatagcaggcaggtaaaggattagtatctggatagcaaattaacaatcacagaataatcataaatttagaatatatatcattaataacatcaagtttcactcaaaagacttgttcacttcaggaatcctaattggcgcgtacgaccccccccggcgcgcacgcgctggcccacacggcccgtctctcgtctactagtactcttaagtgttaacgtaactagttaattaaggataatgacaataattaaggaaatattgtttttttgggagattttttttactaatagattgtaaagttttaagttacatttgaaaagttttgacttacgatttaatttttaaagtcaaattttgaaaactttcaactcaaactttgaaaatttcaatttgcaagaaaattttttaaaacttttaactccgacttaaaaacttttcaatttctacttgaaaactttcaactccgacttgaaaactttcaactctaacttgaaaacttccaactcagattcgaaaatcttcaagttagatttgaaaactttcaactcgagatttgaaaactttcaactcagattcaaaaactttcaactcgaatttgaaaacgttcaaatcaaatttgaaaattttcaactcgagatttgaaaacacgtgtattgtagattaaaaaataatcagaaaaagcttaaaatgggaaaggaagaaatgcgaataaaaaacaaaagaaaaaaaatcgggcagggcggatttatgggcgcttttttctgctagctctacatatcaatgtaggcagaactgatagggggtgcccctaaagggcgggtgatcgcacccagcgatcaacccgcccctccccctatacttctatcccttctcacttttcatcataaattaaaacaaaaacaatgttagtaaaagaaattagaaaaaaaaatctaatactctcattctctcattcatgtgcatagattttataccataaactttacacgcataaactttatatatagaaatattctatctacaaaatatttgaatccgaatttaaatttgaatcgggtatataaacttttgacttataaactttccctctacaaactttaggtgaataaacttaataaaagaagaaaataatattctatatataaaatatttgaatctgaatttaaatttgaattgggtatataaacttttgacttataaacattcggtctacaaatggataaacttactaaaagagagaaataatgtggtgacaaaaaaaaaagaaaccaggcgtgctgcggatgggccaagcacaataagcaagaaaaagactaggccgagaaagccagaaaaggcatgaggcacaccgcacgtttggactagaaaaggaaaaggaaaaccgatcgctacgcttataactcagcgattaatcgctcattaggaatttcggaactgacaacaacaggaggcaggcaaaagtgtgtaacaacgtccccagctgatactatgccttccacgactaatttaaatttcggagtttattactcttttgcttacagaaatcaactataacttatcccttaaaattaggcaagtttggagtgatcatataagtaccactagaaaatgagcgtgccagttgggacgctagctatagtttataacctgcgtgtatttcccttcagaaatcatatattcaaaaggattattgaaagtcttttttttatttttatgtttgtaaacaaattaaaggaaaatagtaaaatcatcctgattagtggtattatcatgctgaacagactatatgacatcaagaaatgattaatgatgatatatattagtaacacaaacatgttttattaatattcaatacaattctcatattcatgtaagtcattgagtttggattagtaggaaatacatatctaaaataaatttgtctttgattgcctatttctttttactagtttcatttagaaataaagacgacgacatggcaaagacaattatgttgttttcttatatctagatatactacaatgcatagctcagttggttaggctctctatctatacgagttcaagttctaaacttagcatagatgctcgtatttacggctatttgttttttcaatagtaggaaacccattactcttcatcaatcccaagagtaacggctcagtcttcggaggtgctcgtagtgattgggtttgtatgtgtgcgattgcaagtatgaatatacacatttgtatatgaacatcaatgtctatactatgtagcaaaatgattgttgttacttaccaatgttccaaaataaatgaatatgtagcataaaaatgtataatgtgaggagaaaaaaaaaagaaaatgctctgaattaataggaaagtagttataaacttgtcggttcacagtgtaatttcacatctattctttccattctatagaaattcaggtattttcctcatttgaagtaaaccttatctgaagatttttacttgtcctaacgcaatccttttggctccaggcccaagcttgcatggccttgcaagatgccagggccaggcccacccagcaagtgcatccaggcgaatgtttttcggctatctcgcgaagtgaataccagggtgcagatcccctggagttggcttccaactccaaccggtgaatttggaccaatctgaccccttactttgtttctatgggctagatgtagccatgtcacctctttctaattacacatttacaacagatataatcctatttacttttatttttttgtgttgtccgtccattcagatcaatactctcggaagagcattatagatcatggagtaaaaaataattatctttaaacttttttaactgagttgttatgaaattaacggtattgagacctgtatcgaactcattcatcctaataatcgacagaacaagaaacttctatcggtgcaatatttttgttttgtttgttcttatctaattgttgccagaaagtttgaaggtaacatgttctctactatactagataatatttttttatagactctacattgtagtatttcttttaaataaaacgggctagttgtaaccaggggaaaagggattggatttaatctaatccatcaaattaaagggacggcttggattaagtaaatccaccgtgtggatttggagacaactccaggggatccacacccgtgaataccatcactttgacacgtggcaaatctttgaagggtgtaaccaaatttgtagggagccacatggcccaatgaaaagccagatctctggccctgatttcgggattaaagatatgcggtgtaatcaagaaatcagactatataatgctcagaatcttattgttgttctgataagtatataaaaagagtgtactgtgtggtgtggtaggaagaaataataagaattagctccgggttttactatttcgttcatgtttgtcatcaggtcctcactaattctctttcgtgtgccattttccccactttttctcctacatgtgacttttttaaaaaaaaataacccctggatctactgtgaaccattggcgaaaagacatcgttgcctgcggtcatacatgtgatgtaagatgagtgagagcccatatgccctagcacgaggatcgtggcctccagaaatgcctcttcgttgatggtcatggctttagcgactccacagtggggtgaaatggaaggccggcacttaaggctgggtcagcgaggcaggagagcaatgagcctctcaaggccagcctcgccgagggcatctcctctcactcctgctcaccggccggagatggacgcggagaaggcaaaataggcagggacaccggtgtgagctccaccctagtgatggctgaacgatggcgatgagctcgggcaagtggagattatagttgtagccggtggtttcccctgttgggaactcaacctccaccccagccttgcccagtgccttcctctactgcctggatattgccacacaaaacatctgctttggaatgatattgccacccctgcataggtggtttggatgttgcaatggctctgagatatctacttcctccgtttcatattttaagttatttggattttttttctagtcaaactctattaagtttgatcaagtttatagaaaaatttagcaacatctaaaataccaaactagtattattaaatttatcattgaatatattctaataatatgtttgttttgtgttgaaaatactactatatttttctatgaacttattcaaccttaaagacatttgactaggaagaatgtcaaatgacttataatgtgaaacggagggagaatcatttatcttcgtttgcatgcagcaagttggttttttcatgataatgtatagagtaattaaggtgttgattaaaacagttggaattctcgacttagaattctgatttgttctccaaaatcagtcgtctcctttgtggcggtgcatgactccgttgattggctgtgcctgtccagaattttctcagttcgtgcccatgttgcactgcccatgtacgttttcgagtatactagttgatttctacaaaaatagaaaagagaaaactcaggaaacatgagcagttcacgctctcgttttctacgtgtttcctctattctgctatgttgtgtgccctgtttagtttgtagagatctcaaacttgtatgcgctcacttgtaaaccttcccggtcttgaacagtaaagcacaacaaaactcgagtagatgatattaggacatagaattggtgacaaatagtagaggacatgatcttaggaggccgatgctaaccccaatcagcgctttagaattggtgacaaatagtagaggacatgatctaaggagaccgatactaaccccaaccacgcggttgatctagggtgacatgtcatagcagcattgcaatcctagaatgtacatgcaggtctacggagcacttctttcttgatgcattccattcgcagataaatcgatataattttgatcctcgatttattgctaatacgtacctagacatgttgagctcataagcagagtatgagaactgtgttgtgctatatatcggtgcagcatagctcttgtcttaataagagtacgtcgacttagatgcttgtcctgtatgcacgagttctagatacaatagatgctagtgctgatgaaagtaagaagtcaaaaggagtggcccgtagaggttgtggtgaacctcccgatcaccgaacacatcaagataatgtttgccaattccaaccaaactaacttagttcgttggtacgcagaagaacataacgtcgatggtaagcatgcaaaatcatgcttactatgatcctttcccagcttcctccaatgtatttgtgagtttactactagcacatctatctttatcatctctcatctattccataccccaaccgaagctcttgccatcgaggagaatctctacagccgatttcacctcccgtgagagaagtcaaggaattaatttgaccagtcgatatcttaatctataacaaagtatggattaaaactgaacaaccataagattaaaaagggctaggaggtgtgcctgcattcagataaatcaaaatggtttaaaataatgggtccactaatttaaaagggacaattgcaaatttaccactactttgaatcgttattgcaagactgccactagaaaattgcaaaaatgccactagaactgtcactcgagtggcatccttgcaaaattgaaaaaaccggtggcaaatttgcaaatgccccaatttaaaaacgttcaatagctatattatttttcttattcctcagattttctagcatttatagaagtggcacgtgatgacttaagtgtatttgtaggatgtgcagtgggatattagtatataatatagattgatagaagaattgtcaatgtactcctaatcctaaaccaccaccctattcacacacctagtaatgcagcagccacccaacactccaggctaacctggtgttatattaagcagggaaaaaattatttacatgatcaccagcgatgaaagaagaaaagggaaaaagggaagagggatgaaaagacaagtagaaaataccactaatcaatcaatgagtattaggttgataatctcgcgatgtgttttgctccacatatgctccatagcttgatttcatcctgtatcttggcccgcagttgcggcatggttttttcttgattccaaaacactcgtctgttctgctcacatcatatttccaatgctactagcatgtggactgattttattgctttggctttgtctttcccaccttgagatgttttcctgatccaccagtctagcaatagttcattttcatcatctgtcaggtcaatttcactacagttcagcctacttagaaccctctcccaaatctgtcgcacaaaagggcaatctttaaagagatgttgagttgtttctaggttcctataacatagttgataaaaacaattatttggccattgtctgatctgtagccgatcctctgtccaaatcctattttgtagcaagagccaggaagtgtttgcatttggagggttcccattgtttccagattagttttgctgcagccggtattatccttccattgaactgcgctatataggcggacctcgcactgtattttccattgctcgtccatctccgagttatggtatcgtcgacaccttccgtgagggtgatgccgttgctccatacttggttgaatacctcaaagtacgccttgactagctgatttgtgaggttgcgccagatatcgtctacccattggtcattagcttatctttcctggactgaccttactttgattttggcatgcttgtataaagtcggagcagattccttgagtggttgttccccaatccagttcgattcccaaataattgctttgcatcagtctccaccttagttgctgatccaaatagttttctattgagctcatcacaaggtgggggtgtgtcactgcccaaggcttgtttgggcacacccaactgaaccatagccatcacactctcagtgctctcgcaaatttgtccagatcgaccactcccattcttccgaaagtcccattataaatatggagagcgtatattgttgcagccggtgatgttcatgttacacccattatatatatgattcctaccaagatgacagaattgacactgtggagattatggataccccatatctacacggcatgtatagtctggttgggtacggggtaccagatatagatagaatatctttatgaggactcgggttagtttctaaacttgtatgtcaaggagatacctgagattctagtcggttacgattgtaatttatctataatcacatattccgttagggatatgaacagtattttataatacggactccttcccctatataaggaggggtccgggtccctctagggacacgactttctcccagatcatacgatcaataatacactcggcggaatcatccccagacaggagtagagtattacttcttaactaagaaggcttgaacctgtataaaattccttgtcttcaaacccatccacttttttagcttgatagccacacccttttagtattgccgaaatcttgtttcgacagttggcgcgccaggtaggggttgcgtcaagtttttcgccgatcagtgcaatgggttccgtctccggcatcgacgacttcgtcttccctcccgggcaggcgtttcggttcggcaacctcgacttcatcaacaacgtcttcggcaagatcttctctcttgactcagattcgaaccagtcagggagagaccaggtctcagccccgttcggtattccgaactcggccaagatctaccccaagcttatcttgatcgagtcggcttcaaaccactcggacgagatcccatctactccaacaacaccagatcgagatgatggggcctacccgccaatcctgatgaaactccccgacgatttggctgcgtcttcactacaagggcgtctcctccccgtaggcctaggcggaactcagcttcaacaccgatcctgcctagctccagggaagtcggcgtcatactccagccactcggcacggtttcgacggatcaattggaaggctacttcagttccccttgcgtcgactcacgaccaacagagatcgtggagtacgacgaattcagctatcgatacgacaaccgcgacctcgacgactttgacgaaagctttgaagataattacacccctctctatttcagcgttttcatggccgacaacgagacggaagaacaacgccaagcccgagaaacggaagcacgacgcgtacaacaggaggctgagcgacgccgactggaagaggagcgccaagcacaagagcaagaacggctgcagcgtgagcaacaagaacgcgaatgggctgcaaaggaggccgaggaccgacgacaacgagccttggacgcagggcgatgagcgcgagatctcatcgggcagcaagacgttgaggggacagcggtcttccgtacccctcaacagaacgttgtcgcagaaaatcaccctcctcgacaccctcctcaaggaagacgcactcaatcaagctgatcaagtcgtcaacatcttgaaccagaccaagaccatgattgccacttcggtcccggttaactccggaagcgtccgcatgtcgactggcagccgggttccccatctccgatctcatgattatcaccagccaagcctcagcatcgccggcgcaggatccaatcgcaggagcaggggccacgacgagcgatctgttcactcgcctcctgagcgacacaagtagcgccgagttgaatggcttttctccccacctcgtcggtgccccgtcgatcttcgtgatacgatcaaccagcgccgtgcagcacgaggccatgcccaccgccattcaccagaacgctacgacgacgacgtggatggagtagctgcctttactaacgacatgcgtcgagtggattggccagccaacttcaagccgactggaatcgagaagtatgacggcaccactaatccggagtcttggcttatcatctacggtcttgcaatccgcgcagcaggaggagacagcaaggccgtggcaacctacttacctgtggccctagcggattctgcccggtcctggcttcatgggttaccacgtggcacgatcggatcatgggcggaacttcgcgaccacttcatcgccaacttccagggcaccttcgccccggcacacagtttgatctctacaacgtcattcagaagtctggagaatcccttcgagattacatccgacacttctctgaacaacgtaacaagatctctgacattaccgacgacgtcatcatcgccgctttcaccaaggggattcgtcacgaagatctagtcggcaagttcggacgcaagcctcccaagacggtcaaacagatgtttgaaaaagccaacgagtatgccaaagccgaagactccattatcgcatccaagcagtcgggtcctacttggaagccaaagaaagatgtgccgactacgggaggggttggaagtaacaatcacaaggaccgcaagcgtaagcctgaggaacttgttgcgactaccacacactcctcccgacaacgttcgcgcgtcaacacttttgacaagatcatgaactcccaatgtccgcatcatcccaactccannnnnnnnnnnnnnnnnnnnttcgtctacaagcagtttgcagagcaatatgccaagaatgcacgaaagacctctgatggagaacaaagcacatcgaaaaagaaggatgatgatgatgatgccccgacaggttttcaagatcatcgcaaggaactcaaccacatctttggcggccctctggcttacgagtctaaaagaaagcaaaagctgactgaacgggagatcaacgctgttcagcccgatacgccccaatatcttcgatggtcggagacaacaatcaagtttgaccgctcggatcatccagactgagtggtccacccgggacggtacaccctggtactagacccagtggttcgcaacatcaagcttcgcagatccctcatcgatggcggcagcgcactcaatatcctcttcgccaagaccttggacgacatgcagatccctcgcaccgagttgaagccgagtaatgcgcccttccacggagtcatcctagggttatctgccacaccactcggccggattactcttccggttacctttggtactcgggagaacttccgcacagagaacgtctgcttcgaagttgctgatttcgagacagcgtatcacgccatactcggacgcccggcgttagctaaatttatggctgtcccgcactacacctacatgatgatgcagatgcctggtcctcgaggagtcatatccctgcggagcgacatcaaacaagccgtcacatgcgataaggaaagcggcgagatggcccaaacccgcgagatcgcggtcgcccgagaagacatccgactggccgcaaccacggcaagcgaaggagaagtggctacgaccaagatctccaagactggagaaagcgaagccaagaccaagaaaattcccctagatccttctgatcctactaaaactgctgtaataggcgccgagttagattgtaaataggaaagcgcgctcatcacctttcttcaaaataataaagatatctttgcgtggaaaccatccgatatgcctggtaatcctagagaggtgattgagcactctttgcatgttaaggaagacgctaaacccatcaaacaacgacttcgccgctttgcacaagacaggaaggacacgatcaaggaggaattgaccaagctattagcagcgggcttcatcaaagatgtccttcatcccgattggctggctaacccagtcctagttcggaagaagactgggcaatggcgcatgtgtgtcgattacaccgacctcaacaagtcttgccccaaatatcctttcgggttgcctcgcatggaccaggtagtcgactcgaccgccggctgcgagctgctcagttttttggattgctactcgggatatcatcagatccgattgaaggaatccgactgcttgaagacttcgttcatcacgccctttggggcctactgctacatcaccatgcctttcggattaaagaacgcaggagcaacttatcaacgcatgatccagagacgtttctcaactcaaatcggtcgcaatgttgaagcctatgtggatgatgtagtcgtcaagactaagcagaaggatgatttgatcacggacctggaagaaacctttgcgagcatccgcgctttcaggatgaaactaaaccctaaaaaatgcaccttcagagtaccgtcagggaagctgcttggatttatggtgtctcatagaggcatacaggccaacctggagaaagtcaacgccatcctcaacatgaaaccgccgagttcccagaaagatgttcaaaagctgactggatgcatggcggcgctcagccggtttgtttcacgactcggcgagcgggggatgcccttcttcaagctgttaaagaaaacagacaatttccagtggggacccgaagcacagaaagcctttgaagacttcaagaaacttctcactactccaccagttctggcctcaccacacccacaagagccgctattactgtacgtatcggcaacttctcaagtcgtgagcacagttctggttatcgagcgtgaagaagaaggccatgttcagaaagtccagcgaccaatctactttgtcagcgaggttttggccgactccaagacgagatatcctcaagttcagaagctgttatatggtgttctaattaccgtcaggaaattatctcactacttccaaggtcactcggtcatggtggtcacatcgtttccactcagcgatatacttcataatcgtgaagcaaacgggcggatcacaaaataggccttagaactgatgtccttggatatatcgttcaagccgtgaacttcgatcaagtcccaagctttagctgacttcgtcgccgagtggaccgagtgccaagaggacacgctcgaggagaagatggagtattggactatgcactttgacgggtcaaagagactttcgggcactggggccggggttgttttaatttccccgactggagaaagactgagctacgtgctatggatacatttctctacatctcacaacgtggcagaatacgaggcgctccttcacggactatggatcgcaatctctttgggaatcaggcgtttgatagttcgcggagattcacagttagttgttaatcaagttatgaaagagtggtcctgccttgacgacaatatgatcgcttatcgacaagaggtacgcaagttggaggataagttcgatggactcaaactcacccacgttcttcggcacaataatgaagcagccgacagactagcaaattttggatccaaacgcgaagcggctccttctgacgtgttcgtcgaacatctttacgaaccaaccgtaccaaggagagaaacagctgaggccacggacactcaagacatagccatggttgaagccgactggagagagcccctcatacaatttctgaccaaccaagaactcccccaagataaagatgaagccgagcggatttccaggcgcagcaggctttatattattcatgagactgagctgtacaagaaaagtccatcaggaatcgtgcaacgctgtgtgtctttggaggaaaggagacaatttgctgaaggatatacattctggtatctgtggcaattacgctgctgcacgcaccattgtcggcaaggcttactggcaaggttttttctggcctactgttgtgtccgatgctgacaagattgtgcggatatgtgaaggttgtcaatttttcgcccaacaaactcatctgctagcccaagagttgcaaaccatcccgctgtcttggccgtttgcggtttgggggcttgacatggtcggcccgtttataaaggcagttggcggttacacacatctctttgtggctatcgacaaattctccaagtggattgaagctaaactggtcatcacaatcacggcagataaagctagagattttttcatcaacattgtgcatcggtttggggtacccaatcggatcaattcacaggcggagtatttaaagatttttctgaaaacttcggcattaaaatttgttatgcctccgtagcgcatcctatgagcaatgggcaagtcgaacgagccaacggcatggtactccaaggaataaaggcacgagtttttgaccgactgaatccttatgccggcaaatgggtggaacagttgccatccgtactttggtcctttcgcaccacccctagtcgttctacgggccagtcgccattcttcctagtttatggagcagaagcaatgttgcctagtgaagtagaatttgaatctttgcgttttcgcaattttcgcgaggagcgctacggagaagaccgagtggatgatctacaccgactggaagaggcccgcgaagcagccttaattcagtcggcccgatacttgcaagggttgcgtcgttatcataatcgtaacatccgatcacgagccttcttagtcggcgacctggttctaagaaaaattcaaactacacgggatcggcacaagttatcccctttatgggaagggccatttgtaatctcagaagtcactcggccaggttcatatctgactcaaacatgaagacggtacacctatcaacaactcttggaatatcgaacatctacgtcgtttttatgcttaagttttgcttctgtattcccctattttgactgacaacatcaagcttctccttgaagttattagtcaggggctattataataataatggagtgtgatctttatcaattcaatttgcttacttgatttatcattgccttgcctgatttttcgacttagtccatgaggactgaaagctttttaatagcttttgcgggttttaggctcaataaggcttgacaaaagcttttaagaaatcagaagctaagtttgaaacactaagcacaacatatattcatcagtattgtacaaattgtgcctccatcatcatcatcagaatcattgttatcacattacatcaatcagtatcagttttttcatcatcggagttatcaggaccagtcggtcgaagctcggtgtcttggaatctctcgactacataaactgctatcttgtcgatggctttctacgcatcattgataaggtcaagagcagcttcttcgctcgtcccgtctgcaaatccatcaatggcatcaatgtcgatttttgggtaaaggaacttggtcattgccaacgccagactcgctcccatactcccggcctctttgatgttcttgaaatatgtatccggagcaactctcagcttgtcgaagatttcggaagcatcgaatgtactcggaccgttgttattgaagaacattgcttggaccagtggggtagcatcgttagcaacttcatccctggccccttcgagcctcttgattttgccgactaggacgtcgaattgagcctgcgacttgatcttacggtctacatcaacaaattcacattaatgagttagcatatagaagataatggcttttggggtatcgattgatggtaccttcaacatccttcaaagccgagtccctctgtcttgccagttctgccttgtcattttccagagtctgaatctgcttctctccagttgagatatcttggcggcttgcactacattgactctggttaaccgaaattacaaagatgacagcacaagttagttggacagagtttgtgtgtaccttttgatgagccactcaattcaaaattagactcctggagctcagtgatccgatcccttagatcatgctcagttttcttggcaagttcttttgcctcgtgcagttggtctctggtagcttcaagggttccgagatgaggaactaatttctctaaggttgctgtttttgcttcattcctaaggtgaatcctctgcaaaatagttttattagcgctcgagctaaatggcaaacaagatggttgacgtcaggcgtcaaggaacttacgtttacaatgcgagttgcctggccgagtgcctttttcaataggcatacctcttcatcctctttttgcctatttattacgattccttaaggttgtatgtcgtcatcccaccacttgaccagaatgggagggtgcgaatcttcagccactcgtattcggagaatttcttcttcatcaccaatcattggtcctaatgtgtccatggataaaggttgaacaatcaaatgaagtcagttggatcaacatgatttcagacaaagtatttacccgtgatgatttccggacgaggacgagtggattcttgtgcctttgcaggagatccagatcttgggtcattgctggcatcctgtccgcgagggctgtttgcttgagtttcaacttcaggaatctcttggcttggccctatgtccgactggtttccagtcgggggctcctggttaactctgacttcagcttcggccgactggtttccagtcggaggttgatagctagattctacattgtcggttgccggctgattgtcactcggatgatcctttgcagtcggcccagtttctttggaggaactcgtctccatgttagtcggatcagagtctttcccaaaagggtctatatcagatggtttcctacaagtttgagttatattatcagcattgttttcatgataagtgagcgtcaatacaaggaagatcgttatatgattcgtacctggaaaacttcctgatcttcggcataggacgactggatgttttcttctttggattggcatgcttcggcaattttccgattgtttctttatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20523 - DNA, 3009 bp, Oryza sativa
ctacaaagctgctacattgaggtcatgagagctaacggagggaataggtacaagatccctcacatgaacaaggagaggctagaggcacttggcgttttgcctaaagcccttagttgtgatcgtggactatatgagagagtcatggagtctttggctaactagtggtggctattttgtgttatatatgtaaattgctatcgctatctatgtaattgtggtttggagaactaactggtgttattttgtgttatgcgtgtaaattgttagcgtcatctgtcactacgccatccgctggttttggcaacaaccaatatgtattgtcaacagtcatcatataatatgtgttatatatgtattttcactgttcgttccatccttaacagatacatcaatggctgactatcataaaatattcctaaactatatgaatcatgaatcatgcatttcgttgttattatataatgatacttagtttacacaagcatttactgcatgttatcacaaagaaaatataatgtcggttcgattgtgcaccaaatgcttagcatactcaactcgaaattttgcaatactatatttacaatcaaaatcttgcagcatagactacaagaagttttttttaggttcgaggtgcaaggaatactgagctaagtaaacaaattcaccaaagatgacacaaataagctttaaaaggtccttataattaattagttaattacacatattgatcaagcatctactgcttacatactacgcaaaagggagtgtgcaccaaacagccttggtagtcatgctagttcttcattttttacatatatgcagagatcaaagcggtttagccaaaacaggattccatctctagccttgatctcctcattattaatgcaatactaatatgtcttactcctagtgatattagtactaatactcctagatggcatatcttccatggcattatttgtgaggtatggtgaagtacaggggaagtaaaatccgtaacatactttcgcgaatttcagcaaattcgtcgacgcccccatctccggcagatacaccaacatcatcttgtaggccagccacctcctccccaccgaccagctgttcaatgccatccatgtgctgctcctccaagttggcgaagatgcctttctccggcttctgctccaagttaaggacgccgccaccacttgcctcatcctcggagtcagggacgatgcagccttcgggtggcagctcggagtcgtggacgccaccactcgtctcgtcctcggagtcagggacgacgcaaccgtcgggtgccagctcgaaatcgtggacgcagccacttgcctcgtcctcggagtcagggacaacgcagccattgggtggcagctcggagtcgtcgccaccactacttgcctcgtcctcggagtcaggaacaacgcagccatcgggtggcagctcggagtcgtcgacgccaccacttgcctcatcctcagagtcaaggacgaagccgccgtcgggtggcaagtcggagtcagggacatcgttacttgcctcgtcctgggaaacatggacaaatccactgtccggtggtagctccgagttgtcgatgccgccacacgcctggtcctccgactcagggacgaagcaaccgccggggtgccactccgcatcagacaagtatccacatgcatgctggtcctcggtgagtaactggacgccgtcggcgccgagcaccccaccaccatggcgctcctcggtgagtacctggacgccgtcggcaccaagcaccccaccaccacggccaccatggcgcctacatccacctcgccttgctccacttgcctgttgtgcttcaatgttcagttccgccaccctccgcttgggtgcggcccttctaaccagccgagccgtttcctccaaagccgcgacgggcagtgaatcgacgcgcgccggccgcaccattgccacgcgcccacgccgactgttgaggggagaggcgaggtgaggaggttagggattggggattgaagttgagtgcaacataggaaccggattgaggtgggagagagtgaggatcagggttgggggtgacggaggaaccgaatcaggtagggaaagattggggatcggcgatggttgggggcgatggagattggggatcggcgctggttgaggacgacggagagcgatggatgggggcgactagagagaggataagatcggagtagtactagcgcaacaaataaaaacgcacttcttttttctggttcacctccacgtatacggaggggcccaccacttctctctcgacgacattttttctgggacaatccaggggcggtgaaacggcaggttttgtgggacggagggagtaggatggagcatccactggggtgctgatattgggcttcgggccttacgtacggaccaaagacatgacctaagcatggcccactgtcagccattcaagcctgccacctcgagcccggttagactagccccgaccccgatgtggtaacctcagatttccctcgtgttggtggtcacctcaagcgatggaattacgtgtgcagccagcagcagggcagctttacagtgctctcccctctgcgctcttgccacccgtgagcgagggagcggttgattgatttccgttatctcggtccggggctacggcctcgccgagtggctggctctgtgtgaccgcgcgcgcgccttggaaaaggatgaaaagaactgtgcgcagcagcagacagggcgcggaagagatactctaggcagatagcacagcgcacggcagggcagagcaggaggaggatatagcatcgggggtcccggcgcgccgtatcggaatggcaggcagcgggcagcggcagtatcccgagcgcagcggcgcgggcgacgacgagaccaccgcgtcacgcgtgagcgttgcggatttgttgggattggtcgatgttttggatgcatttcgggggcggtgcgtgtgctgctcctgtatgtggccaaccaaccccaccgcgc

SEQ ID NO: 20524 - DNA, 1077 bp, Oryza sativa
  unsure (1)..(1077): unsure at all n locations
cagtttctaaccgaacccaacctaccagaaagaactcttctaaagcactgagatccaaactcacaaaatagcctaagtttaactggttaagctaatataaaccctgcgatccaaacgcaaagcagggggcatgcgggcagcaggcaagtccaccaaccgaagtaccaacccccgtggaatggatagaccgatcgatcggcgtgcgccaccaccatacactgatgcacaccgctgcaagcggcagtgaaagctgcagcggaggcgtgcacggccaaccacgtgagcgctgaatgattacgggctcatttttgggatgccgcaaccaccaacagctcctgtgccgccggtattattgcgcaggcacagcacatcatccgctccgcaacaaggctgctccgcagcagcagcctctgcacctgcactacgtctgcgtctctcaaagtcgccaaaagccgagactgccagatcaaagtaccggcagtaccacgactcggtcttgcatttcacatcctatatatggcgataggctcatgaactggaaacaggcacatgcacgcgtggaagtgagggggtcaaactgtgcctcgcctgcacgacggcacgagcaacgttcggtggaaagaggtgaaaggatcaaaggacgtctactgatactctgatagcatggtagatttggcatctgctccattcaagtcggccttgattcttcgttccatatctgacatcccgggtttagtacggatagcaagaaaaagttcagaaaagaatttacgagggaaaaaaaatcccacgcgagacacaccgttcggtgaaagggaatggaagacaaaagcctgatcaaattctctcttttcgtgctttgtagtcgtagtaactttggactgtacggccaatgagcgtctactttggtgaagtttgtaagagtaaactgtgcacggctagagcagaactactgtaaaaaaattgcacgcatatacttcacccctgtgcagaagacaccgagcatctcactgtataccccactggatttacagctaaactnnnnnnnnnnnnnnnnnnnnnnnnnnnnnnnnnnnn

SEQ ID NO: 20525 - DNA, 1539 bp, Oryza sativa
ttcaggggtatagaagggatcgggcaaatttcaagggtatgaaagggatggagtgagttttcaaaggtatacagggaattgactctttaaatttaagcactcatatcagccttcttactctaaagtagagtaaagcaggcaaggggcatcctctctattttggtttaagctcacttccaaggatatacagggaatttactctttaaacttaggcactcatatcagccttcttactctaaagtagagtaaaacaagcgagtggcatccctcttcattttatttagctcatctactgattatctaaccgaaaaagcaccccaacaccagtttgatactgttcgaaatcactgcaacgagtgggtgacacaatacaaggacaccatagtgcaccgcaaagcaaattttggttcgaaattttcgaaattcttttcccccccccccccaacggtatgctcaaatctcgcctaaaattttgggttttttgtaacttttttttgtgaatttgggcaatttttattggaattcattcagattttcaaataatttcggccagaaatttccgtaatttcggtgaccccggcatataaaatccaatttcgaaatttcaaaccctgaggagacacgcccgttggtaatgttgttacagcatcgacatgttcatcgaaatctgaggtgctacattgcatacctctgagtccaggtcattgccttgtttcgtacttgtacgtgtgggcgatttcagggaccagaggatcatcagggttcggatcagtcagtacagagcaaattgacagcaacacctgaaagcaaacagagagcacatgtttgtcggatttgttcagcccaactggaggaaccaagcaatcgtcttgcaaaaggaaaatagcattacacgagagaggcaaccttggaaatggttagtgctgtgaagaaaccatagcaagtaaccatcgaggcatcgacactgctgaggtctcgctgatatgagtagtggtgcacggctgcgaagtcacgggtagaagggaatggggaagaggagaacgaaagggcaaacaaacgaatgggcctggttctatgggcttaaagtgtgcattgccgacaagcatgcacgacttagtttttccggttttgttttgccacgccaatctatctatctattatattgctaaaacaactttgaaaggaggtatcatattcatcgtgggggctacaaattcccacattaatcgaagaaaaggaaaagaagagtccaagtagaaatataatttaaaaataactgaaattcggaattaaaaataagcaatatagaaaaaatgcacgtgcgttgcaacaggtaaagacggttttttcagtgatatatcaagagaataagtggtaagcaataaataaattaaaatattaggatcactatacattataattgaaaatgttaatgaaaattctaacattgggatcgctatatatagattataattaaaaaaggtaatgaattttttttcttggtttttggccgaaagcatttctttcttttcaaacgta

SEQ ID NO: 20526 - DNA, 24058 bp, Oryza sativa
taagcaatatagaaaaaatgcacgtgcgttgcaacaggtaaagacggttttttcagtgatatatcaagagaataagtggtaagcaataaataaattaaaatattaggatcactatacattataattgaaaatgttaatgaaaattctaacattgggatcgctatatatagattataattaaaaaaggtaatgaattttttttcttggtttttggccgaaagcatttctttcttttcaaacgtaggctagtccactacctccttcgacccacaaatggagctgtaagcccagctcgcaccgtatcgtccactatcatcttcaaccttccaaacatagtcacgtgctagtacggttgcctgtcacccaaaattggttgcggacttttaatctactcaatactctttctgtttttccaaaaatcagagcgtaaaacctgggataaaaatgaccggggaagatggccgtcatcatcggtaacggttaaacgaagattagatctggcaaattaaagccgaatcgaaagggaaaatcataaagaaaatgatgagggaggagtagggaatcgatttttgcaatcaaattggaggagaaaacgcactattgatatggcggcggtgggaggcatgcggcgaacggatcggattaaaaatccggatgagtaaaacaaaaggcacacgggataaaaaatggcgacaaaaaaatgacgaaaaaactgagtaaattgcacccacattgcaacaacttggtaggtggggtgcaatttggtgcaataacttgagaaatgagcattatagtgcaacaacttagcagaaatatgcaatttagtataataactttagaccatataaataaagtaggtacgattttgatacaataaattaagaagttatgtgacaacttaattatttggagcattttttatataaatttaattttttaagtatttattttgacaatatagtagcgtggatttgtataagcatatttatatttttatcctaataactaataactaaaagttaataaaactggatgtaggaattattacattttggttgatatttgagaaggtgaagaaaacaaaaaattcttaaaggtaattggatgcaaattttatgtgcactataattcttaaagattaagttcaatattataaggtaatatctgattgatatttgagaaggtgaagaaaacaaaaaattcttaaaggtaattggatgcaaattttatgtgcagtataattcttaaagattaagttcaatattataaggtaatatccgtaggaatactgtgtaatggcatattaacatcgtgaaaaaaactcacctagcatatgcttcgccaagttgatgcaccaaaatactaaattgttaagttcttgtactagaatgcacccacttgtcaagttgttgtactcggacgtccaattctcaagttcttgcactatatcgttgttataccgtgggtgcaatttactaaaaaaacaaaagcgcccgggaggcgcgcagtgaacacatcggaataaaaaaaagacgaaaataaccaaaagccttagcgtgtgggcaaaaaaaaaagtctttcgcgtgcaaaacaaagtcgggaaaaaaccggtgaaaaaaaccaaacggacttttttcttttttttttactggcaagattttttttctttttttttcgagagacaaacaatttttattacgacgacatatgtttttaccgactagagaagctttttttatcactttttagttggactttttcttttcttttttcacctttttgagtcggatttttttatttctttttttacagtcggacttcttcttttcttttcttttttacctttttaagttggactttttatttctgttttactaacaaagaaaatttcttgttctttttaagtagagatagagattagtaccgaaacataaaattaaaaccgattcatacacgaatgtaccggtaaaaacatcttttttttataatagtagagatagagatgtactttcagtcaataaatagtagagacatagattgaaagaagagtccatataaaacccaatacaagattaatcaaaattcagaaaaaaataaaataaaatccgatattatatatatatatatataaagaagattccaagtaggaatacaatttaaaaataactgaaattcggaattaaaaataagaaatattgaaagagagtccttataataacccaatacgatattaattaaaatttagaataaaaataaaataaaatacaaaatcagaaaaaaaaagaacagttcatgtaggaatataatttgaaaataactaaattcgaaattaaagttaagcaatattgaaacaagagtccatataagaaacaaatatgatattaattaaaattcaaaataaaaaataaaataaaataaaaaaacagaaaaaaataaaaaacaagttcatgttggaataaaatttttaaacaatttaaattggaaataaaattaagaaatatcaaaagaatagtctatatagaacacaatacgatattaattaaaattcgaaataaaaaataaaataaattcagaaaatagaaaaataaacataagagctcaagtagaataaaatttataaataactaaaatttgtaataaaaaaataaatactattgaaataagagaatctagaacacatgacaagattaattgaagttcaaaaataacaaataaaataaattttaaaaatagaaaaataattataagagttcaagtaggaatataatttatgaattaaaaatatcggaatgaaagatatgcaattttcaaaaaaaaaagtcaatctagaacacaacgatgacaaatgacaataaagagggaagaagcaataagcctataaaggagtagagtactagtggttgatgggatatctaaaaactataatcaaaaccccaaatagaatcccaatgatgattaagaggagtgacaatgggtatgtcgttaagcagcttggtcacgacggttggcgggacttatcgagcgtaaaaataaaccccaatgataatcatgtttgatttttaaaatctcaataacaataaggaggggaggcagcaggcaggctgtagaggaatatagtggcgaagccactaacaatttggcgagacatatagaaagtaaaaaaacaaaaacaataattatgttcgatttttaaaatcgaatgacaataaagggaggtggcagcggacggtccatagagtagtaaattggcgatgtttgacgatacttctaaaaaattatgaaaacgaaacccaacaaaacaatgagctcgaaaaactataaggcctaatttttaaagttctaaagagaatgaatagaattagtggtagatcgagtaagaaaataaaaaggtgacaaatgagcaagggtagtgagtgacgtggcttttaaaaactataaaattatgggatgtttatgtgctctaaaaaaagttgcacgaaaattaaagatcatcagtagctgagattaaaaataggattagcacttaatcaagggtattttagtacaccgatattgggcctatatccagcccactccaactccatcgatagcacgatattcctccagagccgttccttctccaaccacgattcctctgccctcttcttccctggcaactccatcgccgccactacgaatatgaagtgatgatcgtagcttgttgtaaccatacgtgaatatatacatgtaggaagagctataaaaaataggatagttagttcatgttagttagatgtgcgttcaaaatttaagagattttgcaacaaccaaaacaattacacatgcagttctattgggataaaattctctgcggtgcgtccccgatccgatgtcctgctaccgccaagcccttcctttgcagctatagccaagcccttcctttggagccgagcccttcctttggagctacagccaagcccttcggagccgagccgatgtgttttttaaagtatgacagtaacaaagccattggtattatgaggaagaagagggcatatgattattttttaaaagttttagttttgacttatattttaatcgacgcggtgcaaacagacaagatgaataggagattgaaacaaaataggtaatcggtttgatgactgtctcgagattttttaagccacaactcaacgatacaaacttattaaagaaaacaattgagttttctaatccacatattaataaaaaaaaatatttgttttcatacataattaattgtatatataagcaattcagcttcttagtctaattatttcaattatttatatagtaatcaaaataaagatgttgttgagcataatagatcacatcattccagatgggtgcataaactgttaaaaatatctttttttaatcttatttaattagattgtgatgaattatatttaaaattaaacctaaaactaaaggttgctacaactagttcagtcgtatagaaaaaaatgaaacatatttagctgtcaaaattagatctaaagagtattatctaagacaaaagattgaatcgtataatataagtattcagacttttattaattgtagagatactatgtttaagctgctatataacattttgttcattacattgcaaatgttggactaaggtaatcttagagctgactttttgcaataatcggaaggtgggctaagttaattttagagctaactttttgtaatcatcgaggctatggaaaatgaaatttattgtttaaaaacacataagaaagtaacattaaggtaagcaactttgctataacccaatatttttggaccgacttgaagatttagaaaacttttgtactttttttcaaacaaatagtaatggcaaaataagtacttggatttgggatgaatctttggcaagcaaataccctataatttacatctctatgatcaaataagcttattagaagctctctcctagttacatatgcttctatgctcatttgggtatgtaagttcagttgatgaatctagagtgttttcttctgatcattgactgtaccgtttatatcatctatttatatattaaaagttcattaaacttcattcctacaaacactcttcaactgccaaatggcactcatacataagctcctaagttgtcaggtggcactctaataaattagaaaaaaatcctataaattctaaaaaaaaaaaagaaccgttggattttattaaatctcatggatccattatttacaaccattagacctatcttacgaaaaaaaatctagctctcaacccagccccaccctaagctgtaggggcagacgtacatatgtactttgtaccctcctattcacatcatcatctttttcctccgattcctccctgtggtaaaaacaccatctccccgaaggtagcatgacaaagacatgatctatactctatacttaacataagccaacagggaaaaaaaaaaggattgtgacatatgttagggggatgtcgatactccagcaaaatttttgtaaaagaaatttaagcaactacagcatctaaatcatataggaatttttttatccgtttatgttgtttagattatttatgactaaatttacaattagagacatatattaattataattaacctttcaaaggaaatatgtaactgttggggccatattttctaactttgcatgtcattcgagcaattataaaaattacgaaaaaaataactatatagattttgtcatcgtacttgacatcacaataattaattagatctacaatgataaaaatattcatgtttcttattgtaggaaaagataagtattaatcaatcaataatttttttattctatttgtagttaataagtgtaatagttattacaaccccttaaacatgtaaaaatcttacaattatatgcacacatactatctcccgttcgacaattcccttccctcctctccttgttaatttcttcctctcctaactttgaattaacagtctaataaaaaacaatatatcaataactataaagctaaatgattataattcttaagttatctccaagttttgtttgtttgaactgttgttttatgtataattaaataaataatttgagacctatattaccatgtttcactatataaaaataaaaatacatcatttcaaaacccctatcctttgcatggcaaccaaatagcaacaagaatgaaacatgaaaaacatagacgataactattacatcatcttaatcattctacatcctctatagagctctggtcatcacatgttacgtcttaaatttattttttaaaaaaattagaagctacaggccatcgatttccttttaaatcggtgaatccattattttcaaccattagatctacttttagaaaaatcttaagccgtcatgtgttacatcataaaaattagaaaaaatatattagaagttcagagaaaaacaatcaaaacatcggatcatcagtttttacttaaatcatttagaagagaatagaaaaacaaacttccctccaccttgccctcctcctcacatatgcacagctgatcaactttagttaccttgctgatcaactccaatcagaccgatcgacatcgattcgagaaacttttaattccgctaaaagttttgatttttaggactacaactattcaccccccctcccgggttggcttagttcttgctgttcgatcctacagtttcagcctctcttcagatatgcttgagaattaactactccctctgtttcacaatgtaagtcattctagcatttctcatattcatattgatattaatgaatctaaacatatatatctatctagattcattaacatcaatatgaatataagaaatgctagaataacttacattgtgaaacggaggaagtagtcaataccttgatagacagacatctcctgtacattttggttgaccgggttgtgtttggtgaaacattttgccatagagagaacacaggctcaaagtttatgtgtagtacttatggctccatcgataggaagcatagcacttaaggccatgaacaaggagtgctagctccgtgttcttcctcctcactttgaacgtcaacatactggagtgggcttatactttcagaatcaatgcttgctcaagttgacatctgtgtaatttgaatgtagatgcgcaaactatcgtcagtgcgaggttatgtggctattccattggacatctgtgtaagctgtttagttattatcagtagcgtgttcaatccattcaacgtatgcaaaaagcaaaagggaacaagaaaaaaaagtcaatcgagctatgaacttggttatttgcatcttggagggccaagattcaaggaaccactgcatttggaagcactgacttgttggcaagttgcaaacattatctgaccgaaaaaaaccaccagtttgatactattcgaaatcactgcaatgagtgagtgacacaatggagcaacaccaagagtgcactgcaaagccggttttgatccttacaccacacaaggcgagagggagacacacccgttgataatgttgttacaacatcgacatgtccatcgatatctgaggtgctacatggcgtacctctgagtccaggtccttgctgtgttctcgtacttgtgcctatctgtcttgtacatgtgggcgatctcagggaccagaggatcatcagggttcggatcagtcagcagggaacagattgacagcaacacctgaaagcaagcagagagcacatgtttttgcgggattcgttcagcccaactgcgagagaccaagcaaccgcctcgcaaaaggaaaatagcgttaagcgagaaaggaaaccttggaaatggttagtgctgggctccattggtccttaaggatgtcaaggcaaatgctcccgttgctgttgatgtttggatggaaaaccttggtgcgaaacgccacctgcatattgcatatcatagacgtcacattcttcagtcagtctcggtgctgttgtaaagctatagaacttaatggatattcagactgaaaaccagaaaccataagaatttataattgaagtgatattctttcagaatgaagtaaaagaacaccttagtgataagtgagaagacaatcactaccaaaccattattcggttatatagcacagtccaggaaacaactttgttatatactacaaagattcgagaacactggcaacataactgaattagcattattagacagcagctatgctttcacttttgcatgactacagccgtaacttgcaatatttatccaccttgatttcccaaaatttgatcttcaagaatcaggttcataagtggctttgattttaagttcattctaaagtctaaacctgtatgttttcaacaagttagttactggcatgacatgccaccagttgctcttgtgcacaacttcagcatgaactttataatttataccacgttctcaatcccttgaatgctttagaatagaataaaaaatatgaataaagcaccaattcaatcaaccacaaattatagcatctgccagagttctatttttatatgtgaaatgagcagaggaatagggttacagttttacaaaacagcagtaagaagatatatatgactaggaatagtggacagataaaaagggagtgataagtcactgccaagtaccttgggtggtttgaagggataatcaggagggaagtggatggtaactaggaaaactccaccagcatatgggctatcagatggacccattatcgttgcctgccagtggaacatgtcttcaccaacaggacctgtcaaatagtaataaatcatcactgttaagaaatgtggctaggtgcagtcctaggctactatccattgcctgataaccatatcatattatgggcatatggtctagctctacagctttgattagagatgaaattgcatgataaataagggtattgaaacagggtcaaacaaaacagaagtaggctgaaggacaaaagacaagtatccattgttatgtgcacagttaagctcaggttggtttttcttgaccccaaggaaaattggaagacattcctttgacaaaataacagtatgttaccattttcgcttaatggtatacaactagacaacatgaaattgtcacttcttacaggtatggacagggtgagctccaagctcaaaggaccaaacttattctagccacactaaatagtacttatgtttccaatgtgtaagcgtggccgccatggcacatgcgatccaactagttgaacgaagtttaaagtgcaagagtgaaggccacctgtccataaggcgaagaaagttcatacaagtagtctaacaaattaagtttattctattgaatattttgggccctgctataaattttaaaaactagtagaaccactacaaaagataaaagcatatgaactgaccaatggacaggatgacaggtctgacagatcctgggttctagaaacaaagatgcagcatggatgcagttgttttggtataaaagttctcctggatcattggaaacaaagatgaagaataacaactagacaaccaactagttttctctcgaataaggcaagctaatcacttttctatactgaactacatttccattgttttatgctatattagtaaatgatgagctaaattagaaggaatagtccgatttgatactcatggtatttatagtaccacaccagcaactcctttgacaaagcacttgacaggtaacatttacatttcagaatacaaatcgcacagcaccctatatgcaatattcagctcagttaattgacacttcttgagcatacttggatggtgagatttagtttgtaaagtagactaaatcacaacaataacaacaacaccagcctatatccgccatggaaagggaagtaattctaccagaattcatcagggcaaatatagtatccctgtcaatcataatagcataaactaatccctgcatgagtacgttcagacaaactctgccgtattaatcttaatcgatatatatataaaacctccatccgtaatcttcataagatgaaaactctaatcatacagtgatctgtctttcccctcttttgctggggcaaagctgagtacagagagttactccagatactgctaagctaagcccctttgatgtatatgacaaattggagagcaattttccattgctattctacggcaaagcagcaagcacgtggacaaagaagtcattcagaagcacatgtacaaaaatctgactcctgtgcaagatgtatggcctagaactgcaaaatccacgcccaaaagaagcaagcaaaagaaagaaagcaagacctgcactgcatgatgtagggggatccttctgcagatccttgagctccttctgtatcctctttgacgccatccccaattcccccttgcttttcctcttcctatctccaacaacaagaagaacaatcaaaccacaaatcaagcatcatcaaagcttaatcagtgcaaattagagagcactcgcaggaaaacaaacctgtctaacggagagatttcacttcttttcttgcctcgcctctagctgctcttcctccttgcaagaatcaataatggagttgggggaaaggaaccaagaggaaggaggggtatatatgtcaaagaactccccccacttgctaccacaggtttgcgtgctggttttgtttattcctttcaccaaatcatcggttcctgggggcctttactttagtgatgccatggctgatcaacaacggcaggtgaaagcggaatggtatcgatcaaatcaaaatcaaatgccatccactaactccccctttcatattagtggctgctcatgaacagaacaattattctcctctttttctttttccttctcttcttaaataaaaaattcgatttgatttgagatggagatgcaggtagtagagatgtatgcattgtacctgactgtatagcattccgagcattgaaattgacgtcaaaaacggtagtggttgaccggttagccggccgcgtttttcatcgtggtgatcaaaaaaataaaagcgttgaaatggcttgctgtacccacagattctgttgatgggccttcgccgactgatgattgattcctcgtggtctacatgtcagtggcaggatcgagaggatcgaattcttgcgtgtttttgccacaaattggatttgtggatcccagtttctgtttggtagtgtgaaccgaaagatttaagaatttggttctcagaagtttctcgagttacggacttgtggtgctcaccaatacggagtgctttagttgggaaaatgaaagctccttggttgggtttgggttttcttttgcatcttcctgaagtgatcgtaatccataggtagtacagtacttagtactaggtactctccaataaaggtctgccaatgcttggctgttgctttctaaatagacctgattaaatagaaaatttatttgcatgagatgcaagacaagttcctagttttatcacacaacaacaggagggttttgtaggtatgcttgtggaaatgaattaagttctgattacagtgttttttcagtcaaagatggacaggccaacatggcatttaacagcagcagcagtgaacagtaaggcagataaatatgtttggggaggacgtgatcagcgtcctggttggcaagaattctcgtcattcaaagatgctggtcaggataattgatctgccacacaggccccagacactaagccgaaaattttacaccttcatcatcagctgaagtgcccttaaaaatcgctgctttgcccttctgttccagtaacttcaaagccctcatgagaacaccacggtcaattccggcaagttctgcaacagaggtcgtatcataaaactatccaagagcccaacggaaaataaattatgtttcaagcttattaagccaattaaggacatatttagttcaagtagtacttttatgattttccttattggacaagtaggtattttcgaaatttggagaaagccaacagtgaaagtagggtggagggtggtgtaatagtatagattgtgagagccaacgatgaagtagggtggagggtggtgtaatagtatagattgtgagagacaacagaggtgatgtggcagaacagacaccaccactagtagtatagatagatatagataaatcaatttaagcctcacacttttaacaggccacttttaacaggccagaaacatctttattggatgatgatgatgaagaagaagaagtacaaaaaccaattaatgtatatgggtgttctgaaaaacagccaattagttggtcacagaggctaaattgtgttgaatagcgttcgctggagtgtcctaacaatgtcggtcaacaaaacttataaataatgaaatgtttggcacacaactcatgcttgcttagtcacaatttatcaatctttttgacaaataccttattgattaattttcggtatgaacagtatttgagacgttagctgtccattaaacactgattaatcgtctgtcttaattaatggctttgcagtgtcccatccatccagagactacctttgttcaaaataccgacgtacaagtgaaacatcaagccaaaatacaaaaaccaactacaatattagtacccctaccataggttattaggtttccaccacaaaattgttttcaggatagaaaatatgcttgagacacacaatattgacagttggagaaaaggaaaatttagtgccatgattctgaggtttgcagattaccagtcccacgtgtttcaattcctgaacgtatttcttcaacagtcattacactatcttccagcccattatcctttacctacaaacacagggtagagagaaatattatgacacaatgaagacaatgccactatgtattgttcacaaataattaatagatagcgcctaaacaaatgccgaatataaaacaatcgtacaaaatttaatatgtagttagcccaatcttgtatccgcaaccaaagaatgaggcacttcttatgacctttgtccatccattctgcacgtcctgcatgcagtttcaacatagatttaagaaggtgcagagcatcaaacaaatgattttgtaatgcacagaattactatagctgtgataaaagataagagatttaatggtaaaatggaccttcataaacaagagcagcaaggaatacttcctttgcttcatggctaagagatcctgcagaagagaacaatttatgtgaattcagtgcaacaggtaagagtgtaacgagctaatcaagtacaattattttgttcttatgtactcaaagcctccatagccctttgagtgcattgcagtcatgcctcgttgctgagtttttttttttttaacgaaccaaacagtttgatgattagctactgcgacacatttttttttatgaataacagaagaaactagtatgtaagattaagataggtaaatcttactctcgatctttggattggagaacaatgggaaatcttcttctagggagattatatatagcttttgacttctacaataatcaagtatcagatctttccacagctgcacttgcttttcacgtgtttctcgcacaggctgcaatctgagagacacaaattgtcatgctaccaatctcagttgtgttgtttgaccgaattgttaaagaaagttttaacagaagtcagaggtttttctgtagaataatccaaaagattgtggttgtgaatatcataaaatgcaagaagatgaaagcaagaaaatggttcaactgatacaaacctgttgaaacacaagatataccaggtatccagatcttaacatatataatgaaatttaattataaagccaagacataagatatctacatctagtgccaacaagataagaacataagcatacacttgcaagatatcaaatccaattatcaagtactgccgttctaagtagaagtgttccatgcagtgtgacattgtgaacatacacttgggcaaaggcatacttagaatcaaaaggtgcatattgtgttcttcacttgcaacaagttagttgttaacttgttaagttctagaaattttcattacaccttattgataaggtggtctcaagaatcactataaaacgcgttcgcgaaaaagaatcactataaaacaggggacgatctgccctcagcagagatgaataaagctaacaaaatttagagttgctagctaagtagttaactcacaagatcatatcgtacggtaccctaaatactgatgttacgattccgtaagcaactctgggagccaaacaagccagtcacttgtaggccctaaaaactggaaattccggcgatgccaaggaccactagtaagcaaagatcctaaccaattaaccgaatcaacatcccacggtcacctcttcctcctaaagaccgcaaattcacagatcacactgtacaaacatctgtactgaacctattgtcaccacgggaagagctttgggtccctctgtaaaactgaaagctggggaggaaaagttacgggggagagcgagagcaacgagggggggggggggaggggggagggattacttgaagttaggcgggtagttgaagaagggcgggagcctgaaatcccccagcctctgcatctcctccggcacggcgccccgctgagcaaccccacggatcaggaggggggaacgcgagcgctgggcggctgcctcgcggctaaccggcgccttcgtccaaggcgagcgccggtcgagtgctccctgcgcgtgcggcgccgtcgggccggcggctcgccgagcgacgggcagcggccgaggtgaggaggaggaggaggaggaagaagaagaagtcgcgacgtcgccgtgtcgccgactcgccgtgcgagatctcctcgcgcggtgggccggcggctgggagggagttactacttgggcttttttctgtggactaagcccatctaaaacttacgttgggcccgcggctctcaagccggccgagctgttggtttgccgttgttcgcgtccaacggcgcgcgcgccggcgtcggttgaggtgcgtcagctgaattcgccgggcacgttacgacgtttggccggaggcgtgcaaccgtgccaccgcgtcaagtggttggctggtggccggcgcacctaaccgcgcgcaaagtagaaagacagtatgggttgcgaaagagcacgtaatctagtcattgcagtgacctaggtagcatcatgaaatattagagttcgaatcttcctacgagtgaattttaggttggtttatttgtggagctaagtttccaatttaaaagactgtatatatccggttgggtctctaggtcgggtaaaaaatacatttttctaaaataaaagaaagatagtatagatagaatggctggattgatgagaaaatgatctcaacagaacctagtagaaagatagtatggataaaatggctggattgatgagaaaatgatctcagcagaacctagtagagaagaaaaaggaagaaagaaagatggtgcctctggtaaccaataggcgaggatgatgacattgattagtgacatctgtgctgaagaaataagagcagtaatttttttttgagaccaaaataagagcagtaattgacaagctagtgtgagaagtggatggcagccatgtgtcttgcagttgcaggttggatttgatcaaatggaagtcaaacatatggcgatgcttacacacgacttttcaggcgatctgttgcatgcactcacactgccgaggagtaaatcaaacatcggactagtttgcatttgttctataaacaaaatagtatagtagcaggggcgtatatatcgttggggcttgtcagggctcaagccccagctctgccgccaaatctatcatcccttgcaacatagtacagtactgatagccaatgagaatggtgaaaacttaaaaagctgtgagtactaattagctagaatatatgccagattgcttcttactagtagtttgataattctatcacataatcgatcccaatttgttaacgttgagattaccagtttactaattttggttgatttttcattgtaatgttcaaaaacctctaaagtaatagataattcggaaatttggttatacggttaaacttttgatatggccatgcgcagcacaaatagttttaaatcatactttggttaaacaatgcatatttcttttgttttatttatgtattaattaattgagttagaaaagtgataagcatatgtatatttacttttgccgctaagataatttctattatgtgagcacacccttaatttgtatcctaaattcaccactgtacagtagaacacactagcctatatatctccctctcgagtgcagcgtgagttgacgcgccaaggcctactagcaacagagctgcaagcagagtggcagtgtgagtcgtaccgagagttgaagcacacatagccatctctctcgttgtttctccacgtaagctttttgtagcactagctttctagttgcaacgatggggttcatcagcggcgaggagctcgccgtgacgctggcgccggtggccgtgtactggctctactcggggatctacgaggcgttggggagcgtcagggctctggacaggtacaggctgcactcgaggagggacgaggagagcaataacatggcgtccaagaaggaggtggtgaagggcgtgctgctgcagcaggccatccaggtcgccatctcacttgccgtgctcaaggtttgtcgtctcacaaccctcgacgttcagctagctagcttttgattgttgagtgatctttgtttggaacctcctgctgtagatggaaaatattactgtgtttatccataatgcagagagcaagaaaaaaaaaaaagcaaatccgtcgcattatggacgtgacggcatactggtacaccactgagtacagtcgctagctctagcggtttctaccccacatcagtaggtgatacggctgcattgtttaagaagaaccccctgattcacccatatcggcatatctgcagactgcagtgcctagcttcttccggcaagaagatgaacaacaacagtgcaacactaactttgcatcaccctgcactcctgctgacaaaacgcattaatcgatcaagagtaaccttggcccttaaactacactacaggttctgtacacgcgtgcgcacggtggagcagagcacagctcgtgatacgtgatagttacaaggctgcctagttacaactggttgattgatcttgtctttcttttatcgatcttacgcagctgacaagtgagaaagacggtggcgccggcgacgtcaaggccggtcacgcgagcgccccggcagcggcgccatcgtcgtcgtcggcggcggcggcgctactggacgtggcggcgcggttcggggtggccatgttcgtgctggacgcgtggcagtacttcgcgcaccggctgatgcactcgagccggtacatgtaccgtcggttccactcgtggcaccaccgcgtcgtggccccctacgcgttcgcggcgcagtacggccaccccgtggacggcgtgctcacggaggcgctctccggcgccgccgcgtacctcgcctcgggcctgcccccccgcgccgcggccttcttcctcgcgttcgccaccgtcaaggggatcgacgaccactgcggcctcctggtgccctggaacccgctgcacgccgcgttcgccaacaacacggcctaccacgacgtgcaccaccagctcagcggcggccggcgcaacttctcgcagccgttcttcgtggtctgggaccgtctgctcggcacgcacgccggctacaccgtcaccgcgcgggagaggaacaacggcggcggcctcgaggccaagccgatctgcaacgatcgccacgttctcctgtaatgtcaacctgtttttgctgagactttgtttgtagctaccagccgtagtgtccgtcacgttgctgtgtacaaaagaaggtcttcacggcaaatactttttcagaaaactcaagtgaagtcttgtcacaacaactttgcatctgaatatatagtagtatctgacaaatgacacgggtagactgatcagcaacaggctgatcaagacgacggacctagctagcgcccccatgttgtacaatgaaaaacgtagtacacactcccatgtacaaggaaaaacgtagtacatgattttcgatttagggggggcaaaactaagcatctgaatatagctactggaacgcattataggaacactggagctagctacaagggtagtccagatggtcgctgcagttggtggaagcgacggcggacagctccagcttccccgtccactcctcgcctggcttcagcgtgatggctcgctcgactgcggcagcgtccacacacagcatctgcttgtactcctcgtcgccaaaatccgccatcgttttcgacttcttgtcccatgggttccaaacaactgatagccaagatagagagcatgaaacccattgtttatttatgattaccaggacagaaagtaatttttcatccatccggcttaacaatgctaaaactggtttggagtggtacatgaaggaaatcatcttaccgacgtcaggaagcccttctttccttacaatgaaggtgcgtttcttctcatggtcaagcacagcaattacgcttggggaaccaacgtagactctgtcaacctgtaaacatggttactttttatgaatcagtaaatctgttgtcatgcgcatcattttggtgcagaagttcacaacacacaactgaggatgaaaggactgaccaaattcagattcaagatcattagctatttagtgttcaaatgcaagcacgcggtataggcaggcttgctatagtataccgacaaaatgcaacacccatctctaccaaagaaatgtaagacctataaagttggagtaagtacacaaacatataaatagtgaaaatttacctcagactcaaatgttatagcatctccttgttctgtaaaacgttctctttggctaaggttgtcaagataatcaagtgtctccagaccttctattctcacctcactgcaatgagaaaggtgcagcacaccatcttatgcacattgttcatcagaaaatcacaaaaccccaaatgttctattgattgtgaaagcatgagatgtacagcttcaatggatgacaggaaatgttatgctacattatctaaaaaaaaggaaatgctaattgcttatggcataaatatgtactataccttaagctattattatattctactgagaaggaataatatttgtaactcgaaagagtgtatagcatcagcggtaagcacataacatgaaattcagtgagcaacaagatttatttgctcaaacaatgccttacctgatgtcagagactgaaagatatgtatggtaagcaaacgaaaaactgaatggcttcccattaacattcctgactcgtgatactaacgagagatctccatccgtcgaaagagaaactctgagacggaattcaaagctggaattcacattataataagtatatcagacaaatgacaaatcttccggaatgaatatgcagatatcaaaatgctcaatgaaactactaaagcattccatccactatacgcttgaaatagttcagatttacagtttcaaatctcatcaaacagaacatctgcctaaccctaaactcttttttattaatccttgaaagttcatctatcatatttataaaatatatcacagaattaatgtaatatagctcgaggttgaagtattgagcttattgcacacagaacatccctgtccacatcaataacaggtgtacactatttagacttaagatttccttggtaataaaaatatatatttggtataatatttactttggtactaaaaaacctttggtctgaagcaatataatatttagtttgtccaatgtttctgatccaaaaagtagtttctctcatttctacccagttgctatattcaacagaatcagtctattctgatgaatagtcatttagaaatttttataccgaaggcccatagaagtacttattactttatggcctgagctatttaaccaaccacctccctgacacactagctaaccagaattggacattttactcacctagctgtaacagacaaactactcaaggacagttaaatatatatgtccccagaataagttatcataccagtgtggccaacatttgagatcatcttcagatggctttaacagaaggtcaacagaaactttgccgttgttatcattatgatttagtggtggagcctcatcatctatggcccatagcctgttccttgcaaatccatgctgctccaatgttccacaatttccaaactgacaaagttttacagttaaaaacgttcattttttcaccagttcagaagtaaaattgcatcccctcaagggatgaaaatccatctcccaaactggtgcagatgtgcacttttcactgcaaacatatagggaatattgcagtacctgtggaaagcatatgggaattccacctcgcatcgcttttggtggcttgaagatagcctgtatgtacacacaatagctatcaaaaatcttaaaactaactgaaagcacgcaaattataatgtgttattatatctacttttctagcacacaaatatttcagaaacaaaggagaatccaaggccttaagcaggtaattcagaggtagagaaaaaagaaaaccaaatttgagcctgtaatttaccatcctaaattaataatagattagtctctcctttcaaaaaaaataaataaataatagattagtctcatactctcattatacagtatgccccaaagaaaggcttctactgttttaaaaaaaagtctacctttcttttacccaatcacaaacagacgaatttcagttcacatgcatgtctatcagagaaatttcagcacaaggacgttgctccagcataaattgcatcaactaagcgcaaaaaaaaaaaaggaacacgcacattccggctgcaattatgcaagtacttcgtatatccacaagagagaaacctgatgaaaccaaacccttccccaaccacatcgcacgaatccgatcatcagttgcagaaacaaccacattgccaggaaacagaggcaggatcggtacgcagaggcctcaccttgctgctggtgaagaggagctcctcgccgcggtcgttcctccaggagacgacctgcccgccgtgcaggctgacctacaaccaccgcatcaacccaagggacccgcatcagagtagcgcgtgcgcaggagataaaatgccggcgagctaatctaatcgccagccagaaacccgcaaaaagaagagtgaaaatttgcgcggcgactcaccaggacggacgccccccgcggcgaccggatcatgacctggtcggcgccgttccagtccttggtcacctcgaaccccggcctctgctcggagtaatgccccatgctcatcaaccaatggcaggagcgagagagcacacgaacccaccccacacgatcgtcgcaagaacttcgctggcgcgcacgaacgcacgcacgcaacccacaagactacgacgacgacaaccaccacttgtaccactactactaccccctcccctagtaccggcctcaccaatacatcgcgcaaagcaacgccaccgccaccgccccccagagggtcgccattagaacagttcggatgtctacggctcccccaacacttcccttgcgagcaaaagcaaaccaccccctgaatctcgtgaccgcaaagcgccacggcttttctctcctctgtcctagcttagttagccttttttttttcccgctgctgctgctgctgcgcgttgcgcgcgcactcaccaaccacccgggcccgcccgcgcgccgggctcccctactcctaccacgctacgacgacgcccgcaaggcaagaaagcaggatacggcgagctgcagccgggagggggagaaatggaaaatgcggcgtggatctctacgtttttttctctctctccgtctctcggtctcggaaaagcggcgtggcgcgcgggtcacatggcgaggcggcgagagcgcatcatgggagccacctcggcaacgccatgggtacgtggggcgggggacccgcggcccggggggcgggggaatccaagaaaggccacgggggaacagctggaatccgagaagaagcggatggagcgaatgcgaatcaggtggcgcgcgggcgggcgggcggcgtgcggggcggaaacccatatgcgtcgctcacccgcagcgccgacccggctcgctcgctcgcctccagacgaggagcgaagccagcgagaccagctgctggggacagcgtcgcaacggaatccgagaggcgcggacacgtgcaccggcgggcgccacctcgatcaagtgggaacaggcgtgtgcagacatcggccgaccgcttaacattttcgctctgtacacgcatatgacgatatgattagtactgttttttcctatatgatatactacaaatgaattgtttctttatattttagaaaaattagatctaagttcttacgttttgaaacggatagagtagtttacactactttaataggtttaaaagtatatatctgtattttactagttttttttttgaacacgtaaaaaaattacacgtcaatatattagaagaaaagaataattgttacacaatacattaagccagaccgacttatgctaagagaggagggaaatagaagaccaaagaaaaaaaagactcggatactacgacactaaacatcgggaagggggtgtattttactagttcatagccctctatatcatctgcatacaagatacaacttcaagaaacattggagcattttactcatgttgcatcaatcagtttatttaaaaagagtaccaattttatacttttcataatatgtacgatataattttattttaatttatttttcataaagcaatgcgagtgtcaacatgggctataaaggtgctagatttgaccagatcaccagagacggcaaggatagcaatttgtggtgaggatgcaatgctcaacaaggcgtgttttgtcagtggcaccaagcatgacctcgacggtggccaggggcaatatgcggccaaggacaacgaatgtgtcagaaacttgaaggatatgtagtaatctcatagggcatcgatggatcttcaagatggtccggaccacccaaaaatgtgtcggcccaagacatgcataggtaggtatggtaaaaagaaaactaaagttgaagtgacgtcaattcgtttctgctccttctttgtgaccgcggctccgcctcatgcccatctcgtacaattgagcgacgatctatcgtacccatgactagggttagggctcctacctcttggtttgctcggctactcctttcctggtttcctatttacacgttcccgccgcctagcctatagtgatcaagtgacgacagcaaggcagcaagggcgggacgcgagtgcgccggccggtgacggcacggtgtcacagtgtgcagggacacatcaagaaagaaaggcaagtggccaaggggtaagtgattattgattagctgaataggtcttctagacttgtactcttcttttcaattttttactttggattcttctcatctcaaaatgtacttattgtattacggattgttaagacgtgaagaaagatgaaaatattacatctttctttagtaatatggaacatagaagaatgcttcttgattgcctcccacagttatatcagaagaataaactcagaaataagatgatggggtaaccttcttcaaacttttgtagccgtataagcttcttcaagtcaaatttcttacttaacgttaattttaagatgtttgtaagatgatagtaatatatcatgatgcatttttggccaattctattagatatacatgattgtatatgttggcatagttatatttgtgatgtttaatttttttctatcaatcggacc

SEQ ID NO: 20527 - DNA, 3092 bp, Oryza sativa
  unsure (1)..(3092): unsure at all n locations
tgcaaaaggagattactggattttccgtcaccttaaatattcacatgtttcaacctatatgtttgggtttcgagggttaggaggtgatgaaggtagtaggaagtaacaagggtggctttagaggatggcctaggacgtggtggacacaagtagacaacaaagtgaagccatgagtttggagaagggtagtagcaggggcatcatatctacaaaaggttaggaggcagagacgtctccacggcatgaactttatgttgctaagacaacgaagaacaacaggggctagggcaccttgccacttattagcttcaagagaaaggcgcctgggggggaggggtaagtcgagatcggtttggtaggcctcgctggtgccatttgcaggctcttgcactagctaggcagaaggaggcgatgcatgtggggaagagacaatggattacaagggaaaatgtgattacgtcgatcgacaacaatataggaaaataaggagatacagttagagaaacatgtgttacatgaatcttaaaatatcttcctatctaaaattggatgaatttaaaataggtatataaacattggacattctctagatttaatcattctcaaatgttggactgccgttttctttttactaatggaaatggcctactgtggtgtttgaatcttctgaagatgaagataaagattaagtatttcacgcaaaacgaggtggtaataatatgtgattaattgagttttaattattacaaacttgaaaaatgggttaatatgatattttaaaacaattttcatatagaaagttttcgcacgaaacacaccgtttagtcgtttgaaaagcgtgccacgagtatacaaaatttaatcctttacttgcagaagaaatgaacatggcctttggccaagatacataatagtggtattgttgcgctccttatgccctatttaattcagcttaggattattataatctggattattaggagtaagctgaaacaaacaagtaaattattatgctagattattataatctataagtcagattattataatctaataatctcctctagagaagctttttctagattattgagtggctaaagacccagtacccttagatgcctctaataatccagagaaacaaacaactcgtagtttattttatatcagcttattataatccagcttagagtaatctgatttaataatctagattacaataattttaagctgaaacaaacatggctttaatcacttctgtattaagagatgaaagctgtattaacaattttccactcgtacgtggcgtgcgcctgcctgtttgcccattgccatgagcccttgaggccttgacaggtgaaaattggttagcatgttcggactctgggtcgtggtggtgagctagcggccgacccgtttgcagcaattggatgcatcgatattaccaattcagtcaagggtcacgcgggtgctagtcgagtcaaaagaaagccggcctaataccgtgcagggcccaagctaacagcacagcactggaccatgcgtcaatccaaccacgcagtcagatcagctcatcagcaccgtacaagtacgacctcaccaaaaccatcacgaaattcacgcacctctctctcgagcctgaatttgctggcacaaaccatggcacttgagtcactctgccatactgataccgttttaaacgtaggagtagttagaatgcccaagttgtttcaagcctgaatttgctgtcacagtgttgtctcacacatgcccatagtcatggcaacagcatggcggatgtttgggaggtgcaggagcagcaaccggagattcccttgcctctgttctcgctttcaacggagtacagcgcttccgtcgacaagacgaatggcataggacgccggcgagtaattgcccaccggccaccgcatagtgatcatcgctgatgcaaccgtgtgatcttatcgatcatcaatagagagccgtatcaacagaaagccgtaaagaacatgtcgtacgccaaggacagaagcgaacaaccaccggtgttgatcgcatcggctacaatgttatgtgtcgaactaaccaaagaaaaagacgacgtttacacccgtaggagagaaaaatggatcatccaaaagcaggtaaaggtaaaagatcaaagttagaaggctttctgtcagtgttacagtatttacagagatcagtttgatatgaacaacgcgagccagcactgatgttacagatctacgagagtagagtaaaaactcagggaagaactgacggccaggggggcattcatatcccggtggagcggttggaatgctcgtctaaaaggcagctactagtaatttacaagggcgaatacagtgacaaaatcgtacctaatacttcgatgttaatcgtgcgggcaggttgagcttataaaattcaccaggccacatgctgcgtttgagcacgaacggcgggagggtcaagtcgttaagattaccttgcggctacagcatcagtcgccagaccagagcccaggagttgacgaagcttgggcgtggcaatggcatgatccatgtgcccgctgcttctcggcgtgccagtcttgtctatcattgacaggaaattttcgacgcctcgagcttgctgtgcttttgttttgactggaggcacttcttgtgcttcatcaggcccggtttccgttagtttctcctgttaaacaaggcgcatttgagagaagaaaaaaaaggactagtgctcaatgaaaatagctccaatactccaatgatcatattgttagaaaagatgtttaccattagagcagaattctctaatctaagtttcttggagctttccgttagcctgcttatttcacgtctaagggatgtgttctccgcagtcaatagctcaacttttctagccagttcctcagtctcggcctgttagaatgaaagaatatcattattgtacaagtatggtttaaatttctactagagtatggaatactgaaggggataccacaaaacattacaactagctaagnnnnnnnnnnnnnnnnnnnnnnnnnnnnnnnnnnnnnnnnnnnnnnnnnnnnnnnnnnnnnn

SEQ ID NO: 20528 - DNA, 1018 bp, Oryza sativa
cagcatcagtcgccagaccagagcccaggagttgacgaagcttgggcgtggcaatggcatgatccatgtgcccgctgcttctcggcgtgccagtcttgtctatcattgacaggaaattttggacgcctcgagcttgctgtgcttttgttttgactggaggcacttcttgtgcttcatcaggcccggtttccgttagtttctcctgttaaacaaggcgcatttgagagaagaaaaaaaaggactagtgctcaatgaaaatagctccaatactccaatgatcatattgttagaaaagatgtttaccattagagcagaattctctaatctaagtttcttggagctttccgttagcctgcttatttcacgtctaagggatgtgttctccgcagtcaatagctcaacttttctagccagttcctcagtctcggcctgttagaatgaaagaatatcattattgtacaagtatggtttaaatttctactagagtatggaatactgaaggggataccacaaaacattacaagttaaaactagctaagcatcttattatacctgcttcctcaaccttgacctccgagcagactccctgtttgattgcttccttctctcgcgcttcgattccttatcatcctgacaatttattaaggattataggtctatagtttaattcaagaagaaacgatcccatgaatcgaaagctgaaaattcctgatctcaagagtgaatctcattttttattgagtatctaggtactttgcatttaggtgtcctgacagtggtgtttggtgaggtgttttgttgctatctcagggtgtccttctgggacgggtcttgttctgtttctctctggaatgaatgtgtagttcttttttaaaagaaaaagaatgcaaagagctccagcaatctatttagcaaaaccatactagcgactcgagaattaatcccaaaaaataacagcagtaataaataagggatgttgtattctcaaaaaaaaaaggatgttctactgaagtcgtgg

SEQ ID NO: 20529 - DNA, 1959 bp, Oryza sativa
ctgaagtcactagcagtgctcacgtctggtttgattgctgtaaccggaatgcatagatttggcaaagctgcttgttcgctaggtctatcattaggtgttaaagctccaccagtttccacgcctggagaaaaggaaaaacaaaaaccaaatcacctcttagtgttgcttagtgctcagaatatatggccttcttatcatctgaaaacttaaacagaggattatattatgtttcagttatcaattagagaaataacaagaaatgccgcaaaattcacgatgagtcattgaactggatattataaaaatcaagtaccagatgataccaagattgagtacctgatttaggcctatcatctatgctccttttcttgggagttccacttgcctgaataatgatgaaatatatcagcatgttaagtataagcttgctggctcagaacatcttcaatggcattaaataactacagaacaataccttctggttgtttccatcactggatccttctaagctgcaatctccactgcattggcagcatcagatgcacatgaaatcagtttgtcactcataatagttgtatataagttgaactatcaatctggttatcgttttcattttgtaaaatcctgtatcaccttgttttttcactgttgccactgccagttgacacagccgcaccatcaatttccttcattttcttatttgaacagctatccttgctgttgacagactttgctggctccatgctcaatgggctcaccatcttgataaaaaatataagataaacaatcaataacagaagcataattaagatactagcaaaacgattagcaattcagcacagaacgttcacacaagtgaagcaagaaagacattaaagaaaagaacaattgaacaaatgatttaaaaatacatatatacttccacagaagaaaaaaaataaaaaatccagcttccttctacagaaaaaatggcaatatatgaatgcatttattttcatgtagagataattcgtctgcaaggataggttttccaagttccaactacatatcatgaatacttcgaacggcagaaatcattcgtgttagttctgctcatagagaagtttccatgttaacatggctttatgcaagcattttaacaaattggatatcgctttaattccaaagcgtgatagttgactcaaatccatggtgccttccatgtttagttaaatgcaatgttttgaaaaatagataggtgaacaaaatgaaatgcttactaggggcatgaacggatgtgaaaaagctccaccaggaggataaattgcggcatatggcttcccaaaagcggatggcaccagaggctgtagaggcacagggaaataacttagaactcttaaagataagaatgacacctgatacatggagagtaaagtcaaaaacctgaggacccaagataaatggaggaggggtatgaccagcggctattccagggctaaaaaatgttggtggcaagatccctgggccgtaatatgcctgtgttgattatgataccttaaatttagttactcagttcaaaggaaaatccaaacttcagttatcaggaaaatatagattgtcagacacctaacctgcatatttgaccaatcaaggtatggactaaaggctggatgatcctgcaaagtaatacagttgctacttaggcacctttaaggattccaccccttgtcaataatgtggctaattgacaaaatcatgcttcgcagctgtttgatgcagccctaagcacatctaaaacctcaaagcggatttatgttgtcaaataaaagaagaaatgccaataatcaatttgacatcttgctcgtgcaatgttgtctgtgcccatatttggccttggttatctacttatatgcgtttaccttagggggcgatggtgctttccccatcttctgagtaactacagcttcgtcatttcccatg

SEQ ID NO: 20530 - DNA, 752 bp, Oryza sativa
  unsure (1)..(752): unsure at all n locations
nnnnnnnnnnnnnnnnnnnnnnnnnnnnnnnnnnnnnnnnnnnntgggcttttttctgtggactaagcccatctaaaacttacgttgggcccgcggctctcaggccggccgagctgttggtttgccgttgttcgcgtccaacggcgcgcgcgccggcgtcggttgaggtgcgtcagctgaattcgccgggcacgttacgacgtttggccggaggcgtgcaaccgtgccaccgcgtcaggtggttggctggtggccggcgcacctaaccgcgcgcaaagtagaaagacagtatgggttgcgaaagagcacgtaatctagtcattgcagtgacctaggtagcatcatgaaatattagagttcgaatcttcctacgagtgaattttaggttggtttatttgtggagctaagtttccaatttaaaagactgtatatatccggttgggtctctaggtcgggtaaaaaatacatttttctaaaataaaagaaagatagtatagatagaatggctggattgatgagaaaatgatctcaacagaacctagtagaaagatagtatggataaaatggctggattgatgagaaaatgatctcagcagaacctagtagagaagaaaaaggaagaaagaaagatggtgcctctggtaaccaataggcgaggatgatgacattgattagtgacatctgtgctgaagaaataagagcagtaatttttttttgagaccaaaataagagcagtaattgacaagctagtg

SEQ ID NO: 20531 - DNA, 1070 bp, Oryza sativa
catccatacagtccaacgtatttggaagagagcaaagatttgccatgaacagggaatagcagtgaatgttgatcaaggaagcatggaaactctgggcgcaagaaggtcgaaatagacttgtcagttattgcagctattccattgcatcaaaggagaaatattcggtcactagcacaagcccttggtgttcccaaaagcacattacataggtggttcaaagaagggctgatacgacgtcactctaactcgctaaagccttatttgaaggaagcaaataaaaaggaaaggctgcagtggtgtgtttctatgctagatccgcacacattgccaaacaaccccaagtttattgaaatggaaaatattatccacatagatgagaaatggttcaatgcatcaaagaaggagaagactttctacctgtatccggatgaagaggagccatatttcacagtgcacaacaagaacgccattgataaagtaatgttcttatcagcagttgcgaaaccaaggtatgatgatgagggtaattgcacttttgatggaaagataggcatttggccttttactaggaaggtaaaatatccttcttattacaaatgttgttaatgtacatttctttctgatattcatgggcaaacataactaatttcatatactaacaggaaccagcccgaaggagaagtcgtaatagagaaaggggaacactagtaaccaagccaataaaggttgatagagacaccataagatcattcatgatctctaaagtgctgccagctattagagcatgttggcctcgagaagatgcaagaaaaaccatatggattcagcaggataatgctagaactcatctacctatcgatgatgcacagtttggtgtggcagtagctcaatccggacttgatattcgcctcgtgaatcaacctcccaattccccggatatgaattgtctaggtcttggattctttgcttcacttccatccttaacacataataggatctctagaaacatggatgagctaatcgagaatgttcccaaggaatacccgtgactacaatcctaatacttttaa

SEQ ID NO: 20532 - DNA, 583 bp, Oryza sativa
ggaaggaaagggtaccacgtcaggagacacgtgtcggctcgtgatacacggggtaggcccgagcgcgggctgtttcgctacgaggcacccggttcgtgtacccacagagttgggtgcagtttcgttaacaaaatctgttattatacaggtaaacagattcacagatatgcgtcgatttagcaaatacttttttagtcgctatctctaaattgtaactgtgagaccttaataaaaaaatcacgcattctctcatatgtctatatttctttattcacttttaataattgtaatagttattatcatcgtcatcatcattattctccgagaaaaataaaatatcattgttagagtacatgaggatgacatgtgggccatcctatgaataatggcgttcgttgggtcccttgcggaagcgccggtgtagagtgggtgggtgagccgggcaacgtggcggatagtttaatttcttgagtcacgctgtcacccgttgcttccggcacacgtgtctctaccggagcggctctacgcgtccacccgcgcctcccacgagggccagctgggtagcctagtcatgtgggtgacg

SEQ ID NO: 20533 - DNA, 9879 bp, Oryza sativa
ccttaataaaaaaatcacgcattctctcatatgtctatatttctttattcacttttaataattgtaatagttattatcatcgtcatcatcattattctccgagaaaaataaaatatcattgttagagtacatgaggatgacatgtgggccatcctatgaataatggcgttcgttgggtcccttgcggaagcgccggtgtagagtgggtgggtgagccgggcaacgtggcggatagtttaatttcttgagtcacgctgtcacccgttgcttccggcacacgtgtctctaccggagcggctctacgcgtccacccgcgcctcccacgagggccagctgggtagcctagtcatgtgggtgacgtggtttgctgctccgccccctcctgggccccaccaacccgggggccgaaggttctcccctgcgtacacgcacgcaggaaagggttcggcgccgtggcatctcggtgatcagctgcatgcggatttggcttaactaaagtcagcagatctgctttatcagcacatagagtatagaattagtttttttttctatcgtttcattagcaatggttatagtatatttgataaaaattcacgggccggttcgtgacatagtcgtgggcggcaatttgcaaaaagtgtgctcttctagtgacaaatacgaactagtactcgtgttctgtgtgtagctaaaaatattactaactctagctactacgtgttccttagttttgatacacgtagatcgctagcacgagtggctggttgatcccgtgcttgatttcggtggcacacgctgcaaccaagctggaagtgcaacagatttcgagatcaccatctaacgtgcaattggagctcggagatgccgtgcacggcgcgccacgttgcacggtagctaggccctagctcgcgcgtgcgcgcagctgcagctgcgtcgcgatcgggttgccttctggccacgtagcccgctattcgcgtgcctgcgtgcgtgttgcccgtggggcccagaggtagcgtgcaaaaagattagagaagagccaacgacaaggcgccagatcgcggggcctccacattatcagcttatcctgtgccgtgcccgtctcaggatgggaatgggtaggacatggatcgagtctaaaccgttttaaataaaataagtttattgtactatggtttaatacggtcaatccattataagttcattagatcaatagattatctatgaatatataaatagatcatctacgctcctaatagataaaaaaagaagctcttattgcatgcttgtaaaacttgggcctgaaatttttagactcacattcacattataaaaacatatcaaatttagttgaattttatagagatgatttattatatggagaagcaactttgttcaaattttaagtcatttagacatacggggcccacgagcattactaagatttaaaaattctagttacatgcgtgtaaaactcgaacacaaaatttttaaactcacgttcacactataaaaacttgttaaatttagttgaattttataggaatgatttattatatagagaagcaactttgtacaaatttttaaaatatttatacatgtgaagttattttgggtcgaacctcttaaaccttaggttctaatgctttgagccatttgatccatttatattttttggaccgaccttaaaatccgttaggacaaatttacgaatagatttaatggataaatggatcgactctacccattcccatcctgatgcccgtctgaccggctatcatcgccggcgacacctaatcacctgccctgaaacggcggtatatactaattggtgaaggagacgtgatgctgcgccactccacggtggcacacttgaagattccgtaagaaggcagaggcaagatgcgatctgggctctttcatacttttatgtagactccctcctttccctttttatcagcgcctaaacaagatgaaactattctcatttagaaaagtaagaattaacctcgcgaactatcgcggtcgatcgaattaacctcttaacccgaaaaaccagacattgctcatcttgaactttcaataccggacgaattaccccctcaacccaatccagaatggttttgttctacgtagcctatgcgtggcaatctagttagccgttctcttttaaaaaaaataatgggacccacttatcatacctcctcttcacctattcctaatctctctctccctctctctctccccccttctctctctctctcggaagcacgtgcgcaagacgaggagggggaaccggtcagcgggctccggtcggtggcaagtagcggcgagcggtagggcacgagcggcggcagcgttttcgggaagaaaatggtcgacgatgggcggcgcttggcagtgcgataggcaacgatggcgtgcggcctagaggtggtggtatttgtggtcaacgacgagcgcttcagttctgtcgcgacaatggagccagcactggcgaccccgggggcaccctccttgagttcctccgctcccgcacctaattcaccaacgccaagcttcacgggtgtgctgctatcggtgtcggtcgcccgacgacatcttcactacctcccacctcctcctcgcctctccgccagatctggatgagacggtggatgccctccatgagctagcagagacgtcccccgagcaaactcgagctcctacgcacgggatcgacgagcccccgcctcaagcccacctcaccgttgctctgctgtcttcaacgccctcctcgccaatggcccaccatctccaacccctaccacgccatccccgtcgcgccccaccatatcctcccagctatcggccgtcgaccgcctactcgccatgctagggataggcgagctcgtgcagcccccttcctccccttccattcggactggacctcgccgccgacgctatgtcctcctctcgccgagaagcaaagaagggggacaatggggatatagaaaaaacaacgctgacaagcgggttccactggtttttatttatttttgctgaccgtatcgccacgtgtctgccacgtaggctgaaaaccactttgatttttgttagggggataattaacctggattcaaaagtttatggtgtcaaatatcccgtattgcagttatgggggtaattcaatcgacctccataattgagggggtaattcgttcttttttttttctttcatcaatgtataagcttgatggctgttcggttcatacactgattgtttgatctgcatgcagtaattgctttcacatgcatggtttggtagctctccagtttacatggccaattggttcgtatgcaaaggaacacagggacagtctttgcgccctggagtaaaatgggttacggggttatgcctcttttttttttatcttgttgtcagaactcaaaacaaaaatactgattatcagaagaaaatagagggagtatatagtttgtttttcaccgggacagccaataatacgttgtataatttttattagacatgtacaatgggatgtgaatgggatgtgagtgttgtaaataaaacaagacatgtttaattttcgctaaggtatatgagagagatcgaagagagagaatgaaactacttcctccattttaaaataagtatactcatctatatcatattggttttaaattaagtgtactattttgatacgaatagagcatataaggcatgttttttcagaaaaaagatttttttttagaaatgtaaatggttttttctggaatgtgggaccggtaagaacgggaggaggatatgactctcttttcatagtactagtaggagagagatttcaagaattaatgccatacaaaggataaaaatgggttattcgttggctcgaatagctatccaaacgacacccaggctaagcgttccaacatgtgcacaggaagtcagaaactactctaaaaaccaaccaccatacatgcattaggctgtgttcgcatgagctggataggaacttattccctccgcacggaaaacggagcggtccattagcgtgtgattaatgagagcagtccattagcgtgtgattaatactattaactcattaatcacatgctaatagaccgctctatttttcgtgcgggaaggattagttcccatccgttgaatccgaacacagccttagtttggatgcctgaagacctccatgccgccctcttctcatagaacacctccagtttagtgatgaagtttagtgatgttcatagagatagggtgtgcgtctatacattcacaggcgcgctatgagcacctacgtgtattctgtgattttttagaaaaatggttatgatagttgatgataataagtgaaattgggtttatgataattattcaatagtataaacgagatatataaatattataaagttgataagttgattttaaaaggttttgtagtaaataccgatgaagagtcctttctttcaaagtaattcacatcatttagaagtttataaaatatatccacgataatttataatctataaagaaattgaacaagcccattatcatggttggtaggttgtggaagctctgggtaaaagccttgctcaacctctagctattgcttgcatcgccgatgcctgcatgcgccagatccctatttggaggtgtcgtttagaagataatactctatattttggtgctcactgacttgtggtggtgcatgtttcgtttcttgtgggttttatgacttttgtcggttcccttataaataatcatgatgtcgtaaggtttttacccggtttaaaaataaaaaccatgctaactcccttggtctgaattttttaaaaaagaactcatgccttgcctaaaagtaaaaagaagaggatgcccaattaatcaacgatttcaacaaaaaaattatatttaattgaccgagaggatcttgcattttggtatagtacgaagctaacatctgtagtatcatttcttgttttaacatatagtaaaggccgtatttctttaaaaaatacttatcatccattcccacacacagcactaaagatgtatactagagtcaaaatggttaaatctagtaagaaatgattgtccggttttatgtactctagtcaagtcaaggggaaaaaaaaaggggagtgtttattttgccttgcctaataagcaattgcaacaataagacaaccgagaaaataggtacacgactcatccattttgcatggtgaatgcgagctacaaatagatagacactatgacctagttcatttcttgtaaagataaagattttaccttagtttttattatcacgctttttaaactattaaacgacttgttttgagtgaaaactttttatattaaagttgcttcaaaatattaaatgtatccatttttcaagtttgtaataattaaaacttaattaatcatatgctaatagctttttttttgcatgcccatatttaatctgaatctttataagattcgaacacaatctatgtttacaatgaatatggaaaggtacctgttcaaattcgtttggactaaactccatattatataacatccccaactatgctgtttttttaaaaagagggaatacctttttaccaatattttttctttttattatttaaataatcatgtccagattcgttaaactattgtgtctcatttttaactaggttgagttttttcttttacaaaaggagtacccttttacgaaccatatatatattttttctgtctcccttaatagagccttttattatctaaaggttatatccatgtacaacccatctcattatgaataaacataaatatgtatacacccttttgcagctcagtataacctgctattaataccaaagttgccaaacggaaatacttattctgcgaaattctttactaaaccacacctatcaaagatgttgtaacagtggcgctcaacttaacgaaaaaacagctgtcgacaaagccacagcgccacagacagcgaccgaaaacgagagagaaaagatcacggacccatggaccgcgtccacggaatgatcgacagggcagcggcaaccaagggcggcacgttgccccgcgcggctagaccgctagtagactagtcccacgactccccatccctcctccctctctcgaccactcccgtggactcctctcttcttcccttccctcccctcccccgcgcgcggtggtggttcgccggagcgcagcagcagcagcagcaaaaggccgcgagggccgccgtcgggatccccgccgccgccaagatgaacgacgccgatgtcgccaagcagatccagcagatggtgcggttcatccgccaggaggccgaggagaaggccagcgagatctccgtctccgccgaggaggtcagtacttacccctcccctcgcctcgcctctcccccgcgcgtcgaagcttcgggaagcctctcgatccgcgcctccgaagcttttcacccgcccgatctgcctggtgcccccccgtgatctcgaagcgtcgagagctagaagttgatacttgatcctaccttgtttccgaggatccgagcggtttgactgttaggtttcggtttctgggacgagaattttgtagtcgaagcgtctaggcaataggctccctggttccgaggtagatcgagaggaatcgggatccggggtgtgtcgcttgagcagatctcggtgcgtggatctagaagcttccagatcacgagtttctagtccaataaagctcgttttcttactttggactaggaagtactgccacactggatggtcaattgttccgtttccgcccttctctgctactggttagtccgtacctgaatccagttgtggcttgaattgcgataagagaggctagtctaatccaaaggtctctagatcattctagaagcgagatttgggcttaagatgaactgaaacttgaatagggtatgcttgatctgttcactctcccatttcgcttctagattgtgctagaagcacaattggaggataaggttaacaatgagaagacggaaagaggtactaatacatggttaaaggaaatccttgcaacaactggtcaccaccctccatcacctgccaacttatgagctgtagttatccattaccattaaccagccataaacttttttattccttttttttatgtcaatgcaatcataatggagataggatgcatgaacacctctattgcttgttggcatgatgggttggccatgatgaatgtcaagcaacatacttgctgagtgggctgctactgttatgatcatttttacttgctctagcttgtcatttcagctgaatacaactgatccacctgcatggtttgatcgatcaccccttggtgtgcatgattggcaatcatgtttgctaccaacaagcatcatcaattgtgcaatcatgtatcacgccttttactatcataaggtccagcggacatgaacatgtttaatatgctttctgactacaactgtgctggaagtatgatttattcttgaagcaacaggggcatcctcatgtttgtaataaaagaaagtttcattacaatgaggagtcgatcttctggaaatacatgcttgttttgtttgcgtgtccattcttttcaaccccaccttttatcaataccaatgactgacaacaggtacttgtttgacgagtcagttgttcagattttagtaggctgtttggctttagaaaccaaaccatccagtatgtcttgataaatcatgggatgatcccatgaattttcgtgggatgatcctttcctcacttctccactaagtgtgtttttgagggataggtgatgatggtcaaacccattccgttcctcaaagtaaacaagtcatataggactgagttgtcaattagctccttagttggctgtgtgcatccttatttgatgcaaggcagagttatacttccatcatccgaaaaaaaaggctcaattaaccatctcattcctcaaaccagataaaccactatgcctttatcattgctgacagttggttaaccattctgatttccttccatatgttaacttatttgtataatgtgtttgcaggagttcaatattgagaagcttcaacttgttgaagctgagaaaaagaagatcaggcaagaatatgaacggaaagagaagcaagtcgaagttagaaagaaaatgtgagacttcgattcctcaaattatttatgttttcctgtgttctccgtatggtcccattaacagcatttcatgttgaggatttctgcagcatacagtacattacatcaatgcctcaatacattttagatacagctggaatgctggattctcatttgtgtgcaacattagtagtaaaagctagctacaaactacttcagccacatggttaaattggcagtaatcgtaatttgactgcactggttgttgagacacttaaaaatcaaattcggatgtgtagttcagtgcagtaaacttcactgatgagtcgactgtattttattttttagacaaaattgtgtgaactgctgcttgcagttcaatgtctgttgaagtgagagtatgtatcaatcatgatctggatgtaataaaagttgtacattaacaatcttacgatggaaaaagttagagaactatttgacaaaatggtaatacaaagtacaaactgacataacatgcatactcaaacattgtttaccttccttgcgtattacatttaatatggtactgattgcttgttagcataggtttcatagaatccacctgtatcactatttctgggtttatccatttgttaactgatgaggccttgttttctcctttatcagtgagtactctatgcagctgaatgcttctcgcatcaaagtgcttcaagctcaggatgatttggttaattccatgaaagaggatgctacaaagcaactcctgcgtgtcagccacaaccaccatgaatacaagaaccttttgaaagaactcgtcgttcaggtttgtatgaaatgttgaatacatcatctgctagattcttatccattaagcctttttgagcgatccttctgataattgtggaccccaagagggtttcacctatatagttaagttcgatacgcagaactgaattattggatattgaagtgttaaatcacattgtagttttgcaactctaactgcatgcacaaaagagctagtgctaaaagaacatctgtttatgattcacctttaaacttctcttatggacgtgtcaatttaattgatggaattaagtttgaaatgccatctccttgtttgttcactactgttattaacaaaataatcattcatcatattgactggaaatacagggtttgcttcggttgaaagagccagcggtacttctccgttgccgcaaagaagaccatcatcatgtggaatctgtactgcattcagcaaagaatgaatatgcgtcaaaagcagaagttcatcacccagagatacttgttgaccacgatgtgtacctaccgccttctccaagctctcatgattcccatgagaggttttggtaataaatagtttcttacccttgcagcctgccaatttgctactgtatatctgtactactagtaacagtctagcaaatatactaaaagaaagaaagctatcttttggactaacagataatctgctcagtaactctacaaacatgtataatttggaaaataacatcaatatgagtatacaggtcggtcttgggcctgttaatcagaagtttagtgctgaagactttaactctaccctgacctggacaatcagctcttatctggctattgctttggcatacattatgacatttattgaacagttgatatgctgaatagtgtaatactgcactaggg

SEQ ID NO: 20534 - DNA, 2749 bp, Oryza sativa
ttagaaattggctctctattaaaaaaaataaatctaagattgaatgtggtgtaagtgttccgatttattatactaatttatatcacatttaattttagacatgtttttcaagggacggaaggagtacagtgcactggtgtacccaccaatctggcctccattgttaattcgctatgctgtggcaaatatggagttcatccatgacgcaagaatatggaatcttgtagtaacagcacctccacggctctactattgcctgacacagcgattggtggtttgttttgcgcgtatctgaacaggattagcatttggattaacagaaactaatctgaagctaggaacgctccacctgagctcctcgatctcgaccaatatcaaagtcttttcagtctgatggtcgtctctctctccatccctctctcttgactgattgatgctggttagattaatcgaagtgagacctgagagcgagcactattttattgttagaaaactatgggacaaattacttattttcagaccacggttcttcctctgcaagatttctattttattactgtttttgtgggcgtctgacattagttaattagtttcaagttgatacagattgcgtttgaccatctgcctatctaaagatacgaataaaacagaatcgatgaagatttgttgcgttcaacagttaaatatgcaataacatggattcagcaggttggttctgaccgattctattcatgtaggtgtgcgcatcttccgtgcagtgacttaaaaaaaaaacgtctactaatcgtggacgttgattgagagaaggatgatctagatcttttacgacaaacctagccgttgaaacgggaaatacatatgatacgaatccgtatcggaagtatgaccagggtataaaaacagtttggtcaggtttttcttttgttttctttagaacaagtttaatagtataggtcactactaactccaaatcatctataattaatgtaatagctaattcatataatatttgcttactatactattaatatctggtcccacctgtcatacacacattacgtcttggagtccgtgttgcagctggctacagatctgtagcccgttgctcatcgctcttcctttatctctttataatatgtttatagctggtttatagtatgctattgtacttgttcttatgcgacctactacttcgaacggttgatatcaaaatctcaatggtgtgctgcccacctgcaacagttagcgggtaaagtcactattcttaacaaacggaaagcgatctcagcgccgccatgatcttactaaagtacaacagtaagcaacagctgcaagctcgctactccgagtaataaagcagagtttgtgcggcacacgtgatcacttcgctcgccgtcgctccacacatccaccgacgtgcatgcagagcatggaatgcatcagagagcgccatggcagcttttgaacaaggcaattgttgcctactggagtactattagctagaatacgacccaccccacgcagcacctgcgctgcgatggttggatggagcgaatctggccgcccaccatgcaacccccccgtgcatggctggaagggcgcccatgtcacgcccagcttttctttaatctttcatcactggtctgctcaccatcacccttggcagctggcttgctaatggttccaaacaaatttatggtgttgtaaacaagtttaatggcgtacacttgttcgaactcctcgggaaagcatgcatggtggcggtgtgtgaggaggagagagagagagaggcaacaacaacgtacaacaacgggggcatcgaaccgtggagagcatggcatggggaggagtaaacaatctcgtgggggcagcatatataggaattgaaaagaggcagcatacataggaaaagaccaccaccacacggtccacacaccatacgtacccctcgtgcagcggtggaggaattttagccgagcgagagcatcgatccaactcgcgtggcgcagcatctgggcgcgcggggggagcgggagcggagggagattcgccttggcgctggcttaatttggcgctagctggcggtggtggtggcgccgcgcgcgcgggtggccatgggcggcggcgcgcggcaacggcagatgcgcgtcgggatcggcgcggcaacggccgcggggcggcacgtgttacaaaaccggccgtgcgcccgcggatcattggcacctgccaccccccctatcgaccgcgcgcgcgcaagatcggtcgatctatcggctgctttattagggttttctccgatcaggccgggagctatgcacgtgggacgccgtacttttccgcggtggcggtgttagaaatttttttaagtacagtcaaacctagctataacttttatttgctacaaaaatttcatcaccaatttattcaaaaatattaaaatctaatagagttttcgccggtgagactgggctaaccggagcggtggctctgcacatgcttttccgcttctacggtatagcggggacagacaggcgagttttttttttctcttttagaaaagctgaattgatgtcgatagttttataggggaaattttcgattaatagacaattatattggctctaagatcagtgcaaacagggatgaaaaaaaatcaaaacttacttgcgcttatgatggatcaaaaccgtgaccttgccttcctgctaggagtgcgctaacactgcactagtgatttttgtgatggaaa

SEQ ID NO: 20535 - DNA, 2257 bp, Oryza sativa
  unsure (1)..(2257): unsure at all n locations
tttctaataactagctgaatgtccatgctttatgatggataaaagaaattataatattatctaaagcttgtatataaaatatattttaaatgtgttactcgtgtttttccgtcttaatttgattttatacacgactatccattcatatatttaattgaggagtaaagataaagattcacaataatcacatgatgtttctgcagaatgtggaaaggcttatatgaaataagagaacgaagcacgcccatctacaggactatagatttggcagctgcggaaatggtatatgatttatgacagaagttgtacagctattgtctctgttcagctcattacgtttgttgaattctacgtttcaatgttgtgctaataaatttaagaccagatacatgtagatgcttgatttatttctcacactatacatatatacataagaggtttcttcatcctcgcatatgtatatattttcacactatttgcaagctagtaaaaaaattaagggtgtgtttagttcatgctaaaattgaaagtttggttgaaattggaacgatgtgaaggaaaagttggaagtttatgtgtgtagaaaagttttgatgtgataacaaaagttgaaagtttgaagaaaaaatttggaactaaactcggcctaaaccttgaggaaccgattaattagatgaagaaagtcgacaatgtcatctcaggacttctctaatacattgaaggaactaattaatagagagggatgcatacatacatacactaaatatctattcctgtttatatatatatatatatatatatatatatatatatatatatatatatatatatatatatatatatatatatatatatatataacaagaacaagtgtaaaagtgactttccgattatgttctcacttgtgatattagtttgtttacctttctttatgaagtgatatcgcttaaataacaaggatgtgcactctcaaaactggtttatacaattacagtacattccaagtatgctaatctcataatttgggatggagaggacggtagcgaagcttattgctgaagtcccaccctacaaggcttttgcagatgttgcacgtacggctctgtaatttttccttcttttttcccagccgtaacaggccgtacacatttcttttccttcatttataaaaagcctggataagatggttcgtcccacacacacacacacacacacacacacacacacaacaaaaaataattccacaccagcagaaactgggtcttctcgtggacaggcaaacagcaactacagctagcagtacatcttggactgtgttgaacacaatgtatgccctgcgacggtttacaatattgccataacgtaatcaccccgctctaaaaaaataataatcacgtaatcacttggtacttcgaatattaactaaaacacatgcgcttgaaatatgtatacttattatcatgaaaaaggatttaagtctcccattccagtaatttctgttcatacgttgtatcagctggtaatctggaatctcacattccagcgttacaggaatttcagttcatacgttatattcaaacgtttccaaattccaacacagaccggtagtcgtccttgactcctctcgccatttttcgagtatgcctttgagtcataactgcagcatactgatacgagaggatacattgacaaaatgaatttgtcagatgcctgatacacagagaatataattgtgatggagatgcaaaagaaaaatactacatgattgctaatttgatatatatgttccgggaaagccatccttaaccatatagtactagtatatgtcctctgggtttacatcctcctctgatgatgtatacaacagatcaatctcaatgtgtccaatgtgcatgcatgcatgtaagcaccactaatccttgaagttgcgtttaattccctacaacagatcctagagatagtagatccaatcactctttacacaaatataactcatcgatctctacccaaatagtaaattaaatataggtcttaatttatacaatagctagctagttacagaatgccgtaagagaattcattaacaaactgccaacttctgaattaactgacctgaagaatctgagtaacagaaagtcaatgtttagctggctagctgcccctgaaagtggatttcggcaatgatctcagtaaaaccttctannnnnnnnnnnnnnnnnnnnnnnnnnnnnnnnnnnnnnnnnnnnnnnnnnnnnnn

SEQ ID NO: 20536 - DNA, 8876 bp, Oryza sativa
taaccccgttgagctccgccttacctgcgcgccgccgacgcccaaccgcgccggtaccacctcccatcctgttctagcgccacctccaccgcgtcgagccaaccccaacccctgcgcatgaccgcgcagcgcctccccgtccgagggcgccacactggcccacgcctcgctgtgcagccgtcctcggttgaagaaagagcagggagaaagagagaaagaatgagagagaagataaggaagaataaagaaaaaaaattgaaggtaaaactatagttatacatgtgtttatctctccaatttattcggatataataaaataatctgacaagtgtccagcagctaattaccgattttctgtggtgtccttcaacaaattcatgtttttactgtgtctcttagctaattacacgtttttttatgtcccatagtaaatattgtctactatatatacacaccctctatcctcaagtgaatcagcttctgggggtaaatcagaagatgattcattttgtggagaagggagtaggtcgattttttcgacaacacgtaattagttttacttgtaacccccaaaagttagtgtatttaatccttttagagcccctgtgagaattaggcataggtgatctttgatcagcgtagggacatgcatatcttcctggttggtagctcgtttccaatcctagattctttagcaagttccaacaaaagcacatcattctaagcaaactcgtcgcgattcaaactactactactggttgtcaatattaatatatatgtgcgcgcccttaaaagtttatttatgttttctggttagacaaagaaataccgcgattcatgttattcgtacgagttatagtactttgctactcctatatccttttgaaagaaaaacacaggctgtatattgtgtaattgaagagacgatgatgattagatgtgcatgatgacgaagagcgtgtgcagagtacggagtggagtacttctagtaggagtacagtacgtgagagtagtatatactgtagtgtacgtgagagcaggtacactagcaggctataagccagctataaatatattttaaaaagataaagaaagaaagaagagcagcgagctacagatctgtagccagctacaacacggacttcaagatgtaatgtgtatgacaggtagaaccatatattaatagtatagttagtaactattgtatgaattaactattacattagctataaataattttaatctagtagtggactgtactattgaccttgctatgagagtactcctactaggagtagtatactgatcgtatttcagcagagcggaatcaaatcaatatgaatccaaagttcagaatagattttgtcggggagaaaagacagcgcaacatgagattcatgacaccgcggttcgcagctgtcttcattttctttgttgatatgataacctcctagctagagcatcaattttcacgacgttcatctcagtcactgtcgtttgaccgatcatatattctgttacaagtaatggatgcatttctattactccttccgtaccataatataagatattttaagtttttatttgcaatgtttaaccactcgtcttatttaattttttttaaaattattatttattttatttgtgacttattttattatccacagtactttaagcacaacttttcgttttttatatttgcaaaaaaaatttaaataggaagagtagttaaacattgtaaacaaaaactcaaaatacattatattgtgaaacagagggagtataaggtaagatacattataaaaatggtataaactactactatcaggtattagcatttttatatatggtgggtctcatctatcattttaattgtggtatgattcatgtttgaaagaaaattttagatgaatcccaacttattatctaacataaatacattatggtacgtgtctctctaaactactattactacttaatcaacaaggcttcgttttactatatgctacctccgtcttaagttagtggtcgctttaactttttcttacaacatttgaccattcattttatttagaaattagtgcaaatataaaaaagataagacatacttaaagtattttttaataataaagtaagtcaaaaaaaataattccatatttttgaataagacgaatggctaaaagttacaaataaaaactcaaaggacggagttagtagttttgtaataaatattaaagatactctgagattccaaagtccctgagggctgaaatggttcgatcttgacgggatatgggacctgaaatcaaacatgtgatcgtgatggacaggatttgcaatcgtaccagatcgaacagattgttcaagaaaaaccagagagagagagaaagagagaaagaaaagggagttcgaagtattccagtgacaataatattgctcagaagtacagtactactgtagaaattactcctctcttcattccaaaaatataaagaattgttggatgaatgtgacacattctaatatgtgtttagttcacgtcaaaattagaagtttgtttgaaattaaaacgatgtaacgaaaaaatgaaagtttatgtgtgtaggaaagttttgatgtgacagaaaagttaaaagtttgaagaaaaactttggacctaaactaggcctaagtttgattcggttagagggagtagtactcctaaatggcaacagcattataagttaccgtgatatgtaatgtccctgtcgctgataagattcgagcacttgacaatcaatttgtcccctaacctttctctgtaaaactgatggaccaccaaccattttgacaagcgcagcaagaaagaagaaaagctggtggaaatcataccaaacacgtactccagcttttcgcctttgtagcagttcaaagctttaaaatacaccaagctactccacattgctgcagctaggcgctttgcaacgagcctatctcgctgcaaacaagttccatgcaatgcaagttcccatgcagccacatgcacgtccatctacaggcaaagttcattgcatcggtagtgggctgtccccgtgaaaccctcaggcaacactacagctggttttgtccctagtctctacccttattttttttatctttccaaactttgattagctagagtagctctctactccttgccgacaacttcttcgaaatggtggcaatgcaatcacctgagcctgacatccgggacctttctttggacgatgcatggtccttgcaactatcggctactgtatgaccggattaagttttttcatgcgtgtatatggctgcattttgcacagagcccgcaactgctttcggagagatgatctagggcgttcacgtggaatatattcggcctttgttcggcaggataattatgtcatcaggatatagaatggcccaactggggtagtagtagagatgatgagaagatctgtctagggccttttcaacagcggagcatgtatatatggttgagttcagttacaaactttttcttcaaaattctaatttttttatcgcatcaaaactttcgtacaacataaactttcaatattttcatcacatcattttaatttcaaccaaacttttaattttgacgtgaactaaacacaccctacatcaaacactataaaaaaaaaagaaaatcgagacatcccatgcacgcaattgtctcaaattaccaggctattttcttcgcatattccggctcgcttcagaccttcagttaccacgaatctaaacagatgagcagaaccgcagatgctctgcactctgtagtacatatagtactatggatgcttagcggagaggcctgaactttggagcatttcttgtacacttggatcagttggggaagttactgaatcatataagcttgaacacacatgttcgacgtgttcaacaactggtgaccggttctattttatactgtactattattatattgcagaagtaacaggagtatgttttcttcccattcctagtagcttccttccctgataacacaaggactccacagttcacaccatgcgaacatgttccatgctgtcgactgcaacatcaaatcccacgatctgtttccaatactgtctacttactgtaagcaggtcatggcagtagacagccattgttggctctgtggtgcacaatagttgatggctacaaaacggctgcaatagtctcttgcgggaagtaaataaaatcccagctagctgtgacttgtaacactgcggtggatgatacaaaccagaggcatcaaggtaaagttatcacaagccacaacggtcaacatagcagcagaactgatggaattagatgaggatataaacgtagcactgaacccttcaaataaacgtatagcactgaagaggggagcgcatgcagccacatgtgatgtacttgagtttgttccaaggcatttcaatggacaggcagtgtattatttggtagtatagttggttttgaacttggcatcgccaatgtttacataaatggaacttcctctatacagtgtgtactgtgcaagatttttgcatttcctgtaatgaaaaatatatttcaactccgacctttgcacatatatagctagggcacccagctaaatttccagatcaaataaaaggattgttgcatatgtgcacgaacgccaacattctcgactatcacacacagaagaaatggcatatgtaaagtaactctaaacatgagaggtagaccaaagattaattaacatggtgcctaagataagtaatcgtggcctctgtaccgtaatataaaagattttctttcttttatttattttataatataaataattttggtgtactatttgtcacatccataaacactaattcaaatttctacctattttaaccaccaatatattatccaatcacccataaccaaatctcatttaatgtgtatattctagttttttcttgctatcattagtattataaaaaaagagaataatctcttatattatgggacaaaacgagtaataaaaaaccacatccaagcctaaaaattagtaaatctaagagaactatgtcatctagagagaaagtgaaacaaaaaaaaatcctaattaacacattccattacacataaatcttttcccttcagtcgtagcatcatataccagaaaagaaaccaatgggaacacacatagataatctgtaatgaattagaaaactacccattatcaaacaatatcattttggcaacgtcataccgaccaacaatcctctctaatctccacaatatcgttgttccgccaaatcatggttcaataaggtgctatatatctagacagtaaggtaggccacaacctggcccggtggcccctatctagcgcactactaacccctccgtcaattcatggttagtcttattgcccaactgtagcacccctctcaaactatgcccctccttcctccgtcactttagcctgatttaacttcttctccttatctgttatttccccttctcataggtgcccctacattgttcttcttctatcaccgccgaacggcccttaactgaggttttcttgattcccctattgcccgccattgggccgtcattgcactgacctccctctaaccacccccacgtcctacactagctttacctgtaaaatcttattgtcatgtttcgttgttgaaggaatcacgagagttaaaggagaagatgggtccagcgcataaatctgcaaagtccatcggatatatcactataagatttcttcatcagttttctcaattttctatcacaaagtagttaccaaattggtatgatattaacttatatcatgatatatattcggcggggatgtgtgaacccatctcccacatgcataggttgaaaaaatatccttgaatttactctcttttggaatacaagattctagaacaacgaaaataggaaaaactttagaacagaatgtgacactgtgaaatcctatggtattctaaaacatgtgaatactaaagtttgttcctatagatagttgtcaagaaataaatatatgaatttcaaaggaacttgcttgtgatagagacggaaactaaagagttaaaggaagagagttcacgaaggaaaataaaacatgaagtttgactcatgtgtatttttctatggaattgggttgggttggggttggggggggggcaaaggagggcaatttataggaattccaacatcctattcctttgcaataaagggttcaacaaaaaaattcccaaggatttgaatcctccataaagtccattaaaattccttcaatccaaaagagccccgcacgtcatatcactacagcatgcatgtttcctacattagtatgtactccctttgtttcatattaactgttatttcagcattatttttttgaaaaaatatttatcgttctcacatcccaaatcatttataggttgtgtaggttaccaacatctcctccctcgtttttcgcacgcacatttttaaaattgctaaatgttaacctttttttggcaaaaaaaaaacttctataggaaagttctcctaaaaatcatattaatatatctttcaagttttttagctaataattaattaatcattcgctaaaccacggctctattttgcatgctgtgagggaggggttcgcaatccctgcaatcgaacactgtctcagggaattcccaaccctatacctcatctagtttccatagctttaagtacattgtcatataagccaaaaggttgagttggcaatagagttaactaggagagagagagagagagaaaaaaaaaagatgaataaactatttcttatgcaggaaactagctctacacataaacaagaataaaaacaatgtgataaatagataaaaggagagaggagaggtgaacggatgaaaaattgttttgaagaaaccatccgttgagtatatagtttctacacgtagcgactatatgacatagcagatatagaaattacttgcagtttataggttggaattatctttcctacccatctttcatcaattaatacaatcatatattaataatcacacaactctcattcacttgtgtctcacgaaaaaataattatggtttacttatgaagttaacaatgtaatttaccatttcttcatggtttatgtagaaattttactgtaatgacaaggaatttgaattagaggaagtactaatagtaggttgtagtagtattaatttactcacgactcgtaatgacattttatttaggctaagttcgagcctgtttggtagagttttaactcttaaatttagctctaggagttgggtctgaagatgagttgtagagctgcctaaacccagcttcacctccttagtttattttgtgagagagttccacctaaatccactctcattttagatggaggtaaaactgtttggttgagctccaacttcagtagagatggagctggagttgtgcaaaacaggcccttcgttgcaatgtcctactacaccttaagcatgcagggagagattcctgtaggctacccgctaccatgtcaagaaacacgtcacgtgtggtaacgcgaaatctgccgctcgtacgtacttgagcccctgtagcctggcgcagcaggttagatggagtactacccgcgaacacgtcgacgtattctgccacaagcaatacacatgtacacacctgcacgcgcgaggacgtgcggtacagtaaacgcgcactgttcggcacgggccggtcgtacgcgtacgttgatcagtacgacgcgcgacggcctgcctctgactgatgatgaggtgacgggagccaaagcagcgtgcggtgcctgcggggcgcagcgctggcctcgccgcactggcaaatcaaaagggagcagcagtggcacgcgacgcagcgtgtcggccgatcgcctgcgtagtcccgggtggaaacgggtgttcgatctcccggtgcatcggccgtgaaggccgtggggggtggtatggtgggggaagaggaggaggagttgtcgactccagcggacaggggcgtgcaggtgcagatccgtagggtggcgatgggacgttggaagggacgggagctggcgctcgtgccgtgtggcgtgttgagtggctgggcagcgggcgggctcagctcacacgtcccatcgggtcgacgggtcgtgccgtgccgcggtaggctgcagcggatcgcaagccttggtgcatctcaatggatacgggacgccaggaggtggtaaatccgtgaaggagcagtgatagtgtttgagagatatttaactatttatcactcttacaactgatagttaagaatttattattggacccatatattatagattatgttgtaattcttaattttcacatcttaaaaataacaaacagttaaatgtctcagtatttgatttagttagttggaaattataataattaacctcagcgtacctcatatcttttggaaaaggtcaaatgggaaaacctttgcatgagaaaccttttagcagttttaccggagactcctgcttccggaaaagacggccaaaacataggatccgtctgctgaaatttttcactgtttgtgcaaagcactctgctagtaccaatgcgaggaacacgaacaccttgagaaaaagtaacgacattatgtaactagtctgcgttacaagtgaacagcactagagcagcatgccacctcccacttccagtaaaagttcgtcttgggacttggaggtcggggagatgcagccgttgaattttttttatttataattttttttattaaaagttttacaaaaataattttccattttgaaaattgacggaaatagtcgcctaccgccctctgggagggc

SEQ ID NO: 20537 - DNA, 1123 bp, Oryza sativa
  unsure (1)..(1123): unsure at all n locations
caatgtttctgatccaaaaagtagtttctctcatttctacccagttgctatattcaacagaatcagtctattctgatgaatagtcatttagaaatttttataccgaaggcccatagaagtacttattactttatggcctgagctatttaaccaaccacctccctgacacactagctaaccagaattggacattttactcacctagctgtaacagacaaactactcaaggacagttaaatatatatgtccccagaataagttatcataccagtgtggccaacatttgagatcatcttcagatggctttaacagaaggtcaacagaaactttgccgttgttatcattatgatttagtggtggagcctcatcatctatggcccatagcctgttccttgcaaatccatgctgctccaatgttccacaatttccaaactgacaaagttttacagttaaaaacgttcattttttcaccagttcagaagtaaaattgcatcccctcaagggatgaaaatccatctcccaaactggtgcagatgtgcacttttcactgcaaacatatagggaatattgcagtacctgtggaaagcatatgggaattccacctcgcatcgcttttggtggcttgaagatagcctgtatgtacacacaatagctatcaaaaatcttaaaactaactgaaagcacgcaaattataatgtgttattatatctacttttctagcacacaaatatttcagaaacaaaggagaatccaaggccttaagcaggtaattcagaggtagagaaaaaagaaaaccaaatttgagcctgtaatttaccatcctaaattaataatagattagtctctcctttcaaaaaaaataaataaataatagattagtctcatactctcattatacagtatgccccaaagaaaggcttctactgttttaaaaaaaagtctacctttcttttacccaatcacaaacagacgaatttcagttcacatgcatgtctatcagagaaatttcagcacaaggacgttgctccagcataaattgcatcaactaagcgcaaaaannnnnnnnnnnnnnnnnnnnnnnnnnnnnnnnnnnnnnnnnnnnnnnnnnnnnnnnnnnnnnnnn

SEQ ID NO: 20538 - DNA, 956 bp, Oryza sativa
tactgttattaacaaaataatcattcatcatattgactggaaatacagggtttgcttcggttgaaagagccagcggtacttctccgttgccgcaaagaagaccatcatcatgtggaatctgtactgcattcagcaaagaatgaatatgcgtcaaaagcagaagttcatcacccagagatacttgttgaccacgatgtgtacctaccgccttctccaagctctcatgattcccatgagaggttttggtaataaatagtttcttacccttgcagcctgccaatttgctactgtatatctgtactactagtaacagtctagcaaatatactaaaagaaagaaagctatcttttggactaacagataatctgctcagtaactctacaaacatgtataatttggaaaataacatcaatatgagtatacaggtcggtcttgggcctgttaatcagaagtttagtgctgaagactttaactctaccctgacctggacaatcagctcttatctggctattgctttggcatacattatgacatttattgaacagttgatatgctgaatagtgtaatactgcactaggttaagccacaaatacatccgtctaccttaaaactgattgaatatgggaagagagcactacagctcctgatatagcataatgaagtgatcattggcctgttgcagctctctctctctctctctctctctctctctctctctcgcatgttctagtataggacagcagttgggatttgaaatccatagcttcgtttcaatttcaatacttttactgtagttcttaatcctgatatggatcctgctgtttatgctaatataatgtgtttatgcagctctggaggtgttgtgctggcttctcgagatggaaagattgtgtgtgagaacacacttgatgccaggctggaagttgtcttccgcaagaaattaccggaggtgcctt

SEQ ID NO: 20539 - DNA, 1152 bp, Oryza sativa
aatatggccaaattgagtatcggccttatcaattgtttggcttcaaaccaaactaacatatttactatttaaattaccaaaattttggtagggcaccgttttactttaatccaaaacggcctatagttcttaactgtactatccgccgccgccagttatacattgctgctgctgttcagctgcaaatactcaccagccccagaagttctacagaactcttgaggcttcagatttcagaagagtccagtaactatgggtggttattgttttctacaccccaacactagcgcttagtactactcaagggctgaagtcctggaagtgcattgagcaaatacactagcagtccacctgcgacatgactggcggaagccacggtcctcgccgctcagcacgaaacaagccggcgggtcgggccggatgacggtaaggccactctggcgaccagcgatgcgaaagggcggccggcggcagacgagacgagtgaatcgagcggcgcaatgctatcgatctaaagaaaggaaaacgaaccatgtggtctctcgttgtccttggttgggcaaacgctcctaccagcacaccaggccttcttgcttctggtccttgtctaataggccgatggacaagaacgtataggccacgtatatgggcctagggagcttggaaaacggggccctgcgagagcgcgcaggctgcacgccccggggacgggcctgagggtagggtgctacgtacaccttccattaaaaaaatcaactttgaagatgaatatggatatatgtttatccaattttgtccttagaaattggctctctattaaaaaaaataaatctaagattgaatgtggtgtaagtgttccgatttattatactaatttatatcacatttaattttagacatgtttttcaagggacggaaggagtacagtgcactggtgtacccaccaatctggcctccattgttaattcgctatgctgtggcaaatatggagttcatccatgacgcaagaatatggaatcttgtagtaacagcacctccacggctctactattgcctgacacagcgattggtggtttgttttgcgcgtatctgaacaggattagcatttggattaacagaaactaatctgaagctaggaacgctccacctgag

SEQ ID NO: 20540 - DNA, 662 bp, Oryza sativa
  unsure (1)..(662): unsure at all n locations
nnnnnnnnnnnnnnnnnnnnnnnnnnnnnnnnnnnnnnnnnnnnnnnnnnnnnnnnnnnnnnnnnnnnnnnnnnttgacttggccgcatattgcccctggccaccgtctaggtcatggttggtgccattgacaaaacacgctttggtgagcattgcatcctcaccacaaattgctatccttgccgtctctggtgatctggtcaaatctagcacttttatagcccatgttgacactcgcactggtttatgaaaaataaatgaaaataaaattatatcgtgcatattatgaaaagtataaaattggtactctttttaaataaactgattgatgcgacatgagtaaaatgatccaatgttccttgaagatgtatcttgtatgcagatgatatagagggctatgaactagtaaaatacacccccttcccgatgttcagtgtcgtattatccgagtctttttgttctttgggcttatatggccctcctctcgttaccataagtcggtgtggcttaatgtattgtgtaacaattattcttttcttctaatatattgacgtgtcatttttttacgtgttctaacaacaaatagtaaaatacagatatatacttttagccttattaaagtagtgtaaactacgggtaccgagctcgaattcgccctatag

SEQ ID NO: 20541 - DNA, 744 bp, Oryza sativa
aaagtttcaaccatgtatacaagtagttcagtaccactagaacatttaaacatgatttgcatgttcttatttgtcaatttaacaatgaccctgataggctacagcacatgcagagcaaatggttataccttcatattttcattcttcttcccgtttccttgcagatccggaagcttctttttggtcaggtgacggcataatctgtgcatgtaatttcagctgcggtatagctgcttccatgtaattagctgcaggttcgaacctgcagctgcaaggaatttcacctgtttgtgccaaattgattgtttaaagtattcatccgctatgtaaaacactacctatttgttcattattatcgccgagcaccaactattcgcacgcttgtttgctcagaggtataataataataataaaggacggtcaaacgttccattgctgtgtaaacctatttgcctgttgtccctggcctgttggtctgtaattccgtatagtttgtgtaactctggtgtgggcctatttgattctctaccctacctatttattggtagtgctaaaattaggcatattgtggcactaccaattttttggtagggtaaagttaattagcctacttttagtttgataccaatatggagccaaattttagtactatgatgaagaatatggccaaattgagtatcggccttatcaattgtttggcttcaaaccaaactaacatatttactatttaaattaccaaaattt

SEQ ID NO: 20542 - DNA, 777 bp, Oryza sativa
  unsure (1)..(777): unsure at all n locations
nnnnnnnnnnnnnnnnnnnnnnnnnnnnnnnnnnnnnnnnnnnnnnnnnnnnnnnnnncaacaagaatgaaacatgaaaaacatagacgataactattacatcatcttaatcattctacatcctctatagagctctggtcatcacatgttacgtcttaaatttattttttaaaaaattagaagctacaggccatcgatttccttttaaatcggtgaatccattattttcaaccattagatctacttttagaaaaatcttaagccgtcatgtgttacatcataaaaattagaaaaaatatattagaagttcagagaaaaacaatcaaaacatcggatcatcagtttttacttaaatcatttagaagagaatagaaaaacaaacttccctccaccttgccctcctcctcacatatgcacagctgatcaactttagttaccttgctgatcaactccaatcagaccgatcgacatcgattcgagaaacttttaattccgctaaaagttttgatttttaggtactacaactattcaccccccctcccgggttggcttagttcttgctgttcgatcctacagtttcagcctctcttcagatatgcttgagaattaactactccctctgtttcacaatgtaagtcattctagcatttctcatattcatattgatattaatgaatctaaacatatatatctatctagattcattaacatcaatatgaatattagaaatgctagaataacttacattgtgaaacggaggaagtagtcaataccttg

SEQ ID NO: 20543 - DNA, 943 bp, Oryza sativa
  unsure (1)..(943): unsure at all n locations
nnnnnnnnnnnnnnnnnnnnnnnnnnnnnnnnncaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaaactgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattatctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataatgaggggccatgaccgttcaaaagccatttccacataccgtctccaagcagcagtgctgtccatcggcattagttcccaaaaataaccttctattgcacgactcactacaacagatactgacattgtgtagacttcttggtctattct

SEQ ID NO: 20544 - DNA, 337 bp, Oryza sativa
aaaatagcgttaagcgagaaaggaaaccttggaaatggttagtgctgggctccattggtccttaaggatgtcaaggcaaatgctcccgttgctgttgatgtttggatggaaaaccttggtgcgaaacgccacctgcatattgcatatcatagacgtcacattcttcagtcagtctcggtgctgttgtaaagctatagaacttaatggatattcagactgaaaaccagaaaccataagaatttataattgaagtgatattctttcagaatgaagtaaaagaacaccttagtgataagtgagaagacaatcactaccaaaccattattcggttatatag

SEQ ID NO: 20545 - DNA, 1747 bp, Oryza sativa
atgtgctccatttaaacagttcccaatttcaacatagagtataatcctcatccaaattcctccataggaagtgtaattaggtggtgacgtaaaattatataatttgcatatttgtcattgtcaaatatcaatctgctcgggaaacatctaactgcttgtgccattggatccgacactgtggaaccaaaatgccactactgtcatacatcaagacgtactctctgtttacacccgaatttgacacctagattcaaaataggaaaacattatcaaaatttggaaggcatcgggttttcttcacagggccaggctgaccgtggcctatgggctagacagaccagcagagtccgacgcttagtccgatattgttgggtctcggatttccttactggaagatatgtttcgggtttcctttggtttctatcctgagttggacatggagaaaaacctataggaggcaaaaccaacccctttataaggatcaagaccgattcgattcaagaaccccccaccccccaatctctcaatcctacacaatcgactcgttcttttacctttgtttttcagccatgtcttttaatgtactctagtttagtccatttttatcgatttatgctataaatcgtccgttgtcgccacaagagtgcgattgcccctttgtaggtttgtcccgtaagccttctgttcgcctatgagatgggtggttatcttcaaatcgttctaaatcggcctcgtggctggttttgatctctaaatggctccgctagtcggtttaatcttcaaaacccatcttggtttagagttgtctatatcgaggtggttgacgagtctcgtgttgggatcgaaaaagacgccttgttgtttagtatgagatttactaaaatgataaataaattaaaacggacagagtataaattctaaatattaggaatgctaagatatattccatccgttaaaaaaatatatttcctccgtttcacaatgtaagtcattctagtatttcctacattcataatgatgttaatgaatctagacatatatatctatctagattcattaatatcaatataaatatgggaaatgttaaaatgacttacatggtgaaacggagggagtaactatctttaaactgaaatttaataatacgtcaaatgcgagctcatagtaaagggagctatattttgaaatggagataatataatcggattgcccttaattaccgcttcgaagctccttattggcacggtatttgaccttaatttacgaagtaccttgcggtagccctgcttcataattttgcctgtactaaagtagttcagcggatttatatcctcaacagtctatgcgtggagtattaagggtgtgtttggttgcaagccacagtttgccacagtttgccacgcctaaggttaggcaaatttgacaggtgtttggttgtagtcacagttgtgacaagattcccctccaacaaattgggtcccacgtgtcaatggctcaaaaaagtgtggcaagattcccttaggcttagtaagttgtggctaacaatttgatcacctcaccttaggcaaggtgtggcaacttttgttggcaagtaatggtaaagtgtggctgggaaccaaacagccccagtcatgggcccgttaagttttgtcccccccctttcggagcttttacttaaaaaacctagtagtaagcacaagtttaatatatgaacacactcacgcacacacaatctctttaaaacagt

SEQ ID NO: 20546 - DNA, 3054 bp, Oryza sativa
cttagtaagttgtggctaacaatttgatcacctcaccttaggcaaggtgtggcaacttttgttggcaagtaatggtaaagtgtggctgggaaccaaacagccccagtcatgggcccgttaagttttgtcccccccctttcggagcttttacttaaaaaacctagtagtaagcacaagtttatatatgaacacactcacgcacacacaatctctataaaacagttttttaaactagactgttatattttgagattgataaaatcatcacaatcatatcactgtcgacggtcacgtctactattgaaggaatagttagacgtaaatcatggtacaatgtaattttcattttatactagtcagtataactatatcagtccatctccactgttataatttgatccactgtgatatagtgatttaatgacttaccttttcttttattaatgttagagagtccacagtgaaacgtctaccaacaatcatgataagatcgtacttctgtcctatattacgctattcctccacctaatttctcatattaatcaatcacaatcattatttatttaatttatttatctatttttttcatctcaaatgctatctctgtttcatattataagtatttttaactttttttagtcaaattactttaaatttgacctagtttctacaaaaatatagtgatattttgcacacaaaacaagcatattattagaatatattcaatattggttttcaataaaaataatttgatgttataaatattgctaattttttctataaatttgatcaagctttaaaaaagtttgactagaaaaacagccaaaacgatttataatataaaatagagagagtaatcacaactatttctcatctcaatcttaatctctcgagaaaaataaaagtaacataggcggtagatcatattaaaatatctaccaatcaagtactatatactaatatagtactccctctgtctgggttacggataaggtataccctctacccttggatatacatcatgtatcaatatggtatatctgcgcgtatatggacgttctttgtacacgttaagaaaattcaccacggagtcatagatgtaaggattcctactcggacagaactgggtcgttactatatcgtgtagggtccgatgtctccgagttctacttagagaccaactaacctgcggtataaaagggacccccgggaggacctaaggcatcgaatcttaccgccaacacatctaccacggcctacgaagccggagcctacaggagccaagttgccggatgatctagtcgaaccaactcgactacgatctcgtcggtatcaacgagttccactattccctttgtaatctgtgttttccgtcatataatcccatatcaactggattagggctattacctattaaggggcctgaactagtataattcctatcttttgtttgcttgatgtcgtactacgtcgatcctcgtaccagcgtactccaataccctctatatccggtctacgggtatcccccgtcgacagtggcgcaccaggtagggggacttggtactcaaggttctactactatgtcatcaagcttcgttgacaacagcgtcaaccccggcttcaaccaaggagtttctacttcaacaatgttggcgtggactcaagtcggcgaaatcgtctttccggtttacaccacggtgctgatctcgactggtccatcaatggccggaagcgagaacgccgtagttataaccctggacgactccatgtcgaaggatcctcccgctgaagtggagaacagaacgtcgacaacatctgagcccgagaaggatcctagtgcggccaaatcttgtccctccgacgagaatcacgagccgacaaggacaacttccgaggcgacaaggtcctggtgccctatccacaaaaccaggaaacacaccttacaagcttgctgggtttttctcaacgtacaagctgagatccgtgcctgcaaagagcgtggaattcagcgtacttctccaacttgtgatgcctattgtcctgttcacaagacaaagaatcacgacctctcaagctgcaaggttcttctcagtgccatgaggacgtcacctcctaaagttcagcagtcacgaatctctcttagagatatggacaaggaacgaggagcgacagttatctcttagagattcgttggggtaatcgacatcgatccccatgagccgtcggttctacacttgctcgaagaccaggcctcatcgtcgacgagcacaccacgcgatgtgtttgctataggtgggaccagcacgtctgcatgcgccgacgcagaagcggagaatcaggtggcaacactggcccagcacatcagggccatcaacacaatactgagggagaccccttatgatcccgttctgaacgatgatcttgcgcagtggtcagaacgattacgggaattagtggccaacctcagcaacgtgttcgaggaggccgctgccagggtaccgctagaacaaccgccaaccggcggcgttaatggcgaactgcctgagcagcgggcgtcacctcgtcaagccacccctccccctcgcggcaccagcgatctccgtgaccatctgaatggccgccgagatgtacgacgcacgcggaacaacgaaaaccgttcccgacatcatgtctcttcgcgacgtcgcgagaatgaagagcgaggagacccgacggaaaccgagaccgtgataactgccacaaccgccacaatcatgacgatcgcgaacagcggatgccgggcgatactagtcgatgacgccgccataatgatggtgatgatggagatcggcgccgggacaacaacagtgggcgacgataggattctcgggaacccggacgtcatcctcataatcgtacacttgaaccaagtgactcatcgtcgtcgtcatcatcctcatcatcctcatcatcagatagacatccacgaaggacatacgatcgccgacaacccaccgcccccgatggcgggtgtagagctttcagccgtgctctacatgatgtccgatggcctaa

SEQ ID NO: 20547 - DNA, 1485 bp, Oryza sativa
  unsure (1)..(1485): unsure at all n locations
ccctacatgatgtccgatggcctaagagattccgactgtgagcaattgaaaagtacgatgggagcaccgacccagaagaattccttcaggtctactccacggtactctacgctgccggagcggacgacaacgcgttggtgaattatttgccggcggcgttgaaaggttctgcactttcatggctagttcacctcccgccatactcgatttcttcatgggcagatctgtagcagcagttcgtcactaacttccaaggaacttacaagcgccacgcgatcgaagacgacctacacgcgttgacacaaaatccgggcgaatcattgagggactacgttcggcgctttaatgagtgcagaaatattatccccgagatcaccgatgcttccgtgatccgcgctttcaagactagtgtcagagatcgctatatgacccaggagttggcgacaaggcggatcacgactgctcgaaaactattcaagatagtcgatcgatgcgctcacgcggacgatgcactgagacgcaagaacgacaagccgaagacgggaggagaaaagaaaccagcgaaagacgcacctgaatcaagcaagaagaagagtcgcaagagtgggaaaaggaaagctcaaacggaagtcctcgcggcagagtacgcggaccctcccaggcacccagacccacaaggcaacgacacaaagaaaatatggtgccctatacacaagttggacagacactctctggaagattgctttgtcttcaaaaagttgctcgcaaagcaactggcattggagaagggcaagcgagtacgtgtagtcgagaaggccgctgagcagctactcaggactcggactcagcatatccagattccgatctccatgtctcgcacatcttcgcaggttccacggcttactcctcaaagcgagagtacaagaaagtggagcgtgaagtttgttcgacatggcaggggggtgcgcccaagatgaagtggtctgaacagaagatcgagttctcagatgaagaccaccccaagattgctgtcatcccaggacgatatccgatcgtggtcgagcccactattcggaatatcaaggtcgcgcgagttctcgtcgatggcggcagctccatcaaccttctcttcgccagcaccttggacgcgatgggaatcccacgaagcgagttgacaccgactgatcaacccttccatggaattactcctgagtcatcgtccaagccattgggcaagattacgttgcctgtgactttcggccaagcaaataacttccgaacaaagcagatcatctttgatgtcgctgaatttgatacaacatacaatgccatcatcggaagaactgcacttgcaaagttcatggccgcatctcactacgtgtatcaagtgctcaagatgcctggtccgaagggaacaatccctgttcaagggaatgcaaagctnnnnnnnnnnnnnnnnnnnnnnnnnnnnnnnnnnnnnnnnnn

SEQ ID NO: 20548 - DNA, 1400 bp, Oryza sativa
  unsure (1)..(1400): unsure at all n locations
ctattggaatatcaaggtcgcgcgagttctcgtcgatggcggcagctccatcaaccttctcttcgccagcaccttggacgcgatgggaatcccacgaagcgagttgacaccgactgatcaacccttccatggaattactcctgagtcatcgtccaagccattgggcaagattacgttgcctgtgactttcggccaagcaaataacttccgaacaaagcagatcatctttgatgtcgctgaatttgatacaacatacaatgccatcatcggaagaactgcacttgcaaagttcatggccgcatctcactacgtgtatcaagtgctcaagatgcctggtccgaagggaacaatcactgttcaagggaatgcaaagctggcggtgcaatacgactagcggagcctcgacatggtcgagcacacgcccagcccacccgccacagctgagccacccaagaaagtgagcaaaacgaacaagacgccaaaaccagacggtgcaatcaagatcgttccgcactccagtgccaaccccgacaagaccgtcaagatcggggcatcactgagcgaggaataggaactcgcgctcatcaccttcctccatgacaatgcagacgtgttcgcttggcagccgtccgacataccggggatcccagggaggtgattgagcacaaactcatggtgcgacccgatgccaagccagtaaaacaaaaactgcggagatttgcaccagatcaaaaacaggccatacgtgaagagctcgacaagcttctcaaagctggcttcatcagagaggtactccatccagagtggctagccaacccagtcatggtgtggaaggccaacgggaagtggaggatgtgcgtcgacttcaccgacctcaacaaggcgtgtcccaaggatcacttccttcttcctcgaatagaccaactggtggactcaacagctggttgtgagttgttaagctttcttgacgcttactccggctaccaccgaatcagcatggcaaaagaggacgaggagaaaacagcattcatcacgccgttcggtgtattctgctatgttaagatgccgtttggactgataaccacaggaaacactttccaacgcacggtccaaggggcacttaatgatcagcttaggaacaatgtcgaggcctacgccgatgacattgttgtcaagaccaagacaagtgactcattgattgacgatctccgggaaacgttcgacaacctccgacgatatcgcctcatgctcaatccagagaagtgcacgttcggagtaccatcgggcaagctgctcgggttcctcgtctctggaagagggatcaaagcaaatcgagaaannnnnnnnnnnnnnnnnnnnnnnnnnnnnnnnnnnnnnnnnnnnnnnnnnnnnnnnnnnnn

SEQ ID NO: 20549 - DNA, 2551 bp, Oryza sativa
agtttaatagtagaactcactacttactattagtcaatgttaaaactaacatatatagtaagttggctataaggttatctttattttcttcatcctctctctttctctcactacgaatttaatgcatatttcttggagcttgtgtgtagttagctcttgcatgagagccaacactccactatacttttgtttatctctctcttctacataagcatatagcttgcttatagcccactattatccttactctcagtagcaccttaggtcatgggttcgactccccatgggagcgaattttccaggatttaaaggcattatgctttcagtggtaggcgacgtacccgtcgacagcgaggcgcctgtggtgactaggatttgccggcccggtcttcaaagatgctcataggggtagggtttgtgtgcgtgcgttcataggggtgagtgtgcgtgtgttgtgagtgtctgcgttgaactgtgtaattcttaaaaaaattgagaaattttaaattctattatataatgatcaatttttgaaggagggagtacaaattatgttacctcggaatcatcaacaattaagttacgactgtactaaaataacattccatggccactaacgccggacgcatagttaagcaagtttagattttaaatttaagctcaaattctaaaaagtggtcggagatgtaatttatcttctgttatcttcttatctctactctttgaaagaccagtcatccttcttctctcaccctacaacgcgcgccaaaaaaaacctgtaaaaaccgaatcggcccccctcccatcgtactgcaaggtttttttttttcttccaccaaagaattaaccgatcagaaaaagcaaatagagaaaactaaacctataatacaattattttgtcttattccttcatatatacttatatctcattgtaaagcacagccatagcgcaatggggaaggagtcgtttcgggtctcgttggttgccgatggaccctgacccgaactttagcatcaacggctaagatggaatactatactgttggaagtattttttagcacactggagctctcccattagtttgttgatcgctttattaattgtcttctgtgtttctcgcgaaaacttgttggtgatgtagcaaaacttgtgaagtaacagcaatagagtttgctggttccgaagataataaagatgaagtcgctccaccatgatgacaaagttgtgttgccgtgatgaagtgaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcaacggcggatgcggcggccggtcggtgaagacgtagacgcccaacaacggcggcataaaggccagccgtgcaggcggaaacaccagtcggcggcggcgaaggcaagccgatcggtgaagacgtagacgcccaacaacggcggcataaaggccagccgtgcaggcgaggacatcagtcggcggcgacaaaggcaagccggtcggtgaagacgtaggcgcccaacaacggcggcataaaggccagccgtgcaggcggggacaccagtcggcggcgacgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcgaggacatcggtcggcggcgacgaaggcaagccggtcggtgaagacgtaggcgcccaacaacggcggcataataggccagccgtgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcatacaggccagccgtgcaggcggaaacaccagtcggcggcggcgaaggcaagccggtcggtgaagacgtagacgcccaacaacggcggcataataggccagccgtgcaggcggaaacatcggtcggcggcggcgaagccaagccggtcggtgaagacgtagacgcccaacaacggcggcataaaggccagcggtgcaggcaaggacatcggtcggcggcgacaaaggcaagccggtcggtgaagacgtaggcgcccaacaacgg

SEQ ID NO: 20550 - DNA, 1752 bp, Oryza sativa
acgtagacgcccaacaccggcggcataaaggccagccgtgcaggcgaggacatcggtcggcggcgacgaagggcaagccggtcggtgaagacgtaggcgcccaacaacggcggcataataggccagccgtgcaggcgaggacaccagtcggcggcggcgaaggcaagccggtcggtgaagacgtagacgcccaacaacggcggcataataggccagccgtgtaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacactctgcccgactagtcatagccaccaagcactgggagtcggcctaagcacttcccaaacatgcatatgagtgacataagttcgtcattaatggaacaaagtttcacggatcggagtttactactcgggtacttttgcaattattaagagcagaaaataaattatcttatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtagtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccagtcggcggcgacggaggcaggccggtggtgaagacgtagacgcccaacaacggtggtgtgaccaaccaaccatataggcggaggcaccagtcggcggcgaagtcgtagacgcccaacagcagcggcataataggccagccgtgtaggcggaggcaccagtcggcggcgacggaggcaggccggtggtgaagacgtagacgcccaacaacggtggtgtgaccaaccaaccatataggcggaggcaccagtcggcggcgacggaggcaggccggcggtgaagacgtatacgcccaacagcagcggcataatacgcccaccgtgtaggcggaggcaccactcggcggcgacggaagcaagccggcggtgaagtcgtagacgcccaacagcagcggcataataggccacccgtgtaggcggag

SEQ ID NO: 20551 - DNA, 10527 bp, Oryza sativa
  unsure (1)..(10527): unsure at all n locations
atgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatatatgccccctagagggcctcctgcccaccttatataggatggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacagcgtgcatgctgataggcgatagctactactcgtactagtactctatttctgcctgaccggtacaacaatctcagtgtaaagtacacatgcatgcgtgcatgcggtggttcggttttagcctgcttagaatccaaactcggttttaaatatacagccatttacaattccacctttttttcgaatccagaatgactcacattgctcaaacctatccacattacactattttataattaagaatttaaatctccaactataactaccgctatagctaaagatacctacttaaaaaacaacagctaagatatgtactatacacattctatattgctattagctattgttagcgagggatagccactgccagggttacggatacgatataccctctacccttggatatatattgtataccgatacggtatacctgcgcgtatacgaatgtttcctgtatacgttaagggaatccatcacgtaatagaaaccgaatccacacatgagagaagtcctactcgaacaagactgggtcgttactgtatcataaggggtccgatatctccgagtcctacttggagatcaactgacccgcgatataaaagagacccccccgggaggacctaaggcatcgaatctcaccgccaacacatctaccacagcctacgaagccgtagcctgcagaagccaagtcgccgggtgatctagtcaaaccaactcgactacgatctcgtcggtattatcgagttctgttattccctttgtaatctgttatttccatcatataatcccagaccaactggattagggctattacctaccaaggagcctgaaccagtataatccctgtcttttgtttgcttgatgtcgtattacgtagatcctcgttccaacgtaccccaataccctctatatccggtctacgggtatccaccgtcgacagccaccaaatggatcttcaattagcgccagctaaactcgacgggctgaaattggtgaacgacccatataaccatacaacccataataaacttctaaactccaattctctccacctatcagtttcttagtctctcgccctctcctcttctctcctcaacagactatagcggcatctacagctgcgacctgcagcggcgatgagctgcaccaatccctccatccccactcttctctgtttctcccccgggtgctatggcggtggctgtggttgtggctgcggcctacaatgacaatggtggcggctgcgccctgaggtgacggtggttacgttactgctgtgtggcaccaatccatccccactcccccaagtggcagtggatgtgatattgtgagcctatgacgggtggcggtggctacatctggagatccacttctctcctccaagcggcaaccactacttttgtactagtttatttctccacatatctgcttttgtacacgtttaatattcacctttcaaattttatactagtttatttcctcaactattatcatttgtctgatcacttatacttttgctactcccctaatctttaaaataatatgtataatttattatattatgggacagagggagctttaaacttgctattagcagctactggctagccacgtacttctaattcgcatttactctttatataatgtaagcaattgttgtgacggacaatggcgtgacaatccgactactccaagctttcatcagtccgccgctctgagcccttcgcaccttcatttttgatgatgtgaagccacttgaccattggcatgtattcaagtaccgatttcgtctttcaaacttatatggactatgctatcaatagttacttttataatgattaaccaataagtggttgaaagatatacttgaaaaacaaaaggcatatacattaatacatatgtaattaaggaacgtattttagaaccccatgatgtcaaattcattctagggctcttcacagatatagagtcggtatggtgccgagagcaaattattagcatacaaaaatccataatttttttgtggccagaaaccgtaaaggataacatcgaaacttgacggctttcaccaccaataaaatcagctgaccgtcgagaaaatactactccctctattctataatataaagcacaactacttttaaaagttgtttcataatataagacgtgcatacatgcatgtcattaagtagcacatatttttcacttaaatattattatttaaatcctccaccatcaagatctctaattttattgggtgcatgcattctatttattagggtaatccaaactatgatgtgataataattatttcttggtctttgggttaagagtggttgtgccttatatctagaatggagggagtaggtttttgtagtttaggtccgttccccatttagggcccctttgaatcgcagggtaaaaaaaacagagaaataggaaaaacacatgactctgacaggaattgaagtgtaaaacagaggattgcaaaacacaagaaaagaatggtcgtttgattggagcgcaggaaaaacgcaggaatcggacgagagagattgactcaaaggaaattttccaagaggttggagctcttgctaaatttcctctaaaatccacatgcaatgtcccattccattggaatttcataggatttggacagcttcaatcctttgaatcaaagggccaaataagaaaatttcctatagaatttaaatactataaaatttttatataaattctttgattcaaatggacccttaaccagccgttcatcctccgaaacacggagcgctatcgcaagaaaggaaagttggtatcgtgcgcgggcgtgacacgcacgaacgacgtctggccgagatgcgccgccgcgcgcacgctccgtctgtctggtctcgatcgatccacaaaccacagcccgctgcacgcaggccaggggtctcaaaacgcacgcacgaacgcacgcacgtgatcgaccacctgatcagcgcgcgcacacacggcgcaccgcccgcctcctctctccagtggcacgcaccgcgcggtatgcacgtactcacgcatgtgcgagtgttaagtgagatttgcgagccgcatcgatcgatcgatcgatcctgcatggatggcgcatccagtgcccgggtcacatgccaaggcatatactcagtgcaggagtgtacagtatagtgattgggtagcgagcaaagctgaaagcttttgtgttctttttttttttcgtttagatttcgcagcaagtactgtagcaccttttcgtggccacgtaccctacacgcgcgcgactttacgtgcgtatatactgcgtacaacatgctgctgcgcctagacgtacgacatattttggtatagtaaaatactagtgtacgtacgaccagcacacaatattcataagagaccgacgaccaggtgaaacatgcttacctccgaagcaattaacagccgacacaaaagaaatacattatggattatgccattacgtattgctggtggcggtaatatataaatacgatgggtacattgcgcgctctctgtataatagtacttctgttggaacttttttaaaaagaaaaagactgaaattgtttgcttttcacacaactggatcatacacagcacaatttgacagtttgtgattagccggagggatcgactaaccttaccgttgatcattggtctcacaaaatttgcaaatgagccgttgtctcaagaacgcacgatatgccgaatgcatggccagccgtcgccgtcgtttccctgcaaatacatttgctgtcttccggactggttccatgcccgtaccacccccaaaattcgagccaagacacaaacactcttttttttttgtcaggcacgtgtatgtacagtaacgtaagcacacgtatcagcagctgctcacttagctagagagcttgtacttagagggtgtttggaaaagaggggctaaactctcaaaaccataaatcatgacttatggttttgagagactcctaaacatcccccttatatacgcctccatatggccgagaatcccctatttctctgtgcaatttcttaggatggtccctgctgatcagctacccgtctctcagcaatgcgaatcgtgggcattgggcaagccggctatatagccagcagagtagcagactgaccggggtcagggcagggtaggatgccattgattttcccaattcccagctgctgatgatgctaaattgctaagaacatgtacaatagcgggttataagccagctacaaatatattttaaggagataaataaggagagagaagagcagcgggctatagatttgtagctagctgtagcacggactttaagacacagtgtgtatatgacaggtgggaccagatattaatagtgtggtatgtaactattgtataaatgagttattagattggctatatataaattggagcaagtagttgggtatactattgtattgaacttttgatctaatgagtggcgattaggggctccacctcccaacacgcgtggctcgcgccgacgagtgctcgtcgtttgtttatcgcagccagaaccatgttacgcacgcgagtgaaaattggttgattctacataccaggctaccagcgccgcaaccacggtcactgacatgtgagccttgtaccgggcggttagcgtgggcccgtgttgtcagtagcagtatcatctcttgacgtgtgtgatagatcgtgagaatacaaccgttttttgctccatttttataaattatcaccggcccattcgggttctggcgttctgctactgttttggggcactctaatgctctaacactatagtatcatcgatggtttttcttttttttttttagaaattacacagtacaacacagacactcacaacacacgcgcactcattcttatgaacacacgcacataaaccctacccttatgaggatctttgaagactggaccggtaaatccctggagtttaatggtttttcttcttcttctttgagtgatcgatgttgagctttaggaaaagagaagaaaatggtcctgctcgtctgtacaggaccccggctttaactataattgcggtgtcgtctcccagggcactgtgcatgtactcctcaccgattagcagctgaaacgatgtcgagtggatgcatgcatcagtatcacgcggtcaaatttggaggtgaggccagtgttggatctcgtttcaaccccccggcattttggcagatttttgttttcttccgaaggatatatacaacttaggagtactaagctttaattgatctgagtgttttgtggagaactacttgttttttactccctgtcccaaaaaaaaatgttaactaagattagatatgacatattctattacaacgaatttgaaataaggtatgttcaaatttatagtactaagatgtgtcacattcaatattagatttgttttttatgggaaaaaaaaggtagatgagaagtagtagtacatggtgagtactgtaatgtgatgaactccctgttaaaacatgtgttaatactatcatcaattaatgtagggacccggatctgttgcacttaacactatagcactgcaacttaagcagtcgcactacagtagtccaatcaaaatctaaggatccaagcgtcacctagcacgataagcaacatagtatctgctcctcgtcctataatataccaatctagtatcagatggaacattagtcctacctatgttcattgtactatgtagtgtcccatctggtactaggttattatatttattatgggattgagaaagtcctccatacgatactatactataattctagtattgtacttctggtaaatctgaaccattcacctctgaaatggatggatgaaatggcacgcaaatgtgcaatcaataacttgtcgttacagggttaaactcttatacctctattgttatgaatttaaaattaattaaaggctaaagattacaatgaaatactcaagatcaattttaatattagattttaaaatttaagttttaactatggctaataagttaatgaatagacgatgaaaccactcgaaaaacatggtctattgttaccatggtgatgttagtcccgttccaacgggatcttgcgatcccggtaagactgtagctgctcgagcgctccatcttagagcttccccagcaactcatccaaattttatcctccatattctcattaggatggtcgtctaaaaagattctcactccatatttcttttcactctaatagatcatccatattacattcaccattttgtatcatcctatattttactaatatcttttaaccaccacacattttatattaatttctcactaactcttcctctcttctacttcgtatagacggcgaggatgaggagggctgatgggtgtttcgggggtggtgtggtgcggtcgttggtggagaagcagcacgacgggagggggaggtgcgatagaaggcgttggcggaggtggaagtcgcgggcgaaagggagcggcggcggaaggcgggagcaaagggggcggtggtggaagtcgtgggcggaggggaaatgcggcggtggaagttgcgagcagagggaaacggcgtcgaaggccggcacaacaccgggaagggaccgctttttctccaacgaactcccccaaatctggttggtgcctcctctctacctctctctccaactcttacaagtaatccagtcggagccacacctcattctccctttcttcccatgtctgccgctcctcatcctccctctccttctctgcctgtcactagcacagatgctgcgagagattgaatcggaacttcggatgggggcaggagctgcggcggttacgataggacgtgaggagagaggaaagctaaatttgacgttcccctctcttatttagtacacgcactatttttgacatagccaatggtgtatccgatgaaggctgattttttacccccctacgttatttttgggaaaagtacagacaaggtccctcaacttgttagccagatacaaaatcatccctcaaccgtaaaaccggacatccggcgtcccccaacttataaaaccggtcataataggtccctcggtggttttcatcctagttttgtcccacgtggcggctgacttagcgtgggacccacgtggaccccacatgtcagtaagccacatcagcaccctctctctctctttctctatttctctccttcctctcgctctctgctcttgcacaggaggtggcacgcgcggccgaagggtggtgcggccggcgacgacggctctcgggtggcggcgcgcgggctcagggcggtgcgagatcgccggcctccccatccccctcgtgcggtcggcgatggcggcgcgcggctgcggccatcataactgacgcggaaaggagggctgatgcggcggcggcggcggcggcgtcaccgacacggtggggaaaagggttggcacggccgacggggaaggagaaccggagaggaggaccggcgacggagctagaagccacacgcccggccgacggaggcgcggggaggccggtgagctcctcccaagtccaaatctggcggcgaggcgggaggaacccggtgacgacggcgggaaggcacagggaggccggcgtcggcgtcgaggcgggaggaatgcgtcggcgttggctcaaaggagcaaggcggcggtgaggggagcaaggtggcggcgtcagcttcctctccgtgctcgccaatgagaaggagcggcgggcgaccgtggcggccaagctagagccacacgcgcggccagcggaggcgcggggaggccagcgagctcgtcgactgggcggtggcgacgaggcaggaggaacgtgtcggcgtcagcttggcggtggcggggaggcgggaggaacgcggcgacgacggcgacgccatgacggcgctcgagaccgaagccgcgacgccctcgacggctgccacccgcgcccagctccttccccggtggctgaggctgggggagacgtcgacgccgtcttcctcggcttcgtctacaaccacgtgccgccaccgcccttcccgctgcccgtcccgtgcctgtttgttgggtgccgcgaccacgctgggctgccaccgcccttcccttttcccgtgttgccgccgccgcgtcgccggtcggcggtcgtcagacctcctctcccgcctcaccccggcgacctccccacccgccacccggcccgcccagcctgccgagaggagataagtgagagagagaggaagggagaggaaagattgagagaggtgatgacatggcttactgacatgttgggcccatgtgggtcccacgctgagtcagccgtcacgtgggataaaaccggggtcaaaaccgccgaaggatctattgtgaccggttttgtaagttgggggacgccggatgtccggttttgtggttgaggaatgattttgtatctagctaacaagttgagggaccttgcatgtatttttcccgttatttttcatatggatgatactccctccgtcccacaaaacatgacgttttaaggttagcagccaaaattagctgttgtgcaaaatgaccaaattgtccccatgatttgattaagctgtcatttacagcatttgtacatgcatccagattattctagagaagtttcctgaaaccacagctcagtgccacgtgttaacgaattggcgccttagccacacggttgatacagggcaaaaccatcattaacatattcaaaaatttgaatcaaccatgaagcttgctttgccgcccaggagtgcctcttcatttgctagttctggcgcccaagagtgcctcttcatatgctagaggtcatgaaagagccatccatttcattccatttcatcaacctacatatccaaccaaacactacacacatccaatccaaatgatcagagatctaaatttgctactggaagaggaaggagaggaaggagatcaaggggctttacctgatctcaatgaagaaattgatatggaagaagatggaagacatgttgttatccttggagataaccttcttggagttgatggccaggaacatggaggttttcttgatctcaacttgcatccttttgatctcaacatggtggctacagaagaagaagaaatgcagcaaggtaagatttcaatacttttggagaagcactggtgctatggttttataaaaccaataagatttcaataactgaagatctaccttggcttattagctggataaaattagagcaccagtccatcataacctgcagctgtgaacagatggtgttagctttgaggttaagtgatttacataaaccactttcaaacaaataacagcaaaacttgatcagatcaatctttttcaacataaggaaacataattcattgaacactcgcagcaaaaataattcattgagcaatgaactcatttgatcagtaatatctctaggaatctaagaggccatttgtgatatacagcagctacaccatgcttcacttaatcatttatatagcaagaatatatatagtaggtggacagcagtaccatgctttactcttattattgacttcagtactagactctaaggcctgttggattgcctacaagttgtagtagaactacatgtcaacagacttgtctatccttatggctgtattattaaaataacaatgtgtgcagtgtcaaaaataaatttacacagctaagccttggaaaagcattctctgattgcacatatatttaaagtgtgtaggtatagtgtgcatgcagatttaaaagtatactaaccaacaagtatttggatagacaacgtgatgcaccatgtggcgcacatcgtgnnnnnnnnnnnnnnnnnnnnnnnnnnnnnnnnnnnnnnnnnnnnnnnnnnn

SEQ ID NO: 20552 - DNA, 1447 bp, Oryza sativa
  unsure (1)..(1447): unsure at all n locations
cagtccatcataacctgcagctgtgaccgaatggtgttagctttaaggttaagtgatttacataaaccactttcaaacaaataccagcaaaacttgatcagatcattctttttcacataaggaaacataattcattgaacactcgcagcaaaaataattcattgagcaatgaactcatttgatcagtaatatctctaggaatctaagaggccatttgtgatatacagcagctacaccatgcttcacttaatcatttatatagcaagaatatatatagtaggtggacagcagtaccatgctttactcttattattgacttcagtactagactctaaggcctgttggattgcctacaagttgtagtagaactacatgtcaacagacttgtctatccttatggctgtattattaaaataacaatgtgtgcagtgtcaaaaataaatttacacagctaagccttggaaaagcattctctgattgcacatatatttaaagtgtgtaggtatagtgtgcatggcagatttaaaagtatactaaccaacaagtatttggatagacaacgtgatgcaccatgtggcgcacatcgtgcatgggagtgcacatgtaaatgaggaacaagaagaaactgaactaggtaaaattcatgttttttttagaagtttgaataaatgtacgcattcttattaacccatattaacttaccatgtcaaacattttgtagatgaccatgaagcattgcaatttgagctggaagccttggagaatgatcttcaagactacggagtgtacgccgaagctgtcaatgttgtctttgatgtagaggagttgcccgactcagatgacgatcaagaagaacatgcaaatgaaaatgtggcaagtaagtcaaaagatttgacaaacatacaaaggcgaggcatttatcaattgttgcttcagaaaagtaaagatggaaaattagaaaaacacaccacacgtttagttgctcaagagttccatgttagcatccatacagtccaacgtatttggaagagagcaaagatttgccatgaacagggaatagcagtgaatgttgattcaaggaagcatggaaactctgggcgcaagaaggtcgaaatagacttgtcagttattgcagctattccattgcatcaaaggagaaatattcggtcactagcacaagcccttggtgttcccaaaagcacattacataggtggttcaaagaagggctgatacgacgtcactctaactcgctaaagccttatttgaaggaagcaaataaaaaggaaaggctgcagtggtgtgtttctatgctagatccgcacacattgccaaacaaccccaagtttattgaaatggaaaatattatccacatagatgagaannnnnnnnnnnnnnnnnnnnnnnnnnnnnnnnnnnnnnnnnnnnnnnnnnnnnnnnnnnnnnnnn

SEQ ID NO: 20553 - DNA, 329 bp, Oryza sativa
aaggatcgacgtagtacgacatcaatcccatatcatccagttagcttctggacttccttgagtcttgtgggcgacttcatgttctcgattgccttgatcttctcgggatttgctttgatccctcttccagagacgaggaacccgagcagcttgcccgatggtactccgaacgtgcacttctctggattgagcatgaggcgatatcgtcggaggttgtcgaacgtttcccggagatcgtcaatcaatgagtcacttgtctggtcttgacaacaatgtcatcggcgtaggcctcgacattgttcctaacctgatcattaagtgccccttgg

SEQ ID NO: 20554 - DNA, 367 bp, Oryza sativa
  unsure (1)..(367): unsure at all n locations
nnnnnnnnnnnnnnnnnnnnnnnnnnnnnnnnnnnnnnnnnnnnnnnnnnnnnnnnnnnnnncaaaaatacccgaagctccccatggtgatgaactcggtctgatgtatcctttctgtagcaaatcatctacttgcctcttaacttctgccaactcattggctgccattcgataaggtctcttatggatcggagttgttccaggtaccaaatctattgtgaactctatatcccttttaggcggcataccaggtaaatcatctgggaacacatcgggatactcccggactataggaatctcttccaagttatttggttcagtcttgacctnnnnnnnnnnnnnnnnnnnnnnnnnnnnnnnnnnnnnn

SEQ ID NO: 20555 - DNA, 1463 bp, Oryza sativa
  unsure (1)..(1463): unsure at all n locations
nnnnnnnnnnnnnnnnnnnnnnnnnnnnnnnnnnnnnnnnnnnnnnnnnnnnnnnnnnnnntttatctcgtgcgaccccgttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcatccatgtcttcaccgaccggctggccttcgccgccgccgactggtgtttccgcctgcacggctggtctattatgccgccgctgttgggcgtctacgacttcaccaccggcctgcctccgtcgccgccgactggtatcctcgcctatacggtcggttggtcacaccaccgttgatgggcatcgtcatctacaccgctggcctgcctccgtcgccgccgactggtgtccccgcctacacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtctacgtcttcaccaccggcctgcctccgtcgccgccgactggtgcctccgcctacacggctggcctattatgccgctgctgttgggcgtctacgacttcaccgccggcctgcctccgtcgccgccgagtggtgcctccgcctacacggctggcctattatgccgctgctgttgggcgtctacgtcttcaccgccggcctgcctccgtcgccgccgactggtgtccccgcctacacggtcggttggtcacaccaccgttgatgggcatcgtcatctacaccgccggcctgcctccgtcgccgccgactggtgcctccgcctacacggctggcctattatgccgccgctgttgggcgtctacgacttcaccgccggcctgcctccgtcgccgccgagtggtgcctccgcctacacggctggcctattatgccgccgctgttg

SEQ ID NO: 20556 - DNA, 591 bp, Oryza sativa
  unsure (1)..(591): unsure at all n locations
nnnnnnnnnnnnnnnnnnnnnnnnnnnnnnnnnnnnnnnccaggagccgggtaatccgtttttgcaaggtccagtggagcaaccacgccgaggaagaagctacttgggagcgtgaagacgagctgaaggcagcccatcccgatctcttcgccagtccttctgaatctcggggtcgagattccgtttaagggggtaggtttgtcgcgtcccaaatcgactctaaaatacatcctcgaaattgtgcatagaattagtaaaatccatgtgaaagcctccaacaattaaaatgtgcaaagttaaaagtcaaataaggcttggaggatttttgtatatttcctaaaagcctaaaatgtgtaaataaattttagtggaattttcagagcacaaataataattaagaagaaataaacaaagttaaaaaggttttataaaaagaaaaatcctaaaaagtctttccccccctttttcccttcttgggccggctcggcccagctccctccctctctctcctctcccccccgcggcccatccggccggcccccgcacgcgcgccgctgacgggcgggcccgaccgccaccctcgctgacggg

SEQ ID NO: 20557 - DNA, 3365 bp, Oryza sativa
  unsure (1)..(3365): unsure at all n locations
tagttggcacattaattaattaactaatcacgattgaccatcgtgaactatcattaagccatcattaaataatagtgagtcataagttgtcccgaatgtgtactaatgtgtcacgtcccaaaacgactctaaaatgcatcctcgaaattatgcaaagaataagtaaaatccatgtgaaagcctccaacaattaaaatgtgcaaagttaaaagtcgaataaggcttggaggatttttgtatatttcctaaaagcttaaaatgcgtaaataaattttagtggaattttcagagcacaaataataattaagaagaaataaacaaagttaaagtggttttgtaaaaagaaaaaccctaaaagtctttttccccccccccttccccctcttgggccggctcggcccacctccctccctctctctcctctcccccgcggcccatcggcctcctccccgcgcgcgcgccgctgacgggcgggcccgcccgccaccctcgctgacgggtggggcccacccgtcatcccatacctcgcgccgcacccgccgcctcgcccgtgccctagcgccgccgccgccgcggattccgccgcatcccgccgtccccgcgcgcaataaagagggggaaatcattccccgtgattccctctccctttcccccctacttttccctctctctctccctcggattcgtttggaaactctcccgcaaacttcgccggcgcatcaatggcggccggatcttccgcgaccgattccccctcatccggccgctctctcctcctcccaacactacataaacactccccgtgcctccctccttcgtttccgccactcgccgctctctctccccgtcggaatcgagctcgcgccgtcgtcctctctctccgccgtcgccgccgagctccggtccgccgccgtcgtcgccccgggcctcctcccgtttcggcgtcgccttcttcgggttcgccgcgtcctcgccgatctcgtccaccccttcgtttcgcccgccgaccgccggaacgccgccgtcctcgtcgacccgagccgcgccgccgccttcctccgcttcggtcgccgttcccgtcgtcgccgtcgacccggggtgagccatggaccgcccatttcgtttcccccttccctctcctctctcgggcgccgctccgtcgcgccggaggtcgccgccggcgaccatcggggcgcgggtgcgccgcctcccgtcggctgtgccggcgaggccgccttcgggcgcgccccgcggctgccatgtggggcccggccgtcagccgcccgtgtcctcgggtgcggctgacgcgtgggacccacggcgccgggccggcgtaagccgcgtgcacccggtccaccgtggaccgtgaggctgccgtgtgggccccactcccgtggacccagtccgcgcgccattccctcggctgacgcaataaatccgattttaaattaaaatttaaatgaagaaattcgcaaatattcatttaaagagcatataaacttcaaatggccataacttgaccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagacccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatctagccatgcctatttacctttgttatgaccttattattattgttattgttagtatttccttgttcaccctagattaaacaaaaccccaactagtggacactctactcatggtaccactagcatgattttaggtagatgcttcgctgtttaattaggtaacattaggtggttttacaactctagactttgggaatattcatatcacctggacactttggaactgttggattattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgagcaactaaatatctttaaatgctgtttactgcaaccctaacccctttatagtataactcctttgtactcccttgcatttattctgcacttgtgggtgtgtcttgttgagtacggtggttgtactcagtcttgctcaatttttcccaaacccagaagaggagttcctgcaggatgaaggctttggtgtctagctcgtgcctgccgtcaagtgcctgtggtcgtcgccctagtcttccgctgtttctcgtttgtctttgtgtgtgctgggccttcgctgcccatgtaataaattatctatttacgcttccgcttgttaaactctgaattgtatcaacttttggtgtaccttgcctcctgggacaaggattaatgcacgcacgcaaggaacacccgttgggtcagttccggtcgtgacaagttggtatcagagcccccttgaccctaggacgagccttagatcccgagccttagcaatatttnnnnnnnnnnnnnnnnnnnnnnnnnnnnnnnnnnnnnnn

SEQ ID NO: 20558 - DNA, 6926 bp, Oryza sativa
  unsure (1)..(6926): unsure at all n locations
nnnnnnnnnnnnnnnnnnnnnnnnnnnnnnnnnnnnnnnnnnnnnnnnnnnnnnnnnnnnnttgttattgtattatttctttgttcaccctagattaaacaaaaccccaactagtggacactctactcatggtaccactattatgattataggtagatgcttcgcttttaattaggtaacattaggcggttttacaactctagactttgggaatattcatatcacctggacactgtggaattgttggagtattgtggaattggattcacaccgccccctctattcaaaatccccaaaaatggtttaggctgggctcggggcgcatggttttgatagtagcacctcggccatataaggaccggtgttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtagatgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagtactagattcgtgtttgcaaaatagccctgagcaactaaatatctttaaatgctgtttactgcaaccctaacccctttatagtataactcctttgtactcccttgcatttattctgcacttgtgggtgtgtcttgttgagtacggtggttgtactcagtcttgctcaatttttcccaaacccagaagaggagttcctggaggatgaaggctttggtgtctagctcgtgcctgccatcaagtgcctgtggtcgtcgccctagtcttccgctgtttctcgtttgtctttgtgtatgctggggcttcgctgcccatgtaataattatctatttacgcttgcgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttggaaataaaaatcctttgtatttgtgaaaatcctctagtctctctctgtcttgctgcttcatttatcgccaaaatctgacctttaaaattttgcttttctttttgtttttgtttgtagatggccggcagcgtcagccgtcgtggtttggacatgactggcttcgtcttggagctgcggggcatgtgcgtggtcctggggtatccacatggagtggactaccaggccaggccatttccggagcaggagggtgacgatgcagagccccacgctgcttgggaggtcactgcagtgatcctcgctggctctcccgagcggacttcgctgacagtcaccgcgggtggggactccttccccgccgcttgccagagcgccgctctcctcgccatcggcactcttcaccagcgctacccggacgagttgcagcactcgccctaccgctaccaccctcgtcgcggaggagcccgcgactacgccaccttccgggacgctagctcggaggatgacgctaccatcgtgcacctggcgcgcatggtggaggcgtacgacgcggctcgtatcgacttccatcagatggtgcgtcgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgccgccgtgtctgccgcagccagaagatcaccgcccgcaagagcacctccaggcccgagcttgttcgtcagtccctggcgtggacttgcttcgtggagacccctcgtgccgagcccgcgcccgtggttccccaggagggggaagcctccggcgttggtagcacggaggatgcgctgttgctcaccttccgtcctggcccgtcgcagcagtagacgagcagttagtaggcttgcgcgtgtgttctttctcgtttgtcttcttgttgggttgtgtggggcagggttatgccggtgtgtggcataactgtgtcggagcctgtcttttttttatttgtttaagcaacttgaactttaatgaaccaatttaatagcagtaataaattcaagaattatggtagtcgtgggtggttagctttaattgtcagctctctctgtttgctggttctgtgtggggttttcagatggtgagaccaggagaaatgctggcaccagtgatggcaaccaacccgaaggcagcaaccacaacaaccatggcagcccaccttcacctnctnctncgccttcaccaccaccaccagataccaatgccattctcacccaaatcctcgcccagcaggccaacatgatgactgcttttctccaccacctccaaaatccgccacaacataatgctccaccaccacctccccaacactctaaactcgccgagttcctccgcatctgtccacctaccttctctagctccaacaaccccgtggatgcgttggattggttgcatgccgtggggaaaaagctagacactgtgcagtgcagcgatgaggagaaagtcatcttcgccgcccaccagctgcagggacccgcatctctatggtgggaccatttccaggctacgcagccagagggacagcctattacatgggctcgcttcacccccgctttccgaagaacccatgtgcccgccggagtcgtggcccttaagaaaagggaattccgagagttgaagcaaggcaaccgctccgtgatggagtatttgcacgagttcaacaacctggcccgttacgctccggaggatgtgcgggaagatgaggagaagcaagagaagttcctggcaggaatggaccctgagctgtccgtctgtctagtctccggggattatccggatttccaacgtctggtggacaagagcatccgcttggaagccaagcacaaggaactggagtcgcacaagcgccgcttggcgaatttccacaaccaacagggtgctaaccaaagggtccgctacaccaatccctatccagggggatcctcctcgcagcagcaacagcagcagcagcaacctcgctccgcgcctcgacctcaattcgtggtgcgcgtcccacagccgcagcaggagcagaatcaacaagggactcgtgcgccccgtcctcctccaccgactgtgcagcctggtcaaggccgcagggacgctcaaggtccgcagcgtctgtgcttcaactgcttcgagcccgggcactttgcggataaatgcccgaagccaaggcgtcagcaaggccaagcgcctccccgccccaacaacggtggtaaggacgtcattcggggtcgtgtgaaccatgtgacggccgaggacgtgctgacaactccagacgtcatcgttggtacgttcctcattcattccatccctgctaccattttgttcgactctggagcttcccactcatttatatctgtgccattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctaggcaccaagaacttggatgtgatccttgggatgaattggttggctcaattccaaggagtagtggattgcgcgagacgcactgtcactctgtaccgagggccgggacaaccggttgttttctttgcacccccaacctctgtcagtagttcagaactgcatcagataggtctgtcagaaatccccatagtcagagagttcggagacgtgtttccggaagaactacctggtatgccgcccaagcgagagattgagttccagatagatcttgctccaggaaccactcctctgtgcaagcgaccctaccgtatggcagcaaatgaactggccgaagtcaagaaacagctggaagagttgaaagaaaaggggtacatacgtccgagcacttccccctggggtgctcctgtgatttttgtggagaagaaagacaagacgaagaggatgtgcgttgactatagagctctcaatgaagtcaccataaaaaacaagtaccctcttccccggatcgatgatctgttcgatcagcttaaaggtgccactgtattttccaagattgatcttcgttccggatatcaccaactgcgtattcgtgatgaagatattccgaagaccgcattcaccacgcgatacggactgtatgaattcacggtgatgtcattcggtttaaccaatgcacccgccttcttcatgaacttaatgaacaaagtgttcatggaatacttggataaatttgttgtggttttcattgatgacattctgatatactcacaatcagaggaagaccatcagcaccatctccgtctggtattgggaaagctgcgggaacatcaattgtatgccaaacttagcaagtgtgagttctggttgtccgaagtcaaattcttagggcacgtgatatctgctaaaggagttgctgtggaccccgaaacagtgatcgccgtcaccgattggaagcaacccaagacagtcactcaagttcgcagtttcttaggtttggcaggatactaccgaaggttcatcgagaacttctccaaaatcgctcgacccatgacacagttgttgaagaaagaagagaaatttgtgtggagcccgcaatgtgagaaggcgttcagaactctcaaagaaaagctggttgcctcgccagtgttaatcttgccggatactcgcaaggacttcatagtgtattgtgacgcttcgcgccaaggattggggtgcgtgctcatgcaggacggtcatgtggtggcctatgcctcacgccagcttcgacctcatgaaggcaactaccctacccatgacttggaattagccgcggtggttcatgctctaaaaatctggcggcactatctcattgggaatcgctgtgaaatatatactgatcataagagtttgaaatacatcttcacccagtcggatctgaatcttcggcaaaggagatggttagaactcatcaaggattatgatgtgggaattcactatcatcctggtaaggccaacgtggtcgccgacgctctaagtcgaaagagccattgcaacactcttaacgtccgtggcattccaccggaacttaatcaacagatggaagccctgaacctaagcatagttagtcgtggattcttggctgcgctggaagccaagcctaccttgctcgatcaaatccgcgaggctcagaagaatgatccggacatgcatgggctcctcaagaatatgaaacagggtaaagccgctggtttcacagaggatgaacacggaaccctatggaacggaaatcgggtatgcgttccagatatcagggaacttaaacagttgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagcacggttcattcccgtaaagaccacctatggagggaacaaactagctgaactctacttcgctaggatcgtaagtctgcatggcgtccccaagaaaatcgtatctgataggggaagccagttcacctctcacttttggaagaagctccaagaagagctgggtacccgattaaacttcagcaccgcgtatcacccgcagacagatgggcagaccgagcgtctaaatcagatcctagaagatatgcttcgcgcatgtgtcctggatttcgggaagacctgggataagagtctcccctatgccgagttctcctacaataacagctaccaagccagcatacaaatggcaccttatgaagcgttgtatggacgcaaatgccggacaccgctattgtgggaccaagttggggaaagccaagtgttcgggactgatatcctgagacaagctgaagcgaaggtcagaaccattcgggataatctaaagatggcacagtcccggcagaaaagttatgcagataaccgtcgccgtgacctggaattcgcagcggatgactttgtgtatgttcgggtcacgccattgcgaggtgtacacaggtttcggacaaaggggaagctcgcacctcggtatgtgggtcctttccgtatcactgctcggcgcggagaagttgtcacgaccggaaataacccaacgggcattccttacgtgcgtgcatta

SEQ ID NO: 20559 - DNA, 3180 bp, Oryza sativa
  unsure (1)..(3180): unsure at all n locations
gacactatagaatactcaagcttggagatcactttttgtgaaagaaattcttctacatatgtcccttaaaacaaattgtttctgattggttaaaaactttatagtctttgtgtggtttctttcctctgtaattttgaaaacattttttgagttctataaaactacactgctgggcaaagtcctggcagtatttctagtcaaaaaaaaagttgtcttacctagcataataaagtctaacctatttttttggtattttctattttgcaatttttatgttgtttttagtttataagatgcaatgaaaataaaacatgcatttggaaagggaaacatgcaatgtgatacaagttacctcagcggggggagagacgtctcccaccaagcttgcctttcgctcagggtccttgataaggattgaacccctggaagcgaaagtacgcttgaaggtcgtcatgctgttgctgcatcaggttgcgttgttggtgttggtgaactgagcatcaacattcggttgtcattcttgcgtctgtgttaagtgttcatcgagtggggggtacacggtacccgggtacccaatgacaacccttgggccacactgcatggggtgggccaagtgtcctaggccccatgcgtcatacttgtaaataaagaaagagagattcccgggataagatataaatcccgaggatcctgcatatcttttatagatagaataggttgatctagttgcaatcaactagatactttccttgtaaccctccccctcatcctatataagagggggaaggggtccctagaggaggtcgaatcatctccacgactcttctgtctagcttctccgaccatttttccactatacacaagaaagaacacactggacgtacggtatttcctctctcagagggcttgaaccaggataatccctgcgtcaccatctctccttgatctagcgcacctcttaaaatatattgccgatcctagaaatcgacatcgaggttgtattggatctctcccgtttgcatgtcaattttatccatcctccttgtaatttctcccaagtcctaacgagaggaacttgagcaccattcaccattcattgggggatgaaggcatactgcttgatctgagggaatgaatgttcatgttccccagtgtatgtcatgagatgctctctgtcggctctcgctggcactcttccagaccgagcctctgaggctatggtgtagagcttgggtccatccgggtgcatccccagttggttcctaaccggcttcgtacatttgcacggatgttgaaccttcttgttcatttctcgccatgttgcgtgtgtccctatatgatccacctgcacaagattcttctatggtctatacgggaatggttagttcatgacagttgtacaaatgatatcccgagttaggtaatgggattttttttgtacaaccggggaaaaagaatatcaaagatccatctactccatgcttaagaatatgaccttgcactaaataattctcgtcaacacacggatgaggggttgaaatataagcaatctgatcattagaaataaccccaagtctgtatgctatgctagtaattagggaagtgcactcaacaggagcagtaaactttatactctctaaccattgcacatttcacaggagcaactttaatcttcctaactgtgacaaacatgataatcaatttatcctctcttataggcctaagatcacctctaggaaacaaagtcataacaatccatttgtgcataagcctaagtgtaggattatggatgtcattcgttctaggtttcttgcaaattggaccaccagaaatattttcccaaaatctgtttttctcgaacccagaaattccgaagaacggttttatagtcatcgtgaaaacaaagaagtgtacttaatcatttccatgtaagtgtaaattctttacggaaaaagcgaaaggaaattccatcttctatttctttcaaagtgtaccgaaattgtaaagtaagcaaacgagaaccaggctcatctgccaccgcaaatctctgccatccaacaactttccaaatggtatgagaattaacatccatacctatcttttttagtagctccggatcgtatgcccgcgtgtgagcaaatatctgatcctttagcatgtagtaggcttgcatctcctgatcaccgacaagatcgaggtcagcatcgttcaagaggcatggcgggatgccagttgttggtatttcttacgatcacagatagaatccgcaagcgcatggatataccgatgtaggactttccctacggagtatttcaagggtatcgaatccaagggaacgtgtgtgattatctcttcctccggttcatcaaggacataagataaatatgggcacagggcagagaggatttcttagtgagaaaaagtgtccaaggaaagcttaattttaatcctaacgcgatacttcaggcactagcaactcgctgttcctagatgtcgctctactatgtacccgcacagggaggacttaagtgctcttgagggctatcaccacctctacacccacgtctaacgtattgtgggatacgcagcaagtactggaaattaattatccagacaccgtgtctacgcaattaataactactctagtgctagctaaagactaaagcaatcactatataattaatggactatagtgaacaataatcccatatgctaattaggaactaacgaagaataattctcgctaagcaaatcttaattactcagaatgatatttctattgaaccagagtaattaacaaagtacaagaataaagagaggattatcgacaactctgggattcctccgacttcttctactttactctatccctattctaagtgtactatagaacatataatgaacctaaagtatacttagagcctcttgtaattcagctctacgtcttggtgtgtgttggaatgagggagaggagctctatttataggcttcatatgatagttacattatgggaaatgtcccaaacaccatccaaccatcattagggagcaatcctggacgcccacatggaaggctgggatgaattgggcttcatggcggttcagccgaaccatgggctggcccaactgcctccggccttctnnnnnnnnnnnnnnnnnnnnnnnnnnnnnnnnnnnnnnn

SEQ ID NO: 20560 - DNA, 3503 bp, Oryza sativa
ccctaccactatggttgatgttttacatttatggttttatgcaggtattgacggcatatattttgtatttaacagccatcaacaaaacctcccacacttagctctttactcgttccgagtaatggttaaggatgaatgtggaataaaactttccaagatataatacaggtatacaatttattctaagccatacaagtacttgtgaactttccagtgtctaactatccatcttgggtaattgatgaatggaactgtcgtggctcaagtccttcttgttcctcctgtcaatctcttgggttttcatatattttttcaaagtagatatactcctcgaatgactttctctcaagtctctcgtgtggtttgatttgtggattctcaccaaggcatattttgctgaattgtcccaattctacaaggttgtatatgtggagcttggtagggatcaatcggggcatacctgcatcacatatttcaccaagccaaaagaccagacctaaggagatcgcaagtcatactctctgatcaagaatgtgcatgtgtgtgatatgtgtatggttgttttgtgggtggaaaaaggaaaaataaatgataacaactcctttgatatacctcctcctccaattttctctcattgtccaatttgagagagtgcatggctatccgtttttttcttcttttttttttcattccccatactttatatgagcaagattttctctctcttttttttcttttcaatgctccatttttctatgagcaaaaatttatttttctttattttgcgtagccatgcctctctctctcttttttttttgaaagaattttggaggatgaggcataaatgacatggagtatttattttgtggataatggataaaataaatgatggacaatggatgctagcttccagtgtagaaatttagcttacgtgcttgtaagtttagtgtacgtgatcttgataatgaaagtatcaaaaagcatctcacatgggtcacaataatttgagaaagctcaatgtaatgtcagtcagcctatacatgtaatgttttgcaatgagaatcatatatggccttggtagttaataatatagtcgctgaggagtattgccttgcaatgagaatcatatatgactgctgaattttgtgcgcggccataggctggtgttcatcacagtgtcatgttgagtcgatgctgttgcgcgtcgagagttcgaaaagactcccccacacttgtgttgtggcttgtctttattcaacaaaaaggatggaaagcaaaataggcttctaccggggtaaaatatcggtgagccaaattttatttaagtaactctaggcgcatgaagtgcctaaatttacttttattttatttcacttttattttgtttttatttttattttcattttataatttttatagttttatttttatttttattatggcatcaattgaggtgatgggtaacttagcagggtggacatatgtgaggcgaggatgcacgaggtgtttcgaattattaccagataggtcttaccaagctttgatttggatgcaagaatacagcacaactttgcatttgttctgcttggtttcctaagcatctgtcttctcatagactaaggagcgtggtatgaatgttggagttattttacactactcctctattgtcttttttatttcctgcaaaaggttagtggataacaaatacccgagggacaacaaaaaattgaaaagattttatcatagcctgaagattaattgttcacatccatgctaacaaggaattgaattcttaataagcatggatcccacaattttgccataattttattttgtcatcatctttttttctttttactccagagacacatttttttaatcgagagacgcttcttttattctttgaaaacaaaattttcttttttttctctttctttctttcaattttttttattgttcaccaaattttcatttaagcaaaactcatacagggctaaggtaaatttgcatgaacatgctaaaggagcaattagaaatatgcgcaccgtacaccttgataggtgatatgtttctcctttttatgttagcaactgatttttctcctagctctgtcttacctccagtgtgactcgtgcttgaggactcgctcgtcaatttgaaaaattccctgcaggggttagttcacgaaggatatacatccgaagtccatgaaagtactggacctacggttcatttaagcaaacttgacaccacgtcaactttaattaaagaaggctatttatcctaagcatcatgcttaattttaaaaagcctatgaatgtcgacgaccacccaaaccatagcatacgaaaatggactgaggacgcataaccaggtatgatcaagccaaactcatctaaagacaagtatgtgtaaaagaaatggtgaatcatttgctgtcttttgtataccttaccgccggcatgatgcatatgttgaaatctctggagcggtagcatgatcacatgtgattgtcgatctctcctccgtcttgatgcgggttgtggtggaggaaggcactttgatcacgccaactcaagcgagtgcttcggttatgcacacatctcaggtgcaagaaccctttaccttgtgttggacgagattttgtgcattttttttaagtaaaactaaaaatcatgaatgtgccaatcgaaggaacaaacaaacaagctgtgtgcatttcccacaagttttcactatatgcgtaaattccatgattagttaaacacggtaattagtcttaactgaagtgattactgacaaggacgcacaaatgcaccagaaagtaataggggttgcttgtctgacatctttatcagtgccatatgcatctatacttgatcacctgggttcacaggtcagcctgatgatgaatggcaatatatatgggacaatcgatcggcagctatgcatgctctctgctggtcaatacaatgtgtatataaagcaaaatggaaacacacacgatcccattccatgctagaaaattttggaatggaagcattccatcacaatatcctctttgaaaagctgaaattgagctatctagcctgaaaattaattttcacaaaagtgaattattttgttttggtcacgcaaaggattattatgatcagtattataatatcttcggttgtaagttaggtaacttccctgtcaaatatctcggtattccaatgcattttaaaaagcttagtaacaaggattggaaagttattgcacaaagaattgaaaagaaacttagtagttggaaaggtaaacatatgtctgtcggaggtagattggttttgattaattatgtactttcaagtttagctatgtttatgatatccttttttgagataccaaaaggggttcttaaaaaaatgattattatagatcacgcttctttttgcaaggggatgatcataagaaaaagtaaaggcttggtagatgggatattatatgccaggccaaagatcagg

SEQ ID NO: 20561 - DNA, 7305 bp, Oryza sativa
cttgagacgacggttatacaactttttaccaactatggatggagattcacaaataggcttcaataaatgtgtactccttatcctattttggttattttacttcttaaattggtgtcctatttttttttttgaactttacttgttttagagtgttagtttgtaataattggttgtagctcttttgagcaaaggccgggatgatctattccattatctaaaaaaaatcctctttagttggatagttatcgggctctaactcatttggaatcaacagtagatttcgaatatgcatttgcatggaattaaaataaatacggtggataatattgttttggccaaagatccttgctatatatgtccgcgcggctgggacgcgcgtgtgcatacaaatacaaggaaatgctctctttgcgccacagtcgattggaaagtgatcgcacatcaatggatctctgatacggccggatcgccactataaaacaggccatttccttcacggcggggggaggcagcagagagagtacagaggcacgagccgagggcctgcagttcacgccgccgctgccgccatgcccagccttggcagtagtccctagagagacatacacagagacacaggagagaaacacagaaacacaaggacaaggagagcggacacaggctgctcatcggcaaccatcacgcacgtcgtcttggccggagtatctcggcgtcctgcgggaacgagcgtgctctgcggccggcgacatcggctgccgtacctcggcgtccggcaaggaggcgcgtgcgctgagccgctgaggaagcgcgctaaggaggagacgatcaccagggagacgatgccgctccagttcactgccatgggtaactagcctattttcttatcatccctttgctccatttcagcgcatgcacgccggtatgaagctcctcagcagagaagatgccggatgcaccgccatcgtcagagtcgccagagttgacgtcgtctgcaagtctccgtcaaggtgaagacgatgtttctatatggcgcggcgatgttgaagacgatgtttctatatggcgaggagatgtcgccgagatgctcggacgtcgtcaccttgctggtcggcctcttctctgcaacgccgtcgacgtccgctccccctcatcaacgctgctatcttcttcacattcattgccttgctgcctgaagagaacgccggccggagcaccactacttggtgcctgcaaggctattggattgtaatcttagagcatttatattctcttttgtttcgttgcatgtagagttcggttggagtctgaattctagccggtagaatagcatttttctgttttagcatatttgcttccttctttagctgcgttgactcggctcggatcgtgggatggcgcggtcagtagttgatccgagattgtcgtgatttgattcttttatgcatgtaacaaactccgtctggagatgaataaatagaagagaaaaccgaaaaagctgcactgtattacgcagtgccaactctgttcgtcagttgttctgttcgactctgttttttcggaacttcttcagttagctgtagctgcacctacaagcgtcagagtgtgtgtttcagagagactgagagccagttcgcatgagttttttctgacatttggtatcagagctttgctgagacgatccggtaatgtcatacacaccgcctggccgtcgtggtggcggtggcggcgggggaagcgacaacggctgcggcatcactcccgctagtcgatgcagggcacactgcccgtctcttgatcctgtcgaggacaaattatatagactgagcgctgttgatgcgcgtcaacctgcaggcgcaggggctctggacggccatcgatccctgctatgcggagtaccgcgaggatcgtgcagcgctctcggcgattctccaagctgtgccccgcgagatgttgcgcggcttggcaaagcacgacacggcgaaggcggcgtgggatgccattaaaaccatgcgggtcggtgtcgaccgcgtgagcgaggcgagggagcagggattccgccgtcagttcgaggcgatgcgcttcaaggacggtgagacaccggaggaatttgcgatgcggctcactgccatcgttgcggacatgcgcaacatgggcggagtcatggaagacgaacacatcaacaagaagctgctgcgtgttgtccccaagaagtacaagccggtggcaatttccctcgagcagctcctcgacgtgaagaccatggccctggaggagctcatcgagtggctgtcgacggtcgactcctacagtgatgatgaggaggcaagtgacggtggcaaattgtacctcactaaggagcagtggcaggccggtgtcaagcagcgggagtaggagggatctggcagcagcaacaagggccgggcgggctctggcaaccagaaccgtcgaggcaaggccggcgattcaccgaagggaaaggagatggccaccagcggccatggctgtcgtgacatctctaaggtgaagtgtttcaattgtgatgaatacggtcattactcgaagcagtgccgtatgccgcgtcgccaatgtcggggagaggcaaatgcaaatctggtccaggctgaggaagagccgactctgctcatggcacacgtgatgggggtgtcgctcgccggcgaagcggccgttggtcgaacaccttgtgtgcaggaagtgcatctcacagagaagaaggttgtgctggaccatgaggatgggcgtaaggaggagaagactggagagtggttcctggacaccggggccacgaatcacttgacgggcgcacgctcagcgttcgcggagcttgacactggtgttgtgggcacggttaaattcagcgatggctcagtggttgacatctaggggcgcggaactgtggtgtttcagagcaagaatggtgatcaccgctcactagaggcagtgtactacatccccaagctgagaaaaaacattgttagtgttggtcgcctcgatgcgcgcggctacgacgcacacatttggcatggtgttttcacgttgcgtgacccggaagggatgcagctagctaaggtaaatcgtgattcaagttacctgtatgttctcaagttgaaccttgcgacactaatctgtatggcagcgagcggctccgagctagcatggcgatggcatgcacgatttggccatctgaatttcctggcacttcggaggttggcaaaaggaggcgtggtccgcaggatcccgcaaattgatcacattgatcagttgtgtgacgggtacctcgcgggcaaacaacatcgcacaccgttcccagaggaggcgcagtacagggcgcagacggcgctcgagctggtgcacggtgacctctgcggaccaatcacgccggcgacgacagggggcaagaagtatttcttgctcctagtcgatgacatgagtcatcacatgtggatacgactcctctctgccaaacacgaagcatcggcagcgattaagccggcgtggagaaggatagcaatcggaagctcatggcgctgcgcactgatcgcgggggtgaattcacctctatagagttcatggagtactacgcggacacaggggtgaaacgttaaatcactgcaccctactcacggcagcagaacagtgtcgtggagcggcgcaatcagactgtggtggcagcagctaggtccatgctgaaggcggcaaacatgctggcatatttctggggagaggcggtggttgcagccgtctatgtcttgagcaaatcaccaatgaagagtcttgatggggtgacgccgtatgaagcgtggtatggtcgccgacccactgtcgaacacctgcgtgtgtttgagtgtgtgggctatgttaagacagccaagccaaacttgagaaagcttgatgatcgtagcacgaggatggtcttcatcggctacgagcaaggatcaaaagcctacaagatgtatgattttgtggggcgacgcgtgtgtgtgtcacgcgacgtcgtttttttatgagacgacgttctgggactggggcagcaacactgatgaagaaggagatcaggacgcgtatgtggagtttacggtggagaatttcacaatcccagtccaagggagtgagacacatgcccaggatgcagcagccactccaaccatgctagcaacatcaccaacatcaagcaccggaactgcaacaactctgccatctggtgttgaattctgttcccctccaactgatgctagtgaagggactgatgaagggcccaggagctacagaacagtggtgaacacgcttgccaccttgaccccaatcctagattttaattacagtgatcaatgccttatggcagcagaggaaccagcaagtttcttggaggctgagcaggagagctgctggaggaaggccatgcttgaagagatggaatcaattgaaggtaacaacacctggactctctatgatttgccctctagccacagagcaacaggactgaaatgggtttacaaaatcaaacgtgatgccaaagatgtcattgtgaagtacaaagctcgattggtggcaaagggatatgtccatcaacaaggagttgattttgatgaagtatttgccccagtgacgaggatggagactgtgcgattgctgattgcaacggctgctcatcagggatgggaagttcatcagatggatgtgaaattagctttcttgaatagggaattggaagaagatgcttaggtggttcaaccacctggttttgttgttgatggaaaagaagacaaggtgttgaaattgaagaaggccctatatggactgaaacaagcaccacgtgcatgttatgcgaagttggattctagtcttgtgagcctgaattttgtcaagagtggtgtcaaaagtgctgtgtatactcgaggagagaagaactcatgacttgtggttggtgtatatgtggatgatctcattactacaggagcaagtctgatggaaataaacaagtttaaggagcagatgcaggctctttttaaaatgagtgatctcggtctgctctcttattatctcgggatggaggtgaaacatgcaaaggaagggatcacagtgtctcaaggtgcatatgcagcaaagatacttgacaaagctgggatgagggattgtaatccatgtcagactcccatggatgctcggttgaagttgagaaaggagggaggagaatgtatggaggaaactcaattcagaagcataattgggagcttgaggtacttggtgaacacaagacctcatctaagttattcggttggttatgttagcaggtttatggagaaaccgacctctgaacattgggctgccatgaaacatatctattattatattattaaaacagccttgaaaggaggcaccacgttcgctgtgggggctagaaattcccacattaatcgaagaaaaagaaaaaaagaaaaaggagagtccaagtagaagtctaatttaaaaatacttgaaattcggaattaaaaataagaaatattgaaagaagtttccatataagaacccaatatgagattaaccaaaatttaaaataaaaaaaataaaatctaaaattagaaaaggaaaggagagtccaagtagaagtccaatttaaaaatagctgaaattcgaaattaaaaataagaaatattaaaagaagagtccatataagaacccaatacgagattaattaaaattcggaataaaaataaaaaaaatccgaaattagaaatggaaaggagagcccaagtagaaatacaatttaaaaatagctgaaattcggaattaaaactaagcaatattaaaagaagtgtccatataagaacccaatccgagattaaccaaaattcgaaataaaattaaaataaaatccaaaattagaaaaggaaagaagagttcaagttggaatacaatttaaaaatagctgaaattcggaattaaaaataaggaatattaaaagaagagtccatataagaacccaatacgagattaattaaaattcagaataaaaataaaaataaattcaaaattagcaaaagaaaataaaagaagagttcaagtagaaattcaatttaaaattagctgaaattcggaattaaaaataagcaatgttgaaagaagaatccgtataagaacccaatacgagattaattaaaatttcaaataaaaaataaaataatatctaaaatttgaaaaactaaaagagagtttaagtaggaatacaattttgaaacaactgaaattaaaaataaaaaaaataaaaacatttaaagaacacaatacggtattaactaatttttttaaaaaaataagttctgaaattagaaatgttaataaaacaacaaatagaatcctaatgacgattaaaaggagggacgtcaggcaggctgtgaagcaaacaagtaaggcggttgccgggacttctagaaagtaaaaaaataaaccccattgataatcatattcgatttttaaaatttcaatgacataaaaggagaagcagcgggcgggcgtataagagttatagaaaataaaaaatgaatttcaacaatagttatgttcgatctttagaatcacaatgacaataaagagtaggcgacagacgggctgtagaggggcatagtggcatcgttcaaattttaaaggatcggaacttccaaaaagtaaaaaaacctaatgataatcatgttcgattttaaaatctcaacgacaataaagaaaggaggcagcgggcgagccgtagaagagtacaatagcaaagccgctgacggtttgacgggacttaaagtaaaaatgaacccaaacgataattatgtttgatttttaaaatcttgtcacgaccggaaataacccaacgggcgttccttacgtgcgtgtattattccttgtccgaggaggcaaggtacaccaaaagttgatacatttcagagtttatcaagcggaagcgtaaatagttaatttattacatgggcagcgaaggcccagcacacaagaagacaaacaaaaaacagcgaaagactagggcgacgaccacaggcgcttgacggcaggcacgagctagacaccaaagccttcatcttccaggaactcctcttctgggtttgggaaaaattgagcaagactgagtacaaccaccggactcaacaagacacacccataagtgcagaataaatggaagggagtacaagggagccataatataggggttagggtttgcagtaaacagcattaaaagacacttaggtgctcacagctattttgtaaatatgtctctagagctatgcaata

SEQ ID NO: 20562 - DNA, 5017 bp, Oryza sativa
  unsure (1)..(5017): unsure at all n locations
nnnnnnnnnnnnnnnnnnnnnnnnnnnnnnnnnnnnnnnnnnnnnnnnnnnnnnnnntagtgttgattttactggaggtaggtgtatgtacctagtttccattttctttggttgcactcaaaaattatggatagattactcacagaaattagaggaatatgggttctttggaaactagttcgaatttttaggagccctaaacagagaagataaattctgaaaaaattatttttattaatgataaatgacctagtatttgaataaattattttacttatacacttctatgcagttaaatgcacttttagataaagtatggttttagccgattaagaactacagttaatctagtttttattagtttgactgatttatttgaggtgcaaatttagttattaaatcataccaaaattacagtgagttgtatgtgttgagtagagcctacatgaattttcccatgattttatcttgcacgaattattttagataattctcaagatttatgtcttatatgtgtttccctttcctaaatgcatgtaaatgtttataaaagttatatttggactctcattaacctgaggtgataatgatatgttagaatttcagtttaccttacacaggtcataagctccttacctattatgcacaagtttactttagtattaaattaagagaatgcttatagagatgattaagatagaatatatcctatatgatataatttatttggtcacttccatgttcatgactagtcttcagatggatgaccaaaatagttttgtggggcttggcattggccttgttgatatattttaaggtgtatggttcctattttaacttcctctagctagcactaggccctaatggttcagttgtttatctagatcttagttaatattcatgagacctattatgatatgcaaatcgaaaatccgaatgcaatccaaatccaaatgcatatgaaggactcaagtcaaacatgtctatgagagtatgcatgcttacacataaatttatatttttgtcctaggttagagatgcaaaggtttttaatttgttctaaaattttatcatgcaagagttagatcaacttcacctaggtttaaaatggaaatttttggtttacaaaatagaagaacttccctttcaactagttttgatggaaattccttaatcctagaattcaggtatgttacagtattccggggatcatcaaattcctatccatccggaggaccaaagtaagactacgttcacaagtccgtacggtacctatgcttattgtaggatgtccttcggactatgcaacactcttgcatcttttcaaaggtgtatgatgtctattttctcggacatgatcgaggacattatggaggtcttcatggatgacttctctgtctatggaaagaccttcggtcattgtctgcagaatttagacaaagtcttacaacgatgccaagagaaggacctggtactcaattgggaaaagtaacatttcatggttctgtgaagggattgttcttggtcatcgagtgtcccaatgaggaatcgaagttgatcatgctaaaattaacttaatagttcagcttcctcctcctgtgaacatcaaggggatccgcagtttcttgggacatgccggcttttatagaaagttagtggaaatggaaggttcgggttgtgtctcgattgttgaaggtttctctatcttggacacggatgcctctggatagggctaatcagattgtgtcatgaaggaagtattttctagaatgcgatctagaattacttttccttccgacggtgttttgtgcatgaatgatcctccgacggttatgtccagatagaatgccgattccttatccagactcgtatgaaaatgttgcaaaagcacatactcaggaaaggaaaaggttggtccggactgcactaaatcagtgaatatggaccaggctgcaccgatcgattcgtttttgatctgctggaaactgaggatctctactcgaagggcaatgatacgagtaactgggaagaaggcaaggcagaatcggtcacgcaaatatacaccaacacttgtggattatgtgagattaaacacctattactatgttcgatgttttattatctagactttatgcagatgttggcgatatagaatcagcatttaataaccgccaacatggacgtccaggattgctccataatgacagttggagggcgtttaggacatttcccatacaataaccgtcatctgaagcctataaatagagctcctctccctcattccaacacacaccaagatgtagagctgaattacaagaggctctaagtatactttagcttctttatatgttctatagtatacttagaatagggagagagtaaagtaaaagaagtcggaggactcccggagttgtcggtaatccactccttattcttgtacttttttaattactttggttcaatagaaatatcattctgagtaattaagattttcttagtgagaattattctttgttagttcctaataagcatatgtgatcattgttcactatagtccattaattatatatttattgctttagtgtttagctagcacaagagtagttattaattgcgtagacgtgttgtctgggcaattgatttccagtggttgctgcgtatcccacggtacgttagaggttggtgtagaggtggtgacagcgcataagagcacttaagtcctccctgtccaggtacgtagtcgagcgacatctgggaatagcgggttgctagtgcctgaagtatcgtgttaggattaaaattaagctttacttagacactgtttctcactaggaaatcttctctacctttatccatatttatcttgtgtcattgatgaaccggaggaagagataatcacacatgtttccttggattcgatacccttgaaatactccataggggaagtgctacatcggtatatccgtgcgcttgcggattctatctgtgatcgtaagaaacaccaacaagcatttctggcgcctgtccatatttttctattcttctacgttcaccctgctctatccgaagaagtttcctggaatacacttcttcctcttctatggagcaacctatctttgaattatctgctcatagggatgaattttatgagtgtcacgaccggaattaacccaacgggcgttccttacgtgtgtgtattattccttgtgctaggaggcaaggtacaccaaaagttgatacatttcagagtttatccagcggaagcataaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacctacaagtgcaggttaaatgcaagggagtacaagggggttataatataaagggttagggtttgcagtaaacagcattaaaagacacttagttgctcaaagctattttgtaaacacgattccagagctatacaatattattaaccaaggccgtgaacccacacgaacctgccttaacccaaggcctacaatgattcagaccgaactggcaacccgaccctgggtcccagcttgtcccaagccaacccagggcaaccattccacattttagttgttaagcaggttttaagaattaaaacactaacttcggtacattgctcggcttgcccataaccgagggcgcggctattcgaataggttatactctgatcagaggtgtagatctttacccacaagacacatcttcctcacatgtaaccacgtgccacataccaccatggtatacagacggaagacatgacatagtttccaacccatcctagccatagacaagagtaccgacccaaccctacctacggccggaacctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgggtacttttgtttataatcaaactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataattgaaccattccataatgtccaggtgatatgaatattcccaaagtctagagttgtaaaaccacctaatgttgcctaattaagcggcgaagcatctacctaaattcatactagtggtaccatgagtagagtgtccactagttggggtttggtttattctagggtgaacaaggtaataataacaatagcaataataataaggtcataacaaaggtaaataggcatggctaaataaaacaatgataacgcgggaatttaaataaagcgataatgcaataatttaaatcaaaataattttataaattgggattcaatatgttcaaggatgatgtgactttccttgctccctttcccaaacgtcggcttcaacctccacgaagagcggatcttccgaagctgcagcgtctacacgaccaacagaaaagaaaaggcttttactctaataaactccatataacaagcagaaacaaagcacaaaaatgggttcttgacttcttaaggaaaaattagagacttgaatggtccaattccgagttcaaatggccaagttatggccatttgaagtttatatgctatttaaatgaatatttgcgaatttctttatttaaattntaattttaaaaaggtttattgcgtcagcccggggggaaggggtgcgccgacccggt

SEQ ID NO: 20563 - DNA, 7108 bp, Oryza sativa
agggagatgggccgacccggcccaaaggagggaagggggacttttagggtttttctttttttataaaacctttttaactttatttatttcttaattatttttttgtgctccgaaaattccactaaaatttatttacacatttcaggcttttaggaaatatacaaaaatcctctaagccttgtttgacttttactttgcacattttaatttttggaggctttcacacggattttaattattctaggcataatttaaaggatatattttagggtcgttttgggacgtgacaaatctcaatgacaataaagagaagagacagtggacgggtcgtagaggagtataatcgcaacgtttgacgggacatctggaaattataaaaacgaaaccctatatgacaataaactctaaaactataaaatccaaattttaaaggttccagaaagaatgaatagaaatagtgatagatcgagtaagcaaataaagaaagagatgacataggaggtagcaactggtgtgacttttaaaaactatataattagaaacacgaggatgatactggtgtaacttttaaaaactatataattagaaacacgaggatgataaggtttggtctttcaaagtcttaagacaatgagatagctatttaataaattttaagtagaataatactaaaaaatatatgattttgtttgggtgctagccgcgcaattgcgcaggccacccaggtagttttgaggtatgtggcaggtactctgaatctcggggtggaattcagaaagaagcaacaacaggttcctcagctgaatggctatagtgacagtgatatggctggggatattgatgatagaaagagtacaaccggagttctatttaaattgggagacagtttgatcagttggcagtcacaaaaacaaaaggtggtagcaatatcttcgtgtgaggctgaatatatagctgctgcaactgctgctgtacaaggagtgtggctggctcgaccaataggtgagttggaaggccaagaacctggttgtgcactgatcaaggttgataacaagtctgctataagtctcttgaagaatcctgtgcttcatgatcgcagtaaacatattgatacaaagttttatttcatctgggattgtgttgatcagaaacgggtggaggtggaatacataaggttagaggagcaacatgcagatattttaacaaagcctcttggtaagattcgatttttggagttgagaggcaagctgggattagttccagtctgatgcttcaagattagggggtgaattgttggattgtaatcttgagcatttatattctcttttgtttcgttgcatgtagagttctgttggagtctgaattctagccagtagaatagcatttttctgttttagcatatttgcttccttctttagctgcaatgactcggctcggatcgtgggatggcgcggtcagtagttgatccgagattgtcatgatttgattctattatacatgtaacaaaatctgtgtggagatgaataaatagaagagaaaaccgaaaaagctgcactgtattacgcagcgccaactctgttcgtcagttgttctgtacgactctgtattttcggaacttcttcagttagctgtagctgcacctacaagcgtcagagtgtgtgttttagagagactgagagccagttcgcgtgagtttttttctgacaaaggcgtcattagctctggttgcgtcttgagccatctcgttggagttgccgttgtcccgtggacgccgctaagccgcccaaatccatagacgatgaggcgttgccaactaacgcttgtccccatcaccatccgatgcccaccggagaaggccattctcaggttgccaaggggttggttgccgatacccggaggtcgttaacatatcatccacaagccgcgatggtattgtcagactatatgtgccggcacctgtcatgatgcagccttgctgggcagagatgccccacaaagactactaatcggtgacgccctctgtcccccacgctcatcgtagcctctgcgggttgccgccgatgtctactaaatcatcctcgccaatgctatgatcttcctcatgttataattgtcgagccacctgagaagaatgccggagcgccattgcttggtgcttgcacgatcgtcgccaagtccagccatgatcccttcgctttagctggctgaggtcgtcgtgccatccttccacgacgctttcgcttcggcacgtcgggatcatcctcatacccacaaatacggtgtcatgctcgccggtcttgaccgctcgatgacaaaatctttatatgtacaccgccatcgacgatgattgccgaatcgttgccgtcgccgatcatactctcagacccgcaccgccgaggcgtcttcatgattgtcatcgatgccggtgatgcgatctcgtccacaaacaggacgtatcctcgtcatcttcaacgatcattggcatacatttatccttgcggctatcaccgatggcgaacctgtttctggtcatcatcgcccgcactgattgtttctccgccaatgacaagcccgttcttgtcgtcgttgccggtaccaatcgtgcattcgtcgccaacgtgcaagtttggagccactagctgttttcacgaacattcttggcatcaccgcgggctggtaatgacctcgcgtccgtctcacgctgtcgtcacgctcgacgaccccggctgtccaatgacgaaattcttggatatatatacatatatctatgcatatgcaccaccgtctctgctcgactgctgccggcgaagatcttcaacttgtcgctgccactggcgtcatcatcacatgaatcctcacctcgccatctagtgatcacgagttcggcatccccaccgatgtctctcactccacaacgcccatacacatgacgtattatttcgtcgtggccgtcgtcggtgcactcccgagttaagccactacgatcgtaggcgacccaacaaaatttgggttcggctccgattgtcaggcacatatacaagagggccacccagttcctagaacgtatctcatcgttgccgggttaggctacgcccctaacatcccctaaaatcacttaatcttgagtgtgcagtgcaatgatcggaaggcatactcctgtaccacaatgatcttcagccattgtgctagaaaccagaaaagcagcgctatcccgagtgtcacggtgattggtcgactgaaggccataccaacatgtacctctacaccgagccagagacctaccgcgacgataatcgagcaaaacgattggtcaatgttctctcccaattattctcccactattgacatggcaccaagacggtcaagaagagttgtaccagcctcctagtgcttacaaccaaaaaacctatgccaactacatacgctttttaagactgatgaggctaaatggcacggacaagtggagtctatatgaagtcgatgtcacctacaccggcgcacggaccgacgaggccgtgaaccgctactagcgcccacacacatcgacaccatcaccaccatcacaatcatgcatgggagaatgtgaagcgaagaccgacgacgacgaccagcgtagcttaatttgaggtgtctcgcggtctaacccgcgagagtaattaaccgggtgttttccgagaccccgggaaccatgagaacacagtcgccaagtcagatccacctcgtcaatgagctgtggagcgcatttgaccaaggatttttgtatttttgtaattcttcaagaattataataaaatgcattttccttcttctattttattttgtgtacttagtacactggcacgcccacacatcttattttatttatttcgctgggtgaagagattggaagttaaattctctccgttggtacaatgttgtagagacgtaggatgcatctctttttgagcaaatatgcaagtaccaactggagtggagcagaaaacacctagaaaagaagagtgcatctcctcttgcttgtgtgcgagtaggtgatgcaagagtgaggagttgtgcacagctaggagtggatgaaggctaagccaaggcaacacatgagctcaagagagaggctgggtgtagccaggcatcatgatcgctaccagcaaggtgtatagccattttttaaagactcacacataatgcattctttgatctaaatgtagcccgtcagctctcttgctctcttcctcttctcccatctttttttttcatttttttgttgtctctcctttttttttctcttttttttccttttttcagcaaggtaagactaacaccaactgtaaaccaagatggtcttggttgatggaattcttcatgcaagctcgtagacctccctcccccacacttggtcttttgtgtcatgagacgtcaaaaaccaagtatgtgatactggggcctcttataaagcgtatcgcattaccaaggatcaccatggtgtacggttgatgtggctcccgtgttcttaggcatcgtatgaccctcgctcttaatctcaacgtgaaatggttagcgaccaagaatacccgaatgtgtacactatcttaaacacagtttcttgcttttattggaaagaaaacttacaaagataatccgggtatctcccggcagtgctttgtttatggtcttaatgtcacaccctgaaaattcaaaatttataaattgttgtttaattggaatttttagaaataattttaaaagtcttgaagaaaagatctaattttaattaataaattccaatataaaatggggccagataaaatttcattaaatactttgcttaattctataattcctagattttttctgggatttatttgagctaaggaagtatttttaataaatggaattgcatttaagaaataatttaaattgaaaaaggttttaaaaagtctcttttggctttgggccgaaagtcggcccaaaaccgctctctctctcctcggcccagtccggcccagtccgcagccgccgcgcgcgcgcgccctcgctgtcgctgacaggtgggtcccacctgtcaggcccgtcgtcttcctcgggccgaaaccctagtttcgcgccgccgccgccgctttccaatccggccgtccctttccttctccggccgaattgatagaggggaaatgatctccgggatctcctctaccttttctcctttggaatctttggctaaatcgttttggaaagcgttggattcgagtttgtctcggattcattcttcccgatctttccttcctcgccgccggccgccgtgggcctttgccgtcgcctccgagcccctttaaaaggacccccggtgtctcctctacccgtcgccaccctcgccttcgcctctcgtcgtcggaatcgctctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgcctcttcgccgtcgccggagatcaccggagcagcatcgccgtcgtcaacccgaaggttcccgccgcttcctcctcgtcgccgtcgccgtccgttggtcttcccccgccgtttaggtcaccggtgagttcgccgcgttgtcctctccgtcttggtgccctctgtttgcgtcctagcatcgccgttcgccgacgagcgtgcgccgttcgagccgtctcctccgccgagccgccgccgctgtcggtgatgtcaccgctgacgtcatcggggtcgtccgccgtgagccgccgtggacccgatcgatctcggccgtccgttttggatcaagttgatctcggccgtccgttcgtgtgaaccgccgcccgtgcgcccggtccaccgaaaccctagcccgctgacgcaataaaccttcttttccttttcaaaaataattcattattgcgtcataattcaatttaagccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgttcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattctttgttatggcccttttgtacttgattacttcattccttcataccttgggttattacaatttgactagttgagctttatttatattggttcaactagatattagatataattgcttagcctgcttagaaacattatgtcacgaccggaactgacccaacgggcgttccttgtgtgcgtgcattaatccttgtcccaggaggcaaggtacaccaaaagttgatacaattcagagtttaacaagcggaagcgtaaatagataatttattacatgggcagcgaaggcccagcacacacaaagacacacgagaaacagcggaagactagggcgacgaccacaggcacttgacggcaggcacgagctagacaccaaagccttcatcctccaggaactcctcttctgggtttgggaaaaattgagcaagactgagtacaaccaccgtactcaacaagacacacccacaagtgctgaataaatgcaagggagtacaaaggagttatactataaaggggttagggttgcagtaaacagcatttaaagatatttagttgctcagggctattttgcaaacacgaatctagtactatacaatattatttatcaaggccgtgaacccacacgaacctgccttaacccaaggcctacgatgatttcagaccgaactggcaacccgaccctgggtcccagctcgtccaagccaacccaggccaaccattccacattttagttgttaagcaggttttaagaattaaaacactaacttggg

SEQ ID NO: 20564 - DNA, 1727 bp, Oryza sativa
  unsure (1)..(1727): unsure at all n locations
nnnnnnnnnnnnnnnnnnnnnnnnnnnnnnnnnnnnnnttttagggtttttctttttacaaaaccactttaactttgtttatttcttcttaattattatttgagctctgaaaattccactaaaatttatttacgcattttaagcttttaggaaatatacaaaaatcctccaagccttattcgacttttaactttgcacattttaattgttggaggctttcacatggattttacttattctttgcataatttcgaggatgcattttagagtcgttttgggacgtgacacattagtacacattcgggacaacttatgactcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacataatgtggggttgtgtcttgtgggtacagtggtacacctctggccagagtaaaactattcgaatagccatgcccgcggttatgggcgggtctaacaatgtctttcgtgattagtttcacacttctcaccttagtgaatgatgctataattggtaataatttgattagctcctggtttggaatggtatattcctggtttggagatagaactgtgcagccggtatggttgtatagaatggttgggcctatacaacagggtatgttgtatagtgttggattaatattgtttaattattacttaactgttttattaaattctgaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggagtaggtgtagccttggtcaagctgcctgtggagtggagccgtctgcgccgtttaatttatttttccgctgcttagatctttattgattgagaggaactatctacctctgtaatgacattttatacgcttattaattagagtaataattgtactctattatcaatttgttattgtgtgcctcggctaattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatacacttcataatcccttttaatggttctcattcaaaatttattccagtgttattagtacagaacatctattactgtactaatggcttnnnnnnnnnnnnnnnnnnnnnnnnnnnnnnnnnnnnnnn

SEQ ID NO: 20565 - DNA, 6632 bp, Oryza sativa
tcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatacacttcataatcccttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtgaccttgtttccaactgttttaacttatcttgcaagtttggtttactttatttacttacctttttactctgatttttctaaactttattcaaattaatccaaaaacttgtgctgttaattggatagatgtcttaactccctcctttcacttgtctttagatgccgcgctacaagcctgagtacctgtttggtgttgagggttttgtccaggagttgcgtacgatgtcctttgtcataggatttgggactgcccctttttatgctcagattcctcatgatcgtcatgaagagaagtgccgagtcaaagtcaccttgaatagtaatagtgaagatgtcccctcagtgatgttcgaagctggaggaagaaactacatccatgcatgtcaggaagtggcaaggatcgccataggagagctccgtgatcgctacagtgatcggttggctgacactgagtatcgctaccatcctcgtcaaccacagggaagtgaccgtggcagctaccttgagactgaaggaattgagaatgatgctaccacaaggcatttagttgagatgctgtgggctatggatgaaagccgtgcagagactgtgttagcggctcaagatcgtgaagattggaatcgtggtaagatttgcaagttagaagacaaggtggatcgtttggagaaggaactagccgcgttgaagggagaagcaccaccgcagaaggccaggattcgtcttaccgcaaggaagagagctctatttgtccctcgctatcaattggcgccaaaagttcgtgtggtggagaaagaagttgccccagcagatcctccggtcatcatcataagtgatgatgaagaagaagaatccaagcgcacccattccaagattgagtgggtagcaactcaagatgatgaagacgagccgaacgagcctacaatcgacctccgatgctcggaagaactagagtgacttgttaagtccgtgtcttagatcggtgtgttagttgcttgctttaagtttgcttgtgtgtgtctcgcatgtgatttacatcagtggtgggatgtaagtgcatgcgtttgtttgcttttgagtgttaggaaagtggtgagtttagtggtgtgagagtcttcagtttgtaataatgaaactcagttaagatcaataaaagttaaagtatttctctatcctaagtagtttcccccggtttctttttttgtgccctggccagatggtgctcactcgcagcaacgggaatggccccaacagcaacaataacaacaacaatggagagaacccaacacttgctcaagttcttgctctgcagactcagttaatgaacatgatgatgcaccaacttcagaatcagcaaaaccaaggaaataaccatgcacctccccagaacaagttagcagaatttcttcgtgtgaggccgcctattttctctagtaccactaatcctgttgaagctggtgattggttgcatgccatagagaagaagatggatttgcttcagtgcactgatcaggagaaggtctcatttgcatcacatcagttgcttggccctgcctctgaatggtgggatcacttccgcctgaataggattactgctgaacctattacttggcttgaattcaccgctgctttccggaagacgcatataccatcgggagtggtgtctctcaagaagaaggagttcaggtcgctcacccagggatctcgctctgttacggagtatctgcacgagttcaatcgtcttgctcgttatgctccggaagatctgcgcaatgatgaagagcgccaggagaagtttttgggaggacttaatgatgagctttcttacccactcatggttggagattatcctgatttccagaaattagtggataaggctatacgtcaggaggacaagtacaatcgcatggagcagaagaaacgccggattgctcacttcaaggcacaacaggggagtaatcagaagccgcgtcttactttaggaccccagtctgtgccacagggaggttcttcgtccattgttcgtccgcagcgtcagttcttcaacaacaatgctggcaacaacatccgtaatcaagtcccacgtcctgttgctgcctcgacacagcaacaacctgccaagaggaagcaaggcagcaagcccgtggtgtgtttcaactatggagacccaggacattatgctgacaagtgtccgaagccccgacgcgtgaaggttgtccctgcccagaataactctgctgtaccagcatcaaaggcccgtgtcaatcatgttgctgctgcagaagctcaagatgctccagatgtgattttgggtacgttccctgttaactcagttcctgcaactgtgcttttcgattctagtgctacacattcattcttatctatgagttttgcgggaaatcatgggatggaagtagaagatcttagacgtcctttgatggttagtaccccaagtaatcaagcactctctctgcaacgtagcccctctgtcagaatagaaattcaaggggtaccatttctagccaatcttatcttgttagaatctaaagaccttgacgtcattctagggatggactggttagccaaacataaaggtgtgatagactgtgccaacagaaaagtaactctcatcagcaatgatggtcgagttgtaactgttcatgcattgtcatctgagtttttaaggtcaagactgaaccagataactttgggagagattcctatagttcgggagtatcccgatgtgttcccagatgatttacctggtatgccgcctaaaagggatatagagttcagaatagatttggtacctggaacaactccgatccataagagaccttatagaatggcagccaatgagttggcagaagtcaaaaggcaagtagatgatttgcttcagaagggatacatcagaccgagttcatcaccatggggagctccagttatttttgtggaaaaaaaagaccatacccagaggatgtgtgtggactatcgtgcactaaatgatgtgactatcaagaataagtatccgctacccagaattgatgatttgtttaatcagcttaaaggtgccactgttttctccaagatagatcttcgatcagggtatcaccagttgagaatcaaagagtaagatatacctaaaaccgcttttaccactaggtatgggttgttcgaatgtacggttatgtcttttggacttaccaatgctcctgctttcttcatgaacttgatgaataaagtatttatggaatacctagacaagttcgtggtggtctttattgatgacattcttatctactcccgaaccaaagaagagcatgaagaacatcttcgccttgcattggagaagctacgagagcatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcacagttttctaggcctcgcaggatattatcgaaggtttatagagaatttttccaagattgctaagcccatgacacgcctgcttcagaaatatgtgaagtacaagtggtcggaagaatgtgagcagagttttcaagagttgaaaagtcgtttaatatcagctcctattttgattttgcctgatccaaagaagggtttccaagtgtattgcgatgcatctaaacttgggttaggttgtgttctgatgcaagatgggaaggtggttgcctatgcatctcgtcagttacgtccgcatgaaaagaactaccctactcatgatcttgaattggccgcagtagttcatgcgttgaaaatttggcatcattatcttttcggtactcgtacagaggtgtataccgatcacaagagtttaaagtatatctttactcagccggatctgaacatgagacaaaggagatagttggaattaattaaggattatgacatgggaattcattatcacccgggaaaggctaatgttgtagcagacgctcttagcaggaaaggttattgcaatgctaccgaaggatgacagctgccattggaattatgcaaggaatttgaaagattaaatttgggaattgtcagtagaggttttgttgcagccttagaagcgaagcccacactaattgatcaagttagagaagctcaaattagtgatcctgatattcaagagatcaagaagaatatgagaagaggaaaagctatcggtttcttggaggatgagcaaggaactgtatggttgggcgagagaatttgtgtccctgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcggtatgtgatatttgccagcgagtcaaggcagaacatcagaaacctgccggtttgttgcagcctttgaagattcctgaatggaaatgggaagaaatcggtatggattttatcactggtttacccagaacgtcatcaggccatgactctatttgggtaatagtcgacagacttaccaaagtggcacatttcatcccggtaaagacaacttattccggaagtcggttggcagaattatatatggcaaggattgtgtgtttgcatggtgtccctaagaaaatagtgtctgatcgaggcagtcagtttacttcaaatttctggaagaaacttcaggaagaaatgggttctaagctgaactttagtactgcttatcatccacagacagacggacaaaccgaaagggtgaatcagattttggaagacatgttgagagcttgtgctttagatttcggtggaagttgggataagaatctaccttatgcagaattctcgtataacaacagttatcaagctagtcttcagatggctccttacgaagcactgtatggtcggaagtgtcgcactccgcttttgtgggatcaaacgggagaacgtcaggttttcgggacggatatcttaagagaagcagaagaaaaggtaaagatcattcaagaaagattgcgtgtggctcagtctcgtcataagagttatgccgacaatcgccgtagagatttgagttttgaagaaggagattatgtgtatcttcgtgtcacgcctcttcgaggagttcatcgttttcacaccaaaggaaaattggcaccgcgttttgtgggaccttataagattgtcagtagaagaggagaggttgcttatcagttagaattacctcaatctttggcaggagtctataatgtgttccatgtgtcacaattgaaaaagtgtttaagggtacctaccgaagaagctaatattgagcagatagaagtccaagaggatttgacctatgttgagaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatttataaattgttgtttaattggaatttttagaaataattttaaaagtcttgaagaaaagatctaattttaattaataaattccaatataaaatggggccagataaaatttcattaaatactttgcttaattctataattcctagattttttctgggatttatttgagctaaggaagtatttttaataaatggaattgcatttaagaaataatttaaattgaaaaaggttttaaaaagtctcttttggctttgggccgaaagtcggcccaaaaccgctctctctctcctcggcccagtccggcccagtccgcagctgccgcgcgcgcgcgccctcgctgtcgctgacaggtgggtcccacctgtcaggcccgtcgtcttcctcgggccgaaaccctagtttcgcgccgccgccgccgctttccaatccggccgtccctttccttctccggccgaattgatagaggggaaatgatctccgggatctcctctaccttttctcctttggaatctttggctaaatcgttttggaaagcgttggattcgagtttgtctcggattcgttctt

SEQ ID NO: 20566 - DNA, 3770 bp, Oryza sativa
  unsure (1)..(3770): unsure at all n locations
nnnnnnnnnnnnnnnnnnnnnnnnnnnnnnnnnnnnnnnnnnnnnnnnnnnnnnnagagaggaaaaagaaaaagaaaaaggaaaaaggattttccctggaattaaaatattgcttgctcaattttaattggttaaaattatttctagagctctgaaaattccactaaaaatcctgttaatgaatttcgacctgtagaactcaagaaaaagtcccacatgtcaaatccgattattatttgcattactttcttagggttttctcctgatttgcaccggtattttcttagggtcatttataaattacaattttggcttgggagggaaacttcggggtgtgacaaacctaccccccttaaacggaatctcggccccgagattcggaggagctggtgaagaggtgcggatgggcggctttcaactcatcttccctttcccaggttgcttcctcttctgaatgatgattccactgaactcggcaaaacctggtgaccttatttctggttcttctttcgctggtatcaagtatacgaaccggcttctccacataggttaggtcctcttggatatcaatgtgctccgaatcaacctgttcttcaggtacccttaagcacttctttaattgggacacatggaacacgtcatggatgccgatcatgttggatggaagttctagctgataagcaacttctccccttcgttccaaaattttgtatggtcccacgaagcgtggtgccaacttgccttttgtctggaaatggtgtactccccggagcggagtgacacgaagatacacgtaatctccttcctcaaaagtgagctcccttcgacggttatccgcgtagctcttctgtcgagactgagcaattctcaacctttccctgatgattctgactttctcttctacttccgctaatacctctgttccgaacagttgacgttcgcctgtctgatcccagaataaagcgcatatggctgtataaagcttccgaccgtataaagcttcaaacggtgccatctgtagactggcctggtagctgttgttgtacgagaattccgcatatggcaagcttttgtcccaagctccaccaaaatcaagagcgcaagctctcaacatatcttccaagattaaattgactcgctcggtctgaccatcagtttgcgggtgataggccgtgctgaaatttaaacgggtccccaattcttcctgtagcttctgccaaaattttgaggtgaactgactacctcggtcggatactatcttcttgggtaccccatgcaaacacatgatccttgcgaggtacaattctgccaatctctttccgtataggtggtatgcactggtataaagtgagccaccttggtgagtcgatccacgactacccagattgaatcatgacccgatgatgtccggggcagtcctgttataaagtccattccaatctcctctcatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttagtgctgcctgggtgaatggagtactgggtctgatgagcctcggtgagtatcagatccttcaattccttgtcgtcaggtacacacaatctttctaccatccagatcgtgccatgctcatcctcaaggaaatcccgagcctttccgactctcatgttctttttcagctctgctatttccggatcatttacttgagcggctctaacttgatccacgagcgtaggccgtgcctccagagcggctacgaacctgtgttcaacaattcccacgttgagatgcccaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgccggagatttaggtccggttgggtgaagatgtatttcagactcttatggtccgtatatatttcgcagcggttgccaatcagatagtgcctccagatcttcaaagcatgaaccactgctgccaattccaagtcatgcgttggataatttccttcgtgtggacgcaactgccgcgaggcatacgcaaccactctgccctcttgcattaggacacatccaagtccgtgacgggatgcatcacaatagacttggaagtctttcgtcgggtcgggcagaatcaaaactggtgcggatactaatttcttcttgagctcctcgaaactcttatcgcactcagctgtccatttaaacttctcatctttcttaagcaactgagtcatgggtcgggcgattctggagaaattttcgatgaatcggcggtaataacccgcaagtccaagaaaactccgaatctgcgacacggtcttaggtggggtccatttggtaactgactccacgttcgatgggtcgactgccacaccctgagctgtaatgacatgacccagaaattttacttccgtcaaccagaagtcacacttgttgaacttggcgtatagctggtgctccttcaacttctcgagtactagacggagatgttgttcatgttcctcctcggactttgaatagataagaatgtcgtcgatgaacaccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctcttcccggattctcaactggtggtagcctgatcacaggtctatcttagaaaacactttagctcctttcagttgatcaaacaaatcatcgattcgcggcaaagggtatttgttcttgatggtgacctcgttgagtgcgcgataatcaacgcacattctcttcgtcttatcctttttctccacaaaaatgaccggagcaccccaaggtgaagtacttggtcggatgtaccctttctgcagctgctcatcaacctgcttcttgacctcggctaattcgttggccgccattctgtacggtctcttgtaaatgggagcggttcccggtgccaagtcaatccggaattcaatctccctcttgggtggtatggtagtgaggtcttcagggaacacttctggatactcggagactatgggtatgtcttccaatttcttcaaattcttctcctcggtgaccactgggacttccatctcgatctggttcaaggagaccccttgctttggcggggctagtgatttgtacactaccgtttctcccttctcgttggtcaaggtgactgtgcgattcgcacaatcgatgactcccttgaacttagtcagccaatccatcccaagaatgacatctaggtatttggattcaagaagaatgaggttggctagaaatggtaatctttgaatttctattagcactgaagggctaaaactgactgaggttgaactattccccggggtatgaaccctcattggtgtgctaagctcttctttccttaacccatacatccccacaaatttctttgaaatgaaagaatgcgttgcaccagaatcaaaaagtactgttgcagggattgagtaaacagggaacgtacctagtacgacctccggtgctgtttgtgcctcctctgcagacg

SEQ ID NO: 20567 - DNA, 5752 bp, Oryza sativa
  unsure (1)..(5752): unsure at all n locations
aggtactctgtcacagtcctgttgccctgatggagtgcacgaaattccatcttcttttgtgccatgaccccatggggcacgggtgccttcctgaagctacggcagaactctacccaagtgacttcagtacccggtgggcgggtggccatgtgattgtcccaccaggctgacgcaggaccctgaagctggtgtgtggcgaaagcgaccttctcctgatcattgcactgcaggaggttcagcttcttctctatcgcatggagccagtcatttgcctccatagggttggtggtgctggagaaggtgggtggcctgacacgtaggaactcaggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggctagcgtcggattctcaggaagtggtggcggaccattgccggaatcactgctggggtgcacaccattagcgcgttcttcgccgttgctgccctcgcctgttgcgcggctaccagtcctggtgtagaccatctggagggaaaagcagacgggggggaaagaagaaaaacagatgctcagaaactaagctttattacaaaggaattaaaactgcaattgttctgatctgaattaaaacacttaaagagcaagcaaaaatccttattaagacagccatatcataggcacatgatatcgaccgtcgactgaccccaaacaagcaacctaaacacaccaactaacaagcagaagctagacagtcgataaactaatgggaaaaacgagcctaatgctcggaacggctcctgcggtcggtggagtcgaaggcgtcctcctgctcgtcaccaagtccctctgagcgactcctggagcctggcagatacgtctcgccgctgccactgggagtagcagacaaccaacctccggtgccactggctggacctctggcggctgatgctggagcgaaggagagagcggactcgggagctggagctggagctgcaggaactgcgggcggaactggaggtgctgcgggagttgctgctggaggtgggttcctgggcgcaagctggatgcgcacgggtgccgtcgtagtcttgcggggcgtagtgcggatccggactcctcctggcgctggaagaccctttagctgagcgttctccttcttcaggcgcgctatctcgtccttcagagcaacgatcctcatgagcttcccatcgttcaaggccttggtcgccttgtgcaggtccgagtgcatcctgtccaatcccctcatcacagcacacatgtgaccaaaggtggtgtcgttctcgccagctgtcggacagaaggagctgacgccatcaccgttggctcgacgggggtggtagcggtacgccgtgtcgtggaagatgtagttgtcgcgctcccgtagtctggccatcatcaagtaggctgcctcctgacaggcgtgatctgctgtgcctcctgacgcctcaactgccatgttagcgaggcaagtccccacgtagccatggacctccaagcggacacggtgaggaagctcgccactaagcggcggaatagtcgtgtactccggcgcgttggggtagcccaccaccagtgtcatgcgtgccagctctgccacaaagtcgatcatgccttctccgcggtggttgggtgggtggccagccatctagagaagacaaaggagtaggatcaatgcatgctcaaatccaaatttaaataaggcaataaaagactcaaataagggaaacgaataagagcgaaatttttatgcatagatcattttgcatgagagcgaataaacaagacagacccacataacgataaaataatgagaaattagatatatactaataataacaaataaagcataaataccttgcaacccatgttcctgagctaggacctaatgcatttcacccatcaaaccccaactgactgacgaataaatcccaatagttttactaaaaccctagactgacccgttttgaaaaaactcacttaacgagcgaccaagattttttcccttgaaccacaaaaacagatcccaattttcccggaataaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccagccggggtacacaaacaacaatgttgacattcagatccacgtcttacaaacatcataaaagtcttacaaaaatgcagcggaaaacaaaagataactggagctaatccttgactcgaactgcagcgggaacaccactccacaggcatcctcgacggcacggacaaagcctactcctcggagaacccgccatcggacacatactcgagctctgggattggggaaaatagagcaaggctgagtactacccactgtactcagcaagtcataccggaacgggggtatgatgcagggattccacaagggatagctaagcaggttcatttgcataaatactggcatttataaacaggaattgaatgcgaaaacagttgtaataattaagcagtattaatcatccactgtccaacgctacaccacgttgcgacaggcccaaccatccacctaaactatccaaattcaaaagattacactagggtgagactaattacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggccgtgacaggaccattcgcataaccccctctaaccaagcacaccacacctcaggtttcacccccactcctcgcaaggcagcgggcagtcccctttcgtgcctaggtgaatccggaagccgcataggccgtcgcagggcccatccaaactccatcacgcccacccttgcctggatgcgtcgactagaggaaagctacaccacaagcccagccgttgcccacgctggcttgtggtaagtacgataagttcttccagggcatcccgcgaaccggtcgttaattgccatgggtgcgactagcaaaaccatgcacccacagcccaccattcagttgcattttagttggataattacgaccatgaagcatggccagatgtctcgagcacgcagctcactctgatactaaaaaggtctaatattgtaattatcccatcaactgagctagtggtaattaagcatggctaagcatatagttctagctaagtcacataagtaacacgagctagtcgatttattacccaatgttgacaaaggatagatatcaagtaaacatggcacaagcgagcagataggtaaaccctgatcccgtgtaattagcaaaatatgcatatttatttgtaaacagtaaaacatttgtaaattaggatcaaaatgctcaaggggaatgtgtgacttgccttgcttcttcactttgatcttccgaactcttttccttgcgaccgcggacttccgaaacgacggaaactacacgctggcacgcaaaacgaggaaaatctctaataaaaaccaaggaaacagtacataaaaactaaacaaacatgtagagctcaattttagatgaattttgcaagttgaatggctcaatttggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcgggacaagggcgccggtccaccgtggaccgggaccaccaaggcggtccaccgccggtccacgggaaccgatggcccggatcggcccaaaccgatcgagcggccaggggcggcgcggctggggcacagcacggcacaaagccagctggccaaacgacggcgcgcggcggcgcggccacccgcggcgacggccggcgacagcgcggggaggagaggagggatgctcaccaagggcggcgacggcgagactacaacgaggaagccggcggcgggctcctcggggaggcaacggtggtccggtggcgtaccacgggcgcgaggcggcggacggtgaccgggacgaccggtgcgcggagagggcgatttcagtggtttcccgaagccaggaatccggtggccggtgtgcggcttctgatttccgatcccaaggaggaaacggcgcagtccggcgtcgaccggggaggcgaggcgacacagatggagatacaaacacggcggcgatctcgggttggtggtgaagttggtgctcggccggcgagaggcgacaaccgagcggcggccgagcttgactttgaggcggcgaaggtactggcagtggtggcgcattggggcgacggctagggcggcggtggtgcacggctagaggcggtgaaaggggcggcggcctcgggtgtgcggtgggagtggtgctcgagcggtggagagggggaaataagaggcggccggacttccccttgcggtggcgaagctggcggtggcggcggctcggcgcagcgacggctgtggcggcgggaaacggcgaccggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgatgtggggtggtggaggggttaaccggcgccgattttcgcggggagagtgggggaaatggtggaggacgtggagaggatcgttcccacgtcgttggatgcgagctcgggtgcgggagggcgccggattttgcggcgatgtggacggcaatggcggttggggtcggccggcgagaggtaggaggaggagctgacgggtggggtccacgggtcccacctgtcggggagagagggagggagggaccggctggggaggtaaagcagacttgagggagagagagagccgagcgggccgagggagaaggccagcccgagagggagagaaaagggcgcgcgggccgagggagggaaggaagacttgggccgaaaatggcccaaagagaggaagggggattttaattgttttctttttattttaattgatacaatgatctttgtgctattaaaactatttctcgagctccgaaaattcacggaaaaattccggagagtacattagggcacaaagaatattacaaaatattcccggccaatgatttttaaaggaaatttttaattccctcaataattcacttgattaagttgatttaacttttatttaatttctagaaaatgtattattaattgatttttattcccgaacgaaaatcggggcgttacaccccgtctgctgtcggtcacgaccggaactgacccaacgggcgttccttgcgtgcgtgcattaatccttgtcccaggaggcaaggtacaccaaannnnnnnnnnnnnnnnnnnnnnnnnnnnnnnnnnnnn

SEQ ID NO: 20568 - DNA, 1530 bp, Oryza sativa
  unsure (1)..(1530): unsure at all n locations
nnnnnnnnnnnnnnnnnnnnnnnnnnnnnnnnnnnnnnnnnnnnnnnnnnnnnnnttgtaataattaagcagtattaatcatccactgtccaacgctacaccacgttgcgacaggcccaaccatccacctaaacaatccaaattcaaaagattacactagggtgagactaatcacggtgaatctggttgactgcccataaccgcgggcacggctattcgaatagttttactctgatcagaggtgtacaaatgtacccacaagacacagccccacgacacgtttccatgcgccgacatgccaccacgacatcccggaaagaggccgtgacaggaccattcgcataaccccctctaaccaagcacaccacacctcaggtttcacccccactcctcgcaaggcagcaggcagtcccctctcgtgcctaggtgaatccggaagccgcataggccgtcgcagggcccatccaaactccatcatgcccacccttgcctggatgcgtcggctagaggaaagctacactacaagcccagccgttgcccgcgctggcttgtggtaagtacgataagttcttccagggcatcccgcgaaccggtccttaactgccatgggtgcgaccagcaaaaccatgcacccacagcccaccatgtgattcattttaattaaccaacacccaagcggtgtcactagtccaacattatcatataaacctatagtctaggttttaaatgagatctccccattgtgtgctagttgaactaagcatggctaagcaaaccctagtcctaactctaatcatgttataacccaagctaacaaaggagcatggtatcatattagcatggctgtaacaataggtaaccatcccatagtaatattgcaaaacaaatgcgatatttgaaagaaaacattaggacatttgcaatataggatcaatatgatcaagtgacaagcatgacttgccttgctctgctgctggagggacctcggcgactatctcgaagtacaccggagcgtcggaagagccggaatctagcgacatacaaggcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataacaaaaatccttaaataatttattgcgcaatattaaccaggactgacgtcagcacgggggcgcggcgccgacatgcggggcccaccggtcagcgactcgggagagggaggaagggcgccgacacacgggacccactggtcagcggcgcgggagagaaggggcagcggcaccggctcggcttggctcacggccggccgaccgaccgcggcgacggcgacggcgcgcgcgcgaacgcgttgccggcgacgacaaccggcggcgaaggcgacggcgcaaaggcgatgcggaggcggctgcgctaacggcggctaggaaggggagg

SEQ ID NO: 20569 - DNA, 2378 bp, Oryza sativa
aactcaagaaaaagtcccacatgtcaaatccgatattatttgcattactttcttagggttttctcctgatttgcaccggtattttcttagggtcatttataaattacaattttggcttgggagggaaacttcgtggtgtgacactagtcctcctctttcgtttgccccttttcccgagctctctagtgcgccgtagagtcgccgccgcgtcgctttagccgccgccgtcgccggccatcctccggccacgctgcgccgccgcgtccgccgtcgttgccacctctcgttgccgccgttaggtgcgcacgggagcggggaagctcggccaccccttctccgccgtcgccggccgtcgtagcgccgttcccgccgttcaaccgagccgccgccgcctcttgcgtcgtcgccggccgtcatcgttcgtcgttggacgctttggtgagtaccgttgcgttcgtgacgtcgtcctctacgtgtagatgcccttggatagcccggccgatctctctatcgccggcgaggtcgtcgcccatgtcatgccggcgatgatgacgtcagcatgacgtcatgattcctcttttccagtttttttctaatagattaaatcttcggaaaatcataactaaataaccgtagcttcgtttcaggtggttcaagttgctaaatttttctaaaataaagatctacatattaaaattgtccataaattgaattaaatttatttaattctttttaatgggctttaattagatttaatcttgtaaaattcatattaaattcatttgaagtcagaatagggccgttcaagtctcataattcatctaaaatcatgttctacatgtttgtttattttatatgtattgtttatttggtttttattagtcttttactttgttttgcgtgttagcttgtcgtttccgtcgttgcgaaggttcgtgagtgcgctggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgtattggatgccctattccttgataccttgggtaataaattgattagcttgaaccttatatattggattggttcagctaaatgctatatgtaagtttgcttagctatgcttagaaacattagctaactaaaggggttaattataagctatgttatattattattaattatggttacattaaatggtagctcacgatggttaatcgtgcgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacaatggtacacctctggccagagtaaaactattcgaatagccgtgcccgcggttatgggcgagttaagcaatgtttttcgtggttagtctcacacctctcacaataattatagatgttatacctggtaataatttgcttagctcctggtttggagattagatctgtacagccgggtatggttgttcaggatggttgggcctatgcagcatgggtgtgatgttcagtgttgattaaaatttctgataaattactccactgttttacttctcttaaatctttgctaaatgctgcttttgcaaaagagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgatgcctggacgaggattttatgcacaaattagttcggaaattattagtgaatttccgggcgtgaca

SEQ ID NO: 20570 - DNA, 1688 bp, Oryza sativa
gcaataatcatcaaaccttagttgaagataaaggatccagaaggagaagacgtttggcttataccccagttgagctgcctgtgggagtggagctgaagccatcgctagaccgttaattccgctgctgttttcttttctttgtaagtatgtaacgttattattaagatggatttgtatattaaattgtcagtttgtgtacctcggctgatgcctggacgaggattttatgcacaaattagttcggaaattattagtgaatttccgggcgtgacatctgccccgcgtgcaatcaatagggggaattattccccgggatcccctccccctttccccccatttttccctccctctctccctcggattcgtttggaaacccctcccctaacctcgccggaccgtggggctgccgcgtgggccccactcccgtggacccggtccgcgcgcccctcccctcggctgacgcaataaatcctttttttaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagacccgctcttcttggaagttgaagcccacgtttgggaaagcgagcaaggcaagtcacatcatctttgaacatattgaatcccagtttgtaaaattatgttgatttaaattattgcattatcgctttatttaaattcccgccgcccgtcagcgagggtggcgggcgggcccgcccgtcagcggcgcgcgcgcggggaggaggccgatgggtcgcgggggagaggagagagagggagggaggtgggccgagccggcccaagagggggaagggggggaggaaaaagacttttagggtttttctttttataaaaccactttaactttgtttatttcttcttaattattttttgtgctctgaaaattccactaaaatttatttacgcattttaggcttttaggaaatatacaaaaatcctccaagccttatttgacttttaaatttgcacattttaattgttggaggctttcacatggattttacttattctttgcataatttcgaggatgtattttagagtcgttttgggacgtgacaaacctaccccccttaaacggaatctcgaccccgagattcggaagaactggcgaagagatcgggatgggctgccttcagctcgtcttcgcgctcccaggtagcttcttcttcggcgtggttgctccactcgaccttgcaaaaacggattacccggttcctggtcctgcgctccatggtgtccaggatttttactggcctctccacgtaggtcaagtcttcgcgaactacaatttgctctgagtcggcctgctcggatggcactcgaaggcatttcttgagttgcgacacatggaacacatcatgcacgttgcccaaggaggcgggcagttccagctggtaagcgacttctccgcgccgagcaatgatacggaaaggacccacgaaccgaggtgcgagcttcccttttgtccgaaagctgtgtacagctcgcaatggtgtgacccga

SEQ ID NO: 20571 - DNA, 942 bp, Oryza sativa
  unsure (1)..(942): unsure at all n locations
nnnnnnnnnnnnnnnnnnnnnnnnnnnnnnnnnnnnnnnacaacaacagctatcaagccagcatacaaatggcaccttatgaagcgttgtatgggcgcaaatgccggacaccgctaatgtgggatcaagttggggaaagccaagtgttcgggactgatatcctgagagaagctgaagctaaagtcagaaccattcgggataatctaaaggtggcacggtcccggcagaaaagttatgcagataaccgtcgccgtgacctggaattcgcagtggacgattttgtatatcttcgggtcacgccattgcgaggtgtacacaggtttcggacaaaagggaagctcgcacctcggtatgtgggtcctttccgtatcgttgctcgacgcggagaagtcgcttaccaattggagctgcccgcctccttgggcaacgtgcataatgtgttccatgtgtcgcaactcaagaaatgccttcgagtgccatccgagcaggccgactcagagcaaattgaagttcgcgaagacttgacctacgtggagaggccagtgaagatcctggacaccatggagcgcaggaccaggaaccgggtaatccgtttttgcaaggaccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagatccatgtgaaagcctccaacaattaaaatgtgcaaagctaaaagtcaaataaggcttggaggatttttgtatatttctaaaagcctaaaatgcgtaaataaattttagtggaattttcagagcccaaataataattaagaagaaataaccaaagttaa

SEQ ID NO: 20572 - DNA, 1095 bp, Oryza sativa
atcggactcctcccgcaaaaaatcggctcggcaaaatctaaactcggtttttgggaataaaatcgaacagaactcgattcggataaaatacccacccatttgctccgattctggaggggaaagatagaggaggatgagaggataaaaccccctcaaaaatcgaaaaaatcggggtcggattgggtgcggatttgagggcacaaggtggcgcggtagggcggctcgggctcggcttggccggcggctggaggaggaagatgggtccgacatgtgggtcccacatgtcggtgacccgagaaggagggggcgggcggcgtcggctgggccggcttgggccggttcgaccgcgcggggaagagaagagttgggccgaaatcggcccaacgacttaggggaggattttaaaaacttttccaattaaaataattcgtgaaatgatgtttcatttattaaaatacttcccttgctcaaacaattcctagaaaattctagaaaatagaggaacaagcaaagtatttaataaaattttatctagctcatttttatattgagatttaacaaattaaaattaggtcttatcttttaagcttttaaaattatttctaataattccttttaaacaacaatttataatttaaggattttaaacaagaaaagaacttaacaattataattagatcattattgatcaaataattactgaactgttctttgtatcatttaggaattgagctccgaaaaatccgagaaaattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggaagtgacagtgtcacgtcccaaaacgactctaaaatacatcctcgaaattatgcaaagaataagtaaaatccatgtgaaagcctccaacaattaaaatgtgcaaagctaaaagtcaaataaggcttggaggatttttgtatatttcctaaaagcctaaaatgcgtaaa

SEQ ID NO: 20573 - DNA, 922 bp, Oryza sativa
aggcgacggcgcgcgacactaagaggagaggaaggggaaaagaagggaggggtgcctcaccgagggtggccggcgcggaggaagacgatggcgaacggcgacggcaagccacgggaggacgacgtcggcgagcggacgagcttcggggtgccctaaggaaggaggagagagggattagagagagggagatgaaccacggcgaccggaaaccatggccgaaggcagcggtagaggtggtgctcacccgtgcgcgaggggatgagggctccggcgacgaaccttgacggaggagaggtggacggggtggatctcggccacgcgaatccgacggcggtgacggcgcggcctggcggcgaccctaacggcggctagcggcggccggagaagcggaaaatggcggctgcggaggttgcacgacgcgggggcgatgggaggctcgagagagtgcggcgaaatggggaaaaagtgagagggggcgacggcggtgcttaaaaaggggaagagagaaccgcacatggccgggagaggcggaaatcgccggccgacgtgggggaatggggaagagagagaggcgggattcgattttcgaatcccggccatctcgggcgcgggcgcgagtgggagatagaggggagtgggcgctggagacgcggcgcacgcgcgggcgtggtcgacgtggcccggggaaggcggggacgtgggcgcggcggtggtttcggcgcggcggcgcgagcgcgagatcggcgggaggagggagacgggcccgacaggtgggccccacctgtcggcgaccccgagagaggagcggcggggctgcctggctgggcctcggcctgcggccggcccagtaagggggagggaaggaaggagggaatgggccggcggcccattcgaaagaaaggaggaaaaagagaggaaaaag

SEQ ID NO: 20574 - DNA, 449 bp, Oryza sativa
cccaaaaggggaatggggcaaaaagacttttagggtttttctttttataaaaccactttaactttgtttatttcttcttatttattatttgtgctctgaaaattccactaaaatttatttacgcattttaggcttttaggaaatatacaaaaatcctccaagccttatttgacttttaaatttgcacattttaattgttggaggctttcacatggattttacttattctttgcataatttcgaggatgtattttagagtcgttttgggacgtgacagttattgtaggaggactcggcataggggagactcttatcccaggtcttcccgaaatgtaggacacatgcgcgaagcatatcttctaggatctgatttagacgctcggtctgtccatctgtctgcgggtgatacgcggtgctgaaatttaatgggatacccagctcatcttgga

SEQ ID NO: 20575 - DNA, 1203 bp, Oryza sativa
gggtcgtgtgaaccatgtgcggccgagaacgttgttgcaactccagacgtcatcgttgggacgttcctcattcattccatccctgctaccattttgttcgactctggagcttcacactcgtttatatctgtgccattcatggggagaaatcagttgggaatagaaaggttagaaaccctctgctcatcaccacccctggaggggttatgacagcaaagtactatagccctgccgtccctataaaattcaggggattccttttccccggatctgattctgctaggcaccaagaacttggatgtgatccttgggatgaattggttggctcaattccaaggagtagtggattgcgcgagacgcactgtcactctgtaccgagggccggaacaaccggttgttttctttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaattggccgaagttaagaaacagttggaagagctgaaagaaaaggggtatatacgtccaagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcaatcagcttaaaggtgccactgtattctccaagattgatcttcgttccggatatcaccaattacgtattcgcgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgtggtggttttcattgatgacattctgatatactcacaatcagaggaagaccatcagcaccatctccgtctggtattgggaaagctgcgggaacatcaattgtatgccaaacttagcaagtgtgagttctggttgtccgaagtcaaattcttagggcacgtgatatctgctaaaggagttgctgtggacccc

SEQ ID NO: 20576 - DNA, 1319 bp, Oryza sativa
  unsure (1)..(1319): unsure at all n locations
nnnnnnnnnnnnnnnnnnnnnnnnnnnnnnnnnnnnnnnnnnnnnnnnnnnnnnnacacgattctagaactaaacaatattatttatcaagggcgtgaacccacacgaacctgccttaacccaaggcctacgatgattcagaccgaactggcaacccgaccctgggtcccagctcgttccaatccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtaccgtagtgctttgcaacagaggcccgaagaccggtccttatatggccgaggtgctactatcaaaaccatgcaccccgagcccagcctaaaaccattttggggattttgaatagagggggaggtgtgaagccannnnnnnnnnnnnnnnnnnnnnnnnnnnnnnnnnnnnnnnnnnnnnnnggtgatatgaatattcccaaagtctagagttgtaaagccgcttaatgtcacctaattaaaagcgaagcatctacgtataatcatactagtggtaccatgagtagagtgtccactagttggggttttgtttaatctagggtgaacaagggaataatatcaataacaatgttaaggtcataacaaaggtaaataggcatggataaataaaacagtgagaacgcgggaatttaaatatagcgataatgcaataatttaaatcaacataattttacaaaatgggattcaatatgttcaaagatgatgtgacatcgttgctcgctttcccgaacgtgggcttcaacttccaagaagagcgggtcttccgaagctgcagcgtgaacacgaccatcggaaaactaaaggcttttactctnnnnnnnnnnnnnnnnnnnnnnnnnnnnnnnnnnnnnnnnnnnnnnnn

SEQ ID NO: 20577 - DNA, 653 bp, Oryza sativa
  unsure (1)..(653): unsure at all n locations
atagggattggtgtagcggaccctttggttagctccctgttgattgcggaaattcgccaagcggcgcttgtgcgactccagttccttgtgcttggcttccaagcggatgctcttgtccaccagacgttggaaatccagatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccacgactccggcgggcacatgggttctccggaaagcggcggtgaaacgggcccaagtaataggctgtccctctggctgcgtagcctgaaaatggtcccaccatagagatgcgggcccctgcagctgatgggcggcgaagatgactttctcctcatcgctgcactccacagtgtctagctttttccccacggcatgcaaccaatccaacgcatccacggggttgttggagctagagaaggtaggtggacggatgcngaagaactcggcgagttaaagtgttggggaggtggtggtggagcattatngtgtggcggattttggaggtggtg

SEQ ID NO: 20578 - DNA, 1325 bp, Oryza sativa
agtgtccaggtgatatgaatattcccaaagtctagagttgtaaaaccgcctaatgttacctaattaaaagcgaagcatctacctataatcatactagtggtaccatgagtagagtgtccactagttggggttttgtttaatctagggtgaacaaagaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaacggatttattgcgtcagccgaggggaggggcgcgcggaccgggtccacgggagtggggcccacgcggcagcctcacggtccacggtggaccgggtgcacacgggcttacgccggccggcgccgtgggtcccacgcgtcagccgcacccgagcgcgcgggcggctgacagccgggccccacgcggcagccactcggcgcgcccgagggcggccatgccggcgcggtcgacgggaggcggctttccttcgcccggagaccatcagctcggcggaccggcggccgagagaggggagggaagggggaaaggaggcgacggtccacaactcaccccgaggcgacggcggcgacggaggaggcggccagagcggagggaggcggtggcaaggctcgggtcgacggggacggcagcgctccggcggtcggcgaccgaaacggagaggtggacgaggtcggcaaggatgcggcgaacccgaaggaggcggctccgaggtgggaggcggtccggggcgacgacggcggcggaccggagctcggcggcgatggcggagagagagagcgacgtcgcgagctcgaatccggcgaggaggaagggcggcgagaggcggaaacgaacggaggaggtgcgggaagggtttaaatagggttggaaggggagagagcggctggggaggaaggaaaccggcgcgggaggttcggccgccatcaatggcggcggcgagatt

SEQ ID NO: 20579 - DNA, 1330 bp, Oryza sativa
gaacacattatgcacgttgcccaagaaggcgggcagctccaattggtaagcgacttctccgcgtcgagcaccgatacggaaaggacccacataccgaggtgcgagcttcccttttgtccgaaacctgtgtacacctcgcaatggcgtgacccgaagatatacaaaatcgtccactgcgaattccaggtcacggcgacggttatctgcataacttttctgccgggaccgtgccacctttagattatcccgaatggttctgactttagcttcagcttctctcaggatatcagtcccgaacacttggctttccccaacttgatcccacattagcggtgtccggcatttgcgcccatacaacgcttcataaggtgccatttgtatgctggcttgatagctgttgttgtaggagaactcggcataggggagactcttatcccaggtcttctcgaaatccaggacacatgcgcgaagcatatcttctaggatctgatttagacgctcggtctgcccatctgtctgcaggtgatacgctgtgctgaagtttaatcgggtacccagctcttcttggagcttcttccaaaagtgagaggtgaattggcttcccctatcagatacgattttcttaggaacgccatgcagacttacgatcctagcgaagtagagttcggctagtttgttccctctataggtggtctttacgggaatgaaccgagctaccttggttagtcgatccacgactacccatatagaatcatatccaccttgggtttttggaagtccggtgataaaatccatcccaatttcatcccatttccattctggtacttggagaggttggagaagtccggccggtcgttggtgctctgccttgacacgctggcacacatcacagagggccacgaactctgcaatttcccgcttcatactaacccaccagtatttctccttcaagtctaggtacatcttcgtactgccagggtggatggaataaggactttcgtgagcttcctgaagtatcagcatacccgaaatgtctaggtacatcttccttaagttctctgttatctggaacgcatacccgatttccgttccatagggttccatgttcatcctctgtgaaaccagcggctttaccctgtttcatattcttgaggagcccatgcatatccgggtcattcttctgagccttgcagatttgatcgagcaaggtaggcttggctttcagcgtagccaagaatccacgactaactatgcttaggttcagggcttccatctggtgattaagttccggtggaatgccacggacgttaagagtgtgcaatggctcttt

SEQ ID NO: 20580 - DNA, 999 bp, Oryza sativa
aactcttatgatcagtatatatttcacagcgattcccaatgagatagtgccgccagatttttagagcatgaaccaccgcggctaattccaagtcatgggtagggtagttgccttcatgaggtcgaagctggcgtgaggcataggccaccacatgaccgtcctgcatgagcacgcaccccaatccttggcgcgaagcgtcacaatacactatgaagtccttgcgagtatccggcaagattaacactggcgaggcaaccagcttttctttgagagttctgaacgccttctcacattgcgggctccacacaaatttctcttctttcttcaacaactgtgtcatgggtcgagcgattttggagaagttctccatgaacctctgtcacgaccggaaataacccaacgggcgttccttacgtgcgtgcattaatccttgtcccaggaggcaaggtacaccaaaagttgatacaattcagagtttaacaagcggaagcgtaaatagataatttattacatgggcgacgaaggcccagcacacacaaagacaaacgagaaacagcggaagactagggcgacgaccacaggcgcttgacggcaggcacgagctagacaccgaagccttcatcctcctggaactcttcttctggggttgggaaaaattgagcaagactgagtacaaccaccgtactcaacaagacacacccacaagtgcagaataaatgcaagggagtacaaaggagttataccataaaggggttagggttgcagtaaacagtaattaaagatatttagttgctcagggctattttgtaaacacgattctagaactaaacaatattatttatcaaggccgtgaacccacacgaacctgccttaacccaaggcctacgatgattcagaccgaactggcaacccgaccctgggtcccagctcgtcccaatccaacccaggccaaccattccacattttagttgttaagcaggttttaagaattaaaacact

SEQ ID NO: 20581 - DNA, 829 bp, Oryza sativa
tgctcttctccactggttctccatcaccggctgcgaagaagacgatggccgcaatcgttgatgagccgcggtcgtttcctcttctcttgcgttccatactctcctcaccatgccgaatatttctccttttgatttcatcctctctggtgcagccaatcggcgggaacgctgccatgcacaccggagctctggagcgcgctctgcgcaccgccgcagcaacatcgtcgccgttgccatcaatctagatcaagccggagcgagccaccacgccaccagcttcacctcaacctcctctccatttcccctcaagaatcttcaagaatggtgctacgagtgtggagatcgtccaccgtcttctccacctccggtcgccgtcgccattgtcgattccgcctcctccggtgagccattgtccgattcttcgcgtatacaccatccctgggacctcactaaccccatgaaaacacatgcatgtcaattcgatgagtggatcgagccgttgccgtcttcccggagctctacaccgtcgccggaccatcttcttctccgctgccgctgtccagactttccggcgcctcgttcaaggttcggtgagcacccttgagcccataggattgcattcatgcatttcattcacttagaattgagcaccaactcaacatgcagtagcagcctaagcacagccgccgctcggactcgccgccggcgttactccgatgtccactgaccaagaaaagaagaggaatggaatcgcaatagcatgatcttcattttgtcttttggtcgcaccctcaaacgagccaccgtttgccgctggcaagcttgcatg

SEQ ID NO: 20582 - DNA, 1143 bp, Oryza sativa
agattttggccagataaatggttagggaacttgcttttcaagataagcatccatccttatatgctattatcagaaggaaaaattcttcaattgctagtgttatgggctctgttccgcttaatgtttcgttcaggagagcattggttggtcataatcttgtatcttggcatgatttgtgtgcttctattgtacatgttcagttgaatcaatcttttgattgttttatttggaaatttaatcagagtggacgattctcggttaggtcgatgcatctagccttgattaataatggcaacattgagagaaacaagataatttgaaagcttaagatgctgcttaagatcaagatctttatgtggtacttgcttaaagtggtagtgctaactaaagataatttgactaaacaaaattggaatgacagtttaagatgctgtttctgtatgaaaaatgagtctatttaacatctatttatgaattgtcatcatgcaaagtttatatagagagcagttcaattctcttttggtttataccttcctactagcatttctcatatttttgatgggtggctcttaggggtggacaagaaaaagagtaaacttctattggttggagcttctacaatatgttgggcgctgtggttgagcaggaatgatatggtttttaacaaatcatcatcttttacatatatgcagataattttcagagcaacatattggctctgattttgggcacaattataaaggtgtgatgaagacggagatcttctaaaggttgcatgtcgtaaacttgagacgacggttatacaactttttaccaactatggatggagattcacaaataggcttcaataaatgtgtactccttatcctattttggttattttacttcttaaattggtgtcctatttttttttttgaactttacttgttttagagtgttagtttgtaataattggttgtagctcttttgagcaaaggccgggatgatctattccattatctaaaaaaaatcctctttagttggatagttatcgggctctaactcatttggaatcaacagtagatttcgaatatgcatttgcatggaattaaaataaatacggtggataatattgttttggccaaagatccttgctatatatgt

SEQ ID NO: 20583 - DNA, 759 bp, Oryza sativa
  unsure (1)..(759): unsure at all n locations
nnnnnnnnnnnnnnnnnnnnnnnnnnnnnnnnnnnnnnnnnnnnnnnnnnnnnnnattgaatcccaatttgtaaaattatgttgatttaaattattgcattatcgctttatttaaattcccgcgttatcactgttttatctagccatgcctatttacctttgttacgaccttattattattgtattgttagtatttcctttttcaccctagatcaaacaaaaccccaactagtggacactctactcatggtaccactagcatgattttaggtagatgcttcgctgtttaattaggtaacattaggtggttttacaactctagactttgggaatattcatatcacctggacactttggaactgttggattatcgtggaattggcttcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgcggcccggtagtcgagatgtcatggcacaaggccggtgtcctcctgctaggggctcagtcctgcctgcctgtcccgggtgttccggccgtaggtgggattgggtcgggactcttg

SEQ ID NO: 20584 - DNA, 741 bp, Oryza sativa
  unsure (1)..(741): unsure at all n locations
ggggtggtagcggtacgccgtgtcgtgaaagatgtagttgtcgcgctcccgtagtctggccatcatcaagtaggctgcctcctgacaggcgtgatctgctgtgcctcctgacgcctcaactgccatgttagcgaggcaagtccccacgtagccatggacctccaagcggacacggtgaggaagctcgccactaagcggcggaatagtcgtgtactccggcgcgttggggtagcccaccaccagtgtcatgcgtgccagctctgccacaaagtcgatcatgccttctccgcggtggttgggtgggtggccagccatctagagaagacaaaggagtaggatcaatgcatgctcaaatccaaatttaaataaggcaataaaagactcaaataagggaaacgaataagagcgaaatttttatgcatagatcattttgcatgagagcgaataaacaagacagacccacataacgataaaataatgagaaattagatatatactaataataacaaataaagcataaataccttgcaacccatgttcctgagataggacctaatgcatttcacccatcaaaccccaactgactgacgaataaatcccaatagttttactaaaaccctagactgacccgttttgaaaaaactcacttaacgagcgaccaagattttttcccttgaaccacaaaaacannnnnnnnnnnnnnnnnnnnnnnnnnnnnnnnnnnnnnnnnnnnnnnnnnng

SEQ ID NO: 20585 - DNA, 568 bp, Oryza sativa
cattccaatttcaaccaaacttttaattttggtcgtgaactaaacacatccttgtttcaaaatggaagaatggagtaggtcgtactagctcgagaaccgcgtggcaaaaggagttgtggactgactgtcaaggagaagctccaggagtaggtgacggaagagatccagcgcctaagattactcatcatgatatgcctctcaaatcttggtgatgtcatccaatagtagctggtggggtggcattttagctagagaaggataggtacggggagagtgttgatatctaatctgatcttcgcctgtcaatcgcgcttgagatgacctgtttttgatggtctgatgtgatcccaagatcccatccgatctgcagccctggatttactgaagccacctgctgatgtagagtagggatagtgttttatccgttcttgctcgttttgtcgcctcctttctggcgcagagggaggaaacaggaaagagatggagtagtaagtttgaggttgatggataaacaagatcaggttaatattagaacagactgattagtgatcactgatgtgatgggttg

SEQ ID NO: 20586 - DNA, 1155 bp, Oryza sativa
  unsure (1)..(1155): unsure at all n locations
ttttcataaacagacggagatttgtatagttgccgtccgaatgaccttctgatgggacggcccacaactacccccactttcgccgggagcaggtgcgacgtggaatcgtggctgtctgctgacgacatgaccggtatcagaccagtcacgtcggtcattcttgtccaccacgtgtcagcttaacaatctacatgctcgcccttcttcacacaacatcttacctgtaatggttaggatgaagcctggcatatatctgaccaggactaacgtgccatctttgggaggtaacacgctagctccagctggggacgagcgcctagaagccctcgtcctgacgggatggggcgaggcgtgcgtcagatcgcttgtcgccacctaacccgcgatctgaccggtctgtgactggtcacagaccggataaacgagtgcactgcactgcgttacatgcggcgtgacacgctcagccaaaccgcaataaatgtggttaggtgagccccactgngctcacctaacccatacccgcggagcaaaaacccacgaggggtcggggctccctcggccctcggggccgaggggggttgccgccccaccccctcggtgggactaaaaggagggcgaacgcataacccttgggcccgacattccttcgggggtaccaggccacgtgtgcgattgtgtctgcctcaaacctctagtcatgatactcctgatcccatgtcaccgacagtagcccccggcgttatgcaaggcggatcgccctctttaaggaaaacggtcgggcgtgacgccactcttaagacctggtgacaggtgggaccggtctccacaattgggcagaaacccaacggtcccaaaccacgcacatcggcaatggtaactcggctgtcaacaatgagcggtctcttcaagactgccccattacttgagtagcccccgaatctggccatggcgattcgtttcgtctgaagatatggtaacgtcgcttcggtcggcagcgtaattaacgcgcgcacgatatgatctatctcgattgccacaaccgcatatccacttcatgcgccgcaagcgggcgaatgggattagtggaagcgtgggcgcgagaaacgagggggcgaaatagtgggcgcgagaagcgaggagccgggcacagcgttg

SEQ ID NO: 20587 - DNA, 327 bp, Oryza sativa
catcatgaacctgatctattgtatagttgtagtggtatgaaagttcttggcggggtggaatgtcctcacaggcaaagaacataatgtgaggtacactcttgtcgtcatgatcatataggacattttgtgcataaaggttaggggtgcaactatggttgatgaatttgcaaagttgcccatctttgaagcatcaacagcaaagccagcttcctcatctttatcaggacccttctgaagtgagggtatggatcttgataggccctcccaaagggcttcatcataataattatgaccaatagcgaataagtattcatcggtcgacctttt

SEQ ID NO: 20588 - DNA, 374 bp, Oryza sativa
cagaagatgataagataacttaagactaagcagaataaacatacttgctcaaatttatatgttggtgaaatgaagtatttcgattcatcaaattcaccaatcgctagatcaaccgggcctctagagtatgatccatcctgaaaatcaagcagcagcagccaaaataataagtactaggattttcataaacaagaataaatagcacaaaaaatattgaattataagagttataacgatagtccagtctcgcagggaagaataatgaccagaaaataatctgcctgaacaataacggatacaccaaacgtcacggcattttagtgcaaaaggagtaaagagtttttcagtgattctcagtatcaatttgacctaga

SEQ ID NO: 20589 - DNA, 659 bp, Oryza sativa
gtgttcattttatagtaccacaatatgggtgtctgaaatagcaccttagaacccacaattccacaaacaaacaccatgggtgctgatactatccgcatatcatacctgatgctctccatttgaaccatcgtacggtacctctatccggttctgtaatctctgcagacaacactcctgcagggcagaaaaaaaattccgtcattcgtgaagagaacttccatgcctcacttactaccacattggcatcacattatcacaaccaccttcgctagccatctctccaaatgccaattaaggttcgaattaacctgattcaattttatttttcttataaatcacaatctacgcttgcagggatcgatcataccaatactaccataggccgatttgcatacatacatatacccaccatccatccaaaaaaacaacttcaagctacgtaaaaaccgatcgcatgatcacatcacgacatggctttaccaagcattgacgaggagcagagtattttgtttgtgcattgtggagtttcacctgagcggggctcaaatcgaaggagatgcgctggtcgctgtccctcctctgcgcgcagacgcaagagaaccccctcccgatccacgccgttgaccccgccacgacctccgctgcggcgcgcaagccaa

SEQ ID NO: 20590 - DNA, 700 bp, Oryza sativa
agcaatacagagaacttgaagtctactcgctaggaatttcgtcgaagccatctcgacaaggatctcgtcggtaactttgggatcagttgttctctcttataatctatggatttccatatcaatctcatataaactggattatgactattaacttacgagtggtccaaaacagtataatccatgtcttcttatttgcttgatgtcgaatcgtgtagattttcgtaccaacgtaccccaatacccatactattcggtttacaggtatctctcatcgacaaagaggtatcgaagaaataaatattttcgatttatgaatcgagatagataagaacatccccagcagctcatctatatttggtcctgcaaatgtccatatggagtatcatccaaaaaaagaatatcccattatcctatattttaggaatatctttccaactaactttacatttgtattttaagggatatatttccaactaacttaattttaacggtgttatttatcacgataatattttgaaacgagtaaattttaacggatatatttttaattgatagttttttaattgatatatttgaattgagggaaacatttttttatatattcgtagcatcatcaataaaataaaatgtacataaaaacacagcaaaaaatattcctatttcctatttccttttactctattcctatttgctatttcct

SEQ ID NO: 20591 - DNA, 665 bp, Oryza sativa
  unsure (1)..(665): unsure at all n locations
nnnnnnnnnnnnnnnnnnnnnnnnnnnnnnnnnnnnnnnnntaatttcatatcgaacttaaatttgttggaccagattggtattgttgagttaaatcatatatttacccacagccaaagattaaacagtgatgccattgttgcttttgtgaaagctctttgcaaggtctcaatgactgagttgcagtctccaacggatcctcgtatcttctgccttacaaaaatagtagaaatcgcgtaagaatttcctagatccacttgtaaaacctacctttcactagcagatagtagctgtgacccagtacttgtcaactattctaattctgaactaaattcgtgcaggcattacaacgtgaaccgcatacgtttggtgtggtctcgaatttggaaagttctgtcagaattttttgtatctgttggactgctagaaaatctttctgttgcaatatttgtgatggattctctgaggcagctggcaatgaagtttctggaaagagaggaactggcaaactataacttccagaatgagttccttagacctttcgtgattgttatgcagaagagtaatgctccagaagtacgagagctgattgtccggtgtgtctcacagatggttctaagtcgtgtcaacaacataaaatcttgctggaagggtgtttttatggt

SEQ ID NO: 20592 - DNA, 653 bp, Oryza sativa
cattcccaattaggtggactgaggatcaatcctaagatttcattcgtggcttgtacttaactaaaaaaaatgtttttttccctcagtgtttgtcccaatttcactatcatattaatctgtttccgcaaaactaatataataataatattattattacagatggttactgatttcaaattttagtttttccaatttctgtcggtgtgacattgaagttgacagtttagttaaattcataaatatgaaaatttcctaattgtttccgttcatttccgaaaatagtaatgaaataattatattgtttccatccttagcccgtggtgattttattaatctcaagatatatcagctaagtcttttggatgtactcataggggtagcgtgtacatgtcagcatgtgagcacctgcgtttcttccatgtttgaaaaaacaaaacaaaatcttatgcttttaaactttatatatatactagaaaaaaatgctcgtgcgttgcaatgaccaacgggagaagtttattttaatcttattattattgttatatggtttagttaagataaaattcactgtgggagttcgcttggatatatatatatatatatatatatatatatatatatatatatatatatatatatatatatatatatatata

SEQ ID NO: 20593 - DNA, 8652 bp, Oryza sativa
  unsure (1)..(8652): unsure at all n locations
nnnnnnnnnnnnnnnnnnnnnnnnnnnnnnnnnntgatcgaattggatggctcctacaatttttttctctcttttttgcgagagaccagcaagtcgcggcaaaagtgctgagatggagcatggccatcttgagatgaaggttgacactaacagtgatcggtgcctgtcgatctcctccattgccaactatataatactccctccatccctaaatattcgacaccgttgacttttttaaacatatttgatcgttcgtcttattcaaaaacttttatgaaatatgtaaaactatatgtatacataaaaagtatatttaacaataaatcaaatgataggaaaagaattaataattacttaaattaagatgaacgatcaaacatgtttaaaaaagttaatggcgccaaatatttaggaacggagggagtatcttcttcgccattattggaggaaccatcgagaattcgaattatagcctgttttgtaatcaaaagccatacataagaacaattcacatctgtgttcagaaatacgtcgaatcttcagtcgacgagcctttgcattccatcccttagggcctgtttggcacagctccagctccagctccacccctcctggagctggagctcagccaaacagtttcatctccactaaaactgggagtggagctgtctcacaaaatgaactagagttgtgaagttgggtttaggcagctccacaactctactccagacccaactcctgaagttaaatttaggagttggagctgtaccaaacaggcccttaatttgagtcgtggagtctgtatctatcattttggcaatgcaaaactaagatgatctcccagcaaggctgtgccaactactctttttctgtttgggattaaactttagtgatccaaaataacaatctgcagaaccaacaaagcaaaaccagccagtcacacaggcttgcagaaccaacaaaccgtgcttaaaaaagagataaaatatgtatcttaatcagaaaaatgctctaaatggcatataaaaataggctagaagaacaacggcaacttctccctgaaaattgacgaccctatgtgttcgtaatggcccatgtttagcaggccgccctgtaataagcccaacttttgctctccgttagaaaacgaaaaaaaaaaaggaattggcccaacttttcctctccgttaaaaccaaaaaacaaaataaagggaatttctagattaccatcgacattgctccgttaacttttggactattatatttgctttaaaattcatgctagcaagtatgagaacaaataaattggcaagtgcagctgctgtgattcaatctcacgcccttgagttcattgaagatctatgctgccatcgcgccatacaatttttgtgatagttttatcctagttatatacaagttacaatatacttacacttttgttacactatagttacatttgaatgttttgtatagaaaaaacttgtgacagtttcttagatagtccactaaataaataaatactactataaaccggtataacaatattaccaaataatcatgagggaaggtacgttattacaccttaatgatttgggattcgctgaacttgtttttgacagtggatggtacatttggtgggaaaggaggcaaatggtgaaatgattcagatgattgctacatcagctatatctattgttgctcttacactaaattataaaatggtaaggaaaaacatggatgcaaaccacatatgaaggatgtagatgcttcttttggtattgtttcgagtagaggaggagccggagcaatcatacaagacgcacaaggaaattttatagctggttcttgcatgtacttacctcatactatttgatgtagccatggtagaagactaaaggctacgtcctcagggaaggatacattcttacctagcaaattagcaaattggttgtcaaaatattattacccaaacatactacttgcaagtgggggaaacgatgtaacccgaatatttttggacaacgttttttaatgtgatattataaaagtctttgtcgagcgctataatagggaagctaattttctagcaaatatacttaaacatacgtctattttaaagtgttcttgattaggttgatgagcctcataattttttttgctaaacattctagctaacgatgtaactgtattttcatacaataaaacgcgccaagtggctttcctaaggaatatgaaaaagtactaccaaaaataggagtacaacagcaaagcttccaacaccgtccgattctcatagcgaagatcagaagcagcataaagccactatctcccaagcgagatttttctttaccagaagcggttaaaaaaatgcagaaacagtaaaaaaaaagaagggaaaaaaaacaataaaccggagcgggtgaaacaaacccgctttagttcaaagcgttccccctgttcatttcaacctcttttttcctctcccgtcgtcgtctcccccgtctccggttagggtttcggccgttcgccgccttcgcttccgcttccgcttccgccgccgccgttcgccagggggagcccttttaacctaaccgttcccgtttttctctccccgtcgaccccgacgggctacggttctacaccctccccggctcggttcgtgtctgttcgcccgcggggacgctgtttccggcgggcggaggcgcggccgcggcgtcgcggctcctcctcggaggcacggtgcgggcgacggccctcctcctctccttccccgaccctctctctctatctcactctctctgccctagccttctacgctgtgtggaggcgtcgtcgcgcgcgcgcgcccggacggcgagcatctggatttgagcctaattgaaggtattttgttcatcctcctatgcgatatgggcttggatttatttgtttctctctaattaacacttccaattcgttcgatttgcttaattttgttgcatgcgtggtgtggtgctaatggcagtttgtttgtttccaaaaataattttggggtacagctgaacccccatggcccagtttaggtctgcgcctgtggaaagcgaggcggagccaggcgccgatggccctgtggatgaagccaatgctgtggaagaggagaaatctggtaagggtgaggatggcattgaggaggctgccgataccgttgattccgtgaaggattcagcaaagcctgaaggcatggatgcaaaggaggaggcggtggagcaggagggtggggccgcagcggataaggcaaaggatattcctgtgactagtaacggtaagacggatgctggcggaaatgaggtggctgaaatgaaggttgaaaaattggagaatggtgatgggcatttgaaggcggacggcgatagcaatggtgataacaagggtgctgatggtgagaaacagcttatgttagcgtcagctggggaggacgtggaggacccggtgctgtccaagcttgcaagcaactccttcatgtttgattacagctgtggtggtgatgactcggggactgaggaggagcaggctgctttcatgaaggaacttgagcggttttacagggagaagcttatggaattcaagcccccgaagttctatggtgaagggttgaattgcctcaagttagtacaaggacctctttgtctgtatgttagaatttgttatgtgctatggacatgaactaattttatcttgattttaattttttttataggttgtggagacaagtgactgggttgggtggctatgatcaggtactcattttgatgccttattgaataatatctgaccatctgggttatagtgtcttttggattacttgcttgctattatgcattgcaatggacagcaaataaatagactacaaaactcaaaacaaaaaatacgaaaaaaatatttccaactcaaaacttgtatgaccacatgagatcatttggcctatatatgatcatgtgaaaatgatgcatttttccttattaaaaaaacttgcaaacaatacatccatgtctaccacgtatatatagccacagaagatcctctgaactgagggtggctgtagaacacacctgtcactcccaaaaggttccaagtccttttgtaagattaaatatttactttctgcacatattatgtatttatgagctgggaacattaagattataggactacaatatactgttttacttattttttccctttataaactagttcaagaaaacaaatccaatatatgtatcatacagggttggttatgtgagttttttttttggcacttcggcaatatgcttatccagttgttacttccttttgttatgttagaatggaaggcccatttggaattttgaaaatgattccaacagcaagctataagccaagcaaaacaacaacaaaaaaaaaaggatttaggcttttagcatgtaatgagtttttggtatgccagtttgttatcataacgtgcatatctgattccacacctgtatataaagtggaagatgtggattttaatttgcctacctatttttctttccatataccatcagatcctattaatttgatgcattgtgtgcaaagtgtctgccactattatttctgaatctaatctgttttcggaccttttctcctgaaatattcaactgacctgattaagtgagtcaagaaaatagagatcaaaatcgacacttctatttcctacagtacatacaccaatcatgatgacagttccatttgcacagtagtgagactgaccatatataagttcagttcttgttcaccaaattgatatctctaagctattattaatttctttgtgttactaaaatatttatatgccgcattgtgatttcgtgacattgttgtataatctttaggtaatgtgcactgcatgcttgcttactagttgcatcaacaggtgacatcgtgcaaactgtggcggcaagtgggagagtctttcaaacctccgaagtatgtatctgatttcttctgcattctgttcaggccatttggtgaatctcaattgaattgtgcaatgatggaagctcgaacttggttggcataagctcagatttgaatactctttatgttttatgcaggacatgcacaactgtttcatggaccttccgtaacttctatgagaaggtatgtagatttcagagcctggacaaccttgtctgcagttttagttctctagttgcagcactgttgtggttgaatcctgtattcccctctcacgtcatgagccaatgacaaccacagtagttaattgaagaaaaaaaatcaattcatttaacatattctaagattttgcatgattcttgtaaaaggagtcttgaaacaaaagtacacgcaatactttggaagttttgccaaactgtcaacataagattatgcccttaaatgcgatcccatctcgatgaccgtcacatagatgtggatcatatttgaggctattttctcttggtttatattacttggtagataagcacaggtgctggtttgcatgatttgtttttctctttgaattgcacaagcagaatgcagcaggaacactggttcttatctgggggaaactgcgtgtataataaaatttaaacaccaatgcattttgtcaagagtagtgttgtattttaaatcagcattggttttatttttgcccccttctgtctcaccgaccctctttattgtttttgttccatgcaggcactccttgaatatgagaaacacaaaatcgaaacgggcgagtttcaagttgctgcatctaatttaacagagaggattacttctgaaagtcaggtacagtagtatgacggctagcataagttttccatgatccctgtggaaatcagacataaatgggtcctgtttctaactattatttatgtcccaaaatataagaaattttgggcttagacacgggtagtaagaaagtaggtgaaattaaatggggaaagattgtgattggttgagaagagaatgtaggtagagaagttatattttggaataaattttgaaatgctagaagttatattttgggagtaatttaaaaggaactgatttcagatggaatgaagattcattctgcatttaaatttttgacttcctttattgcagatgtttgtttagttgtgttaaatacttcagcaggaaatatgttatttttttgagatgtgtaagtaaggatcttaaaaaggatgagcttataatcttgatacaggttggcatccatgcttctggttctggaagagctagaagagaatctgcaacccgagctatgcaaggctggcactctcagcgcttgcttggcaatggtgaaattgctgatccaataattaaagtacgtgttcgttcaagtcaaattgtcattagtgacttgcaatttgttgtatcagtaaccttttgtttttaccaggataaagggacggtgtctgtcttaaaaaaggataaaactcctaaaagcagcggtaccatttcttgatttttattttttaaacatcatcatgctattatttacttatgttgctttttttaggttctgccaagaggaaaaggacaccgaccttggaagatgacaggattgtaccatataaacctgacaagctacagtaagtcttgcagatgattctctttcctttgtcatcgagcatccacaggaatcatgtaatattactgtaggcaccagtctgttcttttgaatgtcacgatgatattataaggctcatccagttaactatttgggttttggcatgccaattgattttttcactcttccaccctcaatttgtatggatgtgaaactgtgaactgatttcaattatttctatttggcagaaatgactcaatggttcttgaccttggccctccagctgattgggtaaagataaacgttcggagaaccgtaagtatctcatttggatcatcatattttacctttttcatgcttttttggcctcttttagccacttgcccatattttccagttctagtagttctccacagaagttctgaaaaacaatgctagcgaaacgcatattatgtttgaaatctgtagaactatcgtggaagttagaaacagcatgtgttaaccagaaatcaggggaaacatatttttcatggtcattttgtaaaggaaaatatcttttttcttgcagaaagattgctatgaagtctatgcattggttcctggccttctgcgtgaggaggtaaataaattctccattcaattagcaagcatgcagttagacgcttttggttcagttatcatttaccaagcactcctctgtcataagttggcaacgtgtcctatgcacacaagttccggttgcactaactgtgcacaccaactgagagatgccctaaaagaatccaaaagaatttctgcgtatacttgtaatcttattccacctatctatgaatttcaagtttagactcatactgcaaaagttggaatgactttggtactttggttctagatattccttattcatatctaatacattgatgcaggtacatgttcagtcagatcctgctggccgtttgatagttactggagagcctgagcaactagacaatccttggggtgttactccattcaagaaggtctgtcaagtgttaaccttttgaatttatttgatgtttcattttataattgtattctttggcattgaaaacggtacacttacttcaggttattagtttgccctcccgcattgatcctcatcaaacttcggcagttgtcactctccatggacagctatttgtccgtgcaccattcgagcagtcaaagtaaatggtgctctacaagatgaagcgcaacatgcaagtatgcccttgttccctaaagatgcgctgcaaacttacgtgttctgaagttgtcgtctgtatgaaagtaatgaaaatgaaagcatgttagtgaactggtaaaattttaagatgggcgcagaggatgttagtgaactgtaaatcttgtgtagtcgtttagatagtttcttgtggttgaatgccattgaactgttgtaatctgtttgtttcctgagtcataaatggtagaactcaacattgttgttgctggacagtagtaagttgcaatgggtttatgatttgcattctttagtgttattttcgagttaaattaagcacatgttttgagactaggacacacctgaactaatccacttcctttcttgcagggttgcttttgtaggtgggggtttatgtgattgacttgggcctgttcatcctgatcttcgttgcaaactagttactttctgcttcattactcctgccatgttgtctattctgtattgattaattctagttaactagatggtctagttatgtatcttgtagttcgttaattgtgatatgtagcttaagttcagctctattagtttagaatgttaatagcctgatgctaaacatgttcatggtttctttcttccttttttttttctcaactaaagaaaaggtgataatttgtagcatgtagcttgtgaggttattcctaatactcagttctcatactactcagaacatgaagacaagatagattcttggatgtaactgttgccttgtgcattgctgttgtatctgtataactnnnnnnnnnnnnnnnnnnnnnnnnnnnnnnnnnnnnnnn

SEQ ID NO: 20594 - DNA, 1390 bp, Oryza sativa
tgtatcttgcaattcgttaattgtgatatgtagcttaagttcagctctattagtttagaatgttaatagcctgatgctaaacatgttcatggtttctttcttccttttttttttctcaactaaagaaaaggtgataatttgtagcatgtagcttgtgaggttattcctaatactcagttctcatactactcagaacatgaagacaagatagattcttggatgtaactgttgccttgtgcattgctgttgtatctgtataactgaattgacaactgtgcctgaccatcccttgaaactattactgatggtgtatcaattgtttttagtgttatcttgaaacgagtcttagttctaattggctaactacgtgaagtgaaatatcacagcgttgtcaagtcagttaaaagatgagaacaatgctgttctctcttttcttggggattggccttggtgcttgcagaggattcagaacctcgttgctttactagtactacattgcttataatatatcttcaaaattattgcagaaattttgtttcattattgtgttattcatgccagtgatagcaaatgaaattaccctttcagggctcttcttgtcctatcagtctatcacaatacaagagctactatttaactacaaggtgctgaatgtactagcaaacgacaaacacaaaaccatggtacaaatatatgatgttgaaaacaatcttaagaaattctgcaattgcaacgtagaacacgaggtacacggttcgttattcacccatgatacgctgataggcactacgtactgacagagacagacaccaccagaatcacacacaaactttaaacttgttacgtggagcaactttgtttagccactatgcttacgtacggcttgattagatttagatcacgtgacaatttcgcataattacgagatggatattattttggtcatcctcatggctccccttttggttttgtgacgccgctgctgccgtggttgccaccggttgtggtgatcttacgttggccattgcctgtgccatctccaccatgcttgcaacggtggctgctacagatgctcggaccaggtacaatgaattgacgaacgccattagcatcatcccctcctcctcctcctcctcctcctccggcgccacttacatcgcctctgccaccgccaccaccactactctcccagccgccaccgccatcaccgctttgcgcattgtcgctaccgccatcacctccacctcctttgtttccaccaccgatgacatttctgctaccaccattagatccttttattttgcctctgccaccactgttgattcctcgatctccgttttgaccatttccacgacctatgccactgcccatacctctacctctaccctac

SEQ ID NO: 20595 - DNA, 4259 bp, Oryza sativa
tgagctaagctgccattttggggtggctggctcgcgtatttatagccttcagggcgactttggtgagcagagcactatagagtatagagatccatgcactttgtatcggtaagaacatgtcggcgaagtggaggagttccgtgtaaatcgcttatgctacaagcgatgatggatgtgtgcgtccgtcctactacagaaatgattttcacggaccataggtttttcttttcggaatcaggaactgaacaacacagtgacagtgtatgattggttaattatctgacgactctcaggatccccgatgatttatagatggtgatcactgagctcataaccaatttggagatttttataggttatgaaacggatgtataaaaaatgtgccagaccattgtcttacaatatatatatcctttgctttcttggaaaaaggctgcaaaattccagcatgggtcatcgatcaatcagtgcctctttgctttagcaacaaatcaaatacatgcatatatactcttacataggctacggtagtagccattcttcaacatcaaggatgaccacatagcgtaaaaggaatcaattggaatccatctcccaatcttaacgaaattggtcgaccgaacttttggccaacccggcaaaatcaataggaatccatgactctctaagtatgcccgtaaccataacaggttaacaaaatcggtcggttttcatgaaactgtcagcggttggtttgtaaaaaccgattaatttgtatggagttgactaacagtcaaacaacttttggcatgttttcgtttagttcttggcaaacggcggtggggactgattttcactttaaaatatctgaaggtaaacactaccttatatcaaggcttagtaccatgagaagttaaaaccagtgggtcaccatgctaagcacaaatgaacaacactgcacggtttaatcaatttcatatacacattatatgattgatacaaggggagaagcaccgataatatgttggtgaagttgtaatgtatgagtctacccaccaagatttaaatattggtgtccataaatattacgtgcatatatgtacacgcttttagtaagatttttaaataaggtggaggatttatcgttggtcttcatctcttgcagacacgttcgcagggacgtggcgctgggttgtttatctatggactattaattttgtggagagccaatacaaattttagcaagataagggatttatagctagtctccatatcttgagacattcgccggggtgtatggctaggctgttcatttgtgaactatttattttgagagccaatgagctaatccactagccgttgagttgttcttctaatcttgggcttaagattgctcgatttggttttagtcggttcgaaatggaactaggtattagcaccccaattatgtgatgtatagtggtgagtgcacatattgatacatgtttttccatatctttctttactagtttaaaaccatagttggtcttctttctctgtaaaaaaccgcgccctcttcttcctttaaaaaactccctagaaaaccactcccctttttctgaaaaaccacccatcaaatccgtaagtagtaataaaaaataacactcagatttgatactttcactatgcaattaagcatggcaaaaaccatgcaacacagcacccgttgatctttttagataatgaaagcttaaatacaccaagatgatatatttcaatcgagtctatccccggcctctgcatagaatgtacacagccaaaaaactagatctaagaagacttctctatcacaaaagacagaaactagtggctattaatccgtaaactagacctccacccatgcttctgggtaaaatccagtaaaaaaaaaagagcaagaaacctcacgtacgtgagaacgaggcaactagcagatcgaatcactgtgatcacggcgggcgccgacgaggccagctagcggcggcggcggcgacgacgacgacgtggttaatttgatttctgttcgatcggagtcgcagctgtttgttagatcgctaattgttttgtcgacgacaacgctttctgcctgacttcctgccaatgggaagcccacgtacgattgaattgcttgtacagataaaaagaggaagcatatatatacatcgatctggatgtgattaattagtgagtgccagcacggcatgcacactaattacttaatttaatcggttttgctgcatgcataatatgcatcagtgcgtcgtgttggtaggtcaattatattagtcatttgagttcgaatgaaattatgaactcctttgcaatgccaatgcatatatagtcagttagtaacacaaatacactagctagtagcaagtacatgagcaataattgcgagccggccgccatcgtgatgattgctctggccttttagctaagaaacaagaagaaaatgaaagaaatgtttacagcaacaacctgttggtctctcgtctcttgatgaaagcaaatgtaatatcaggagagtgtttcgagtataacccagtgttttccctgtttaggtaagagaaaagggagagaactaatggtactcaactcaccattacgtgaaagcattgggcaagatctaccatctcaaatgacaacgaacgaaacaattcgtctggaaatagcttcaaatgatacagacacctcgtgttttgtgcacctgatcagccgccatatttggggggaccaaaagaatagatctcaccagatcattttaaacaggtactaccaattttaaataagtactccacacactacagattcacagcatctaaaagtaaactcacctttgccagtaattgcttatccctattactttttttctttaatcatttcctaatcataatgggctagcagcaatcacaaggctactgccaagataagagaacgaaggctagactttgcttgaaaataaaggctttcatatttcataactttatctatgcaccacttacagtggaacaaagctgactcactgaagcaatccatccttgtgccttctccatttcttttgacttgagcagaaatgctaacaaccttgaatatgacaccaggtaaaacagttcatgcgatacgcgatctgcttcagtcagcagatcgctccgataattaccattatttgtcaatgatttctttcagtaatctgacaattctacaatgatacagatcacattgccaacgctcttaacttacacatctaaactaatgccctggtgtgccttgtgtgatctaggctcttacatgttacatctactgctacaaaactggaaggttaatggtacatggtcgcgccccaaagagagttagtccacaggagaagcagattacgaacagcacacggtgcgcattcttccttgaatctccaggttccctcgggaagcagtgaagcacacgcagccacgctggctacaaactcgggaagcacaggcatgccaatcaatgttggttcctcccctctgttcttcggagtgagcttaaatctcatcatcatcatcatcatcatccataagttcatctggaaggtgtactttctccattgcagactgttaaacatcagatggacatggacatggacttgtgactcggttattcagacgcagatgaattgcagcattgagacttgtacgataatggtaagatactaaaactgagaaacaaaattttaactagcaatgattgctggaccaccgtaggaagagacaccaagataagttctttaaaataatatgtagtgcaggaaacaaaatgggggtggagggaggcaggtggagctttgggagtgggataagcaaagatagtgtactataccttgattatagcaacgtcagcagcaggaggtttcaaatccagggcaatgccaaagcaaaatacagccttgtcaagaatgttaagttgcttgtaaatctttcccatcagtgcatacatactactttcatgaggtgcaatttcctttagccgttccaactcatccagagcatcagggtatttttgtaggcctagaaggattaaagccttttgatacttggggagtggattcttcttatcagcaaatatagcgttctccatcatttccaaggcttcctcattcctctgaaagtttcgattcagaaagaaggttcatagttaatcattgtccagatgatgatgaaaattctagttttgagggtaagtggaaaccaaaaattagtatatggtactccctccgtttcgaaatg

SEQ ID NO: 20596 - DNA, 28749 bp, Oryza sativa
catttcgaaacggagggagtattatatcacctttaaagcatgcaaggccatcccaagatagcacataagaacagaagagcaaggatttatctggaatgcccttctgaaatgatgctcagcaaactcaaacttttcctggcgaaggtacaccactccaaggccataccaggcattgtagtgtctttcatctacctgaagtgcagagcggtatagttttatactgttctcataatcctccaatgcagaatacctacagttcaaaggaatggcagtatagttagaaattttcgacaggtgatctcaaacattaatacaagataagaaactcatatgtgcaccagttataagatagtgtgaacgaaaacatactcgtgaccgcatagcgtgtgagcgtatgcaactcttgagtcaagctgtacagcacgttgaaaattcttcaaggcagtctcatgatctttcctcaaggcaaagcaatttcccacagcacaccttttgaacatttaaaaacagatacattagaaaatgtaacacaatattatgtcagcttaaaagcatttccactaaagatctgtaattgtctccttgcttcatccagatgttttgcacagcatcaggactaagacaaagttatcatggactaacaaaatcaatcaagtagatgtgttgctttaacatctattaattactttcagtaaagcacatttgcagagttccattttggcatttggtccaaaatatcattcacttgctgggcataaaaagacgaaccatgcttggggagatagtcgatcaatagaaacaagatcttgagcaaggtaacttagccgcatttcctcattcaaatgctgcaaaagagaaacaaagctggtgaaattggaggcaaaaggtgggaataaagtactctcaagtacaagagcagttagtccacttacataaagaacagtggagtaaatgtccattccctccaacgtgcatggtgatagtcgatgcgctaactcaaaaaaatgatcggcttctaaataattgacgagttcaaaatatgtcttcccaacctgcaccgttgaccaaaatgaaaacaatttttaattgtgaaaaggaacaaaattacagggtactgttaatatctgtacagtgaaaaaaatattatggcgtgactttttattattaagttgagtatatagaagtggaaatgaaataccagatgtagagtggctcatgtgcaagtaaacatggttatgctgagtgactggaaattccaacaatcagcattcagggccaatgttcaactacagttcaagttatcattttactaatgtcaattctccagattgacccaactaacatatatacaattaccataatgaattcatcacattatcacgtatcagattaatttaaataaactcgtagtttcttttagaaaacgaggaaacaaatatgctatacattacgatacagaccctgaatcattactatacagtccctatgcctcatgccctcatgaataacgtagatacactcatacaaaaccagttttccaaaagttagccctaggagcagagtaaccaccccaattaggcattagattgtcaattaggcggcaaactatccatgaaggttctggtgtagctattttagtgttctattgtttaacttctatgtcatatacttgctaattgcttgggatttactaatcatgttggacctaggctacggccctgcagaccctctagcgcctaccaccttcttgaaccatgtacaaaactaaaggtttttcattacaaaatcaaaagcatgaagataagtcgccaaccattttgcaggggctgtacctggcaaagaacccatccagtattaaattgtgcctctgggagctttctatatacttccaatgcttcctgatcattaagtgaatgaaatcaaccacataacaggatagtaggttagcatttccaacacaaacatcgtgaacatacctgacacttaaacaagcaagaaagcctatacccttcccctagtgtccgcaagagtgccattagctccctgataccaatagctaatttggagtcctgtgacagaactcgttcagatttctcttgctcgggatatcttccatcaactatacttgtagaagacgaagttgaagttacattatctgtccacatttcatcaacaacgtggtacctgtttcctatggttcagaaggggaaataaaaccatcgtgaatattaatgcaccattcatatagagaaagctgatgcgattattatgataattataatttcacaaaccacgtaattatgatatcgaaaaggataagttgatggattggatgatcctgcatccagtgaaggagaaggatgtgtgatcattttaaaagtcttaagtgttagggctcttgaaacaggattcatggtgcaagaaagttctttcgatttttttttatcacaataatcaggaaaccctatccataggagtgaaaagttcaaacaagcaatgatacagtaaaaatgtatgaatctggatgtaaatatttatgtattttaggaataatgatctaacatgaggcgccaaagaaaaggataagcaattctgcagttcatatgctacatgaagaagaaactaaaaacaatatgataacggagacacttcaagggttgaatgatagctgataatgttctggtggtattatagatgcttaaaatttcagctcaataatagagatatttaaaaggtatatggattaacatgaacagccaataaattcggtgagtagttgcatgatgtttcttagcatcctaaatgccttgtgagttgtggcttggtgtcattattgtacttttcaagtacaatcaatacaatattgatgagtgagttttactaatgtgaacccattgcacatgaacatataagcaaacatgcagatatatcctgattgcagtgtctataacaacatatcaaccacattttttgcgaggcttatataatttgaggcttatataatttgaggcttatataatttgatgagtcatccatgtcgaaatggtaatcaccttcatcaaaattttctgttgcctgtggtttccctttcctaacttgcacggaacgtagagctgttgaacacaattttgatggtgtggacgagtttactcgcaatttacctgacgagtgatctgttccattccctccaaattgagagatatttgagtttgagtttattgttgtatctctagaaagtcttgcacttcttcgaggaactgaatcactactctgattaaacagccttccagaaacctgagaaaataatcttttaactgagaaaaataatcttttaagtctggtatcatcacaagtcaaatctaaagtggggtatgagcatggtgtgaggactatcaacagaaagaacataaaagagactatacagccagacctcaaagcaacagaacaatagaaacataggtccaatattagacgagatgagctctaacgaaggcaataataaatcaaagatgaaaagaacgaaactacaaaaaatatttgctggttccacagtccgtactacatggacaaacctgtgaaaacaaaatgaaaacaatgataatatcccactattattgaacaaaaagaatgctgatggaaaagtgaagaacgtaaggcgctatgcaaagatgaaaatgaggcaacaatctagcagctagaatgttacaaaaacaccatcggagatatacttcaaagttaatgaatggtaaactatcaaaaattgacaaatcagctattatcaggtaaactatctcgtcgctggggttgggtgttggtacaaacttgatgggtagtctggtactgtcaaacagaactatccatagtcaatgaatcttaattaatgggcaatacaaactaacaaataaaaagaagaccgcaatcacaaactttgcaatgcagacgcagttaggtagaagcaagggatcaacatcttgaatcctgatagaacagccatgactgaaactctacagactcatacaaccagcaagtattaggctgtaaatgcaatgagccaatgaatactaatgcattaacaagcaatgctagtatgcacatctggagaggatcagcaagtatgtggtttactccaaacacgtatcattttccgagaggtttaatctaacaatttaaattattgaaagaggacagtcgaccgagagaaacctagaagctcaagagatcagtagaaattatagaagttgcaagacagtatctttcagttgaggaaacaacaaccttctttaggcttgcttcatcgatgtatttttttcggagtgtcaggttcggagcattaacttttggtttggaaggagcattgccacctgctgtattctgataagcatgcatattccgaaagagtggtggtggagcaatgccagaagcctgcaaaaattaaattaattaaatagaaaattgtgatagcgcaaccatagatcacatgtctttacactgtattgtgatgttgtttaaagtgtgctatatgcttctgtcactctttcactgctcatcatcatatccaccatgaagcatataacagtgaaccaaaagatacaaactttgctgtgagtataatttgatttttcgctttccttttccttgtgatttaacatttggcagattatttacatttttgttactcataacatgtaattagtttgattttgatttttttacacctagtcagagtaaatgagaagtacatcaagaaagtgcacaactgcactacaaagggtatgttgcacttcaagagctgctgtctaacaccaagttgttactcttcatgtgcaaaaaggtcaactgaaagcatgtgattcagagaaacaataatgacaatatgccaaatctttcttgcaaacaaaggtaagaagaggatctagataaaccaaatgtgcagattctggagaattcctcaaagtacgaattgattgtatctggttaatcctactgggtgaagaaccaaacaagttttgctgacctgcgttgaagttggcgatggagtgtcaaactgtgataaattagatggtgcaccgttctgcatatgcaatgcagttgactttacatgaggataaccagatacttctgcagtggtgttagcatgcagctgtttaatttgcttaggactatcaccaaaacttgctgacacattggaagatagaaaccgattttcattaacaaagtttgacttttccacatttgatgtggatgtgagttcctgctgaagacgtagagctgttgcttcactgaaacattcatttgcatcttcagcaacacctacaagatagttaattagtgacacacatggtatatgcttgcttttatatttagtgagtatgaggccttcaatataaggactactgggccatagtgtaactgcaacggtatgcaaaaataataatgtatcaacattaggcatatcaatgggcatgtatggcaatgaactaatccctgttttttttataaggtctctaaatgtgaaaatcatgataacaagaaagtactttcaaaagtgaatctaatgacaccaattctgtatcgcagcctctgcatattgttggactatttgttggtcaaaaaatcgacagagggagtaatgaacataatggctaaaaatattatgcctgtttattgatctatcaagctaataatgaatgacagaataaaactactatgatgcaaaacacataacaggcctattgaaggtctactgcaagtcacatattttggatgacgtgttcttcttcagaaaaatcaacactgtacttttcatttcctactactagacatttaggaaataaatctttgtggtgaagcaacacttgacgcatgtaattctaatgtataaaactaggaatggaggtgctaaaaaacttcactcatagtgtattaacgcaccaacctagtatgcacaattcctcgtatgctgcccatagaagaggatcaagagtcagagcttgtacaaattgctcagctgcagcttccactctgccagtgtacctacatgcagatgtggtaaatacaatgaactatctgacacaactaatggatcaagatatgctgtgattatagatttagttacgagttatgacatgaatattaaacctgtaaattactccaagaaggtagtgccctgttgcaccacttggaacctgcacaaaggaacgaaacaacatataagaaataagttaccaaaataacaatccctcagtttctatttataggtcatattaggagttgtcaagttggcacaagattaagaagagtctaaaaccatgagaaagagaggttaagatgagtagatgaccattctacccgtacttaaataaattcgaaatatagagctgatggttagtgagttcattcgcattaatttaagaggtattatgtcaaaaatgagggtaaacaaggaataaaagcaataaactcacatgcattccttatattttggaaaagtattgaagaagccttgcaaaaaagggaggaagtataacagtaagcaaagatgcaaactgattttttttccacatcattacttcacccgtgtggaatcaaacagttagtggacaacctcaaaatgctgtcatgcacccaaagaaaaaaaagatgtctgcagacgtttctatgcaagcaaaacatcaacttgtagtgacaatgtttctcgtgtacatcacttaatcatacatgcatattttcttttaagacatgatacacttcttgttttcacattgataacattgttgatacgatttcattgacaggcaaccaatcttaatgttttcaaatggtatatcaccagttttggaactcttaattcatgaataatcaaacatgctgcacatcccattttctacttctgatttggaatccagaagacaccatggaacaaatgatacatcatgcgaccccttgtccagaacaaaacttgagttcaagcacttacgaaaaaattaagagcgttggatgaaatatatttcaggaacacaatgaacaaataatgtttaaaaacatgctatatacctcaatatttggttcattgacaggacacaaggcttcttcagcttcccgtaagaggttcattcggaagcatgacatagcaaacaagtaccgggactctggcagcttctttcctttatgttatatcagaaataaaaatcagaaatcgctccaaagaccaaagcactttgcgaccacagaataaaatatactgaaatcacaaaacaggatagaaatgtgcccaaaaagatggacagatactatattcacatttctttgatttttaaataatgtgatttcacttctacacaataataagtggtcacgtggtgagcatatgttattacctttcaagatgtggtatgcagcatatggctggttgttgtgaaggtagcaagtcgctagcaactggacatttgtctgtgcacatgagtagtatacatttagtacaacatgtgatcctggtcatatacgaactaagagaacaaaactacacgctatcagcgatgagaaaactgaaaagactcttattacagcaaacaagtatcggattcagtttactcactatctagcttcatctcaataactgccaaacaattaaagtcatatacaaaagaaaattgaacacatgaaaaaagtaatatttggtctgcccaaacatagtcctactcgaattgttaaaagctaaagcagctaaatccacacactccagtagtccacgttgcaagatactccctccgtttcaaaatgtttgacaccgttgactttttagcacatatttgaccgttcgtcttattaaaaaaatttgtgaaatatgtaaaattatatgtgtacataaaagtatatttaacaatgaatcaaatgatatgaaaataataaataattacttaaattttttgaataagacaaatggtcaaacacgtactaaaaagtcaacggtgtcaaacattttgaaacggagggagtagcatggtagtatgggtagctaactacatagtattaacgtacaattaatctagcctttgcaacttacaatggctagtgttctaaacacccagtaaaataataagatgtaacacatcaccatagctatttcccaaccaaatcactaaaacagactgcaagagtgaaatcgtatcctatcttaggccataaaagtctttcggcacccagattatccataaaccctatggcaaccaattacagtagctctagttctctacagactgaattactgaaaccacttccccaaatggctaaatagctagaggaagcccttctcattcaaccttcccatgaacttggcccaaatctcaccactgaagctccaggcgcacgcctaaacactaaaacctaaacaatgccaataaatcgacccccccggcgcaggcgagcgcccgcaccccaaatcgccgcccccaccccccgaccaagcacccgatctgaaccgcgcttactcccagggaaacacatgcatacctcggcggggaactgggcgcagaggcgctcgcagaggaagacggcgttgcggtgcatgaagaggcggaggctgccgtggacgcggtccaccattagggtttccatcgccgccaacgctccagcggcggcggcggcggcgatgcgtgtcgggctactgcggcggcgcgcggcggccggcggcgagggtgggcaccgtttgaatcgaggaggaggagaggggaggggttgggttagattcgagggggatttttttttttttggtgttgtgttgggatttttgatttttttggattggggattcggacgaacggatcggagtttgggcttgcgcctgtgcgcgttggtgtgagtgagtgtggcgtttgaaatggtgggctgactggctggtgcggtggtgctggcgattagagcggcgcgggggaaccgcggctacgcggacacgggggatttgtctggtgcgtctgtgacatgtgggacccggggttggttgttttgaattgcgccactgtgatgtgtgatgtggggcaggctgtgtgagatttgaatttggttcaagtttaggggctgtttggatcattggatgggagggactagactaaaattagttaatctcatctaaacagggcattagccttaagatccaaactacaaccttctagatttccgttagcatgcttcctaaattgctagtataaaatatgttttgtggtaataattaatactcaattaatcacgcactattaatgatttatctcgttgcgcgagccaccgaaaatccccacacaactgctgaaacaaacgcacccttagagcaagtttaatagtatagccaactactagctacaattcatctatagccaatctaatattcccttcgtactcataaaggaagtcgtttaggacaatgtttaagtcaaaacttgggaatataaatcataaataactctcaagttgttgagtttgaaaatgtaaaaattatataaatagatttgtcttgaaaaatactttcataaaagtatacatatatcactttttaataaatatttttatagaaataagaagtcaaaattgtgttttggagaccgtgtcgctgtcctaaacgacttcctttatgagtatggagggagtagttcattcatacaatagttacatactacactattaatacatgatcccacctatcatacacatcgtgtcttggagtccgtgctacagctagttacaaatctgtagcccgctgcttttctccctagctggcttacttatagcctgctattgtacctgcttttaggcttcgccgtgtttggctagatcgtgttctttatggatgggcacggaccgaccatgcactcctcaacccaaactcgtttatttagttaaactataatgtaatttaccttacgattatgccgtaactcagtgttcagttaaaatataatggtgacaattgggcaacacaagtttgaatttggaattaaaattgtattgcctcactggggctttctttataagtacaaacacgtggggcgcgttcagtagaactaagtgataaatgcattggaggtattgttagtcatttgatctcacctctaacatgtgtaaaagaacatgctcgcatgtgtcttgactcttgagtaagggtggtggtgttgtgttttgtgtgtctttaaagggttgtttgcttcgatctcatgtattggaggtgttagtcctttgatctctcctttagcatgtgtaaatgaacatgcttgtatgagtgtggagcgagtgtagtggttttctaaggggttgtttgcttgttgcctaagtttgcacaactaatgttcggtgagtatgacataatatagaagtgcgcccatgaatttattggtcaccggtattgcatggttagcctagaaatttaagtggatgattcatgagtccaaatttagaggaaagtatagtaaagctaacttatgacactgaagcaaagaaatgtataataaactatagcatgactaaaatatgatgcggtaagatgagaccatgagccaaacattccctaagtgcacactaaaagtattcttaatggtacttatttataagagtaaatttcacaaaattatagatacttggaccaaactatcacaaatcaatagatttaaggtcttatatcacaaaactacagatttagagcaaaatttttcacaaaactacagattttggatggagtgtcacaaaaataaagattaagtagcaaaattgttacaaaactacaggtttagtgtcgatttatcccaaaactataagttctaacataatgttagtaccatggatttaaactctaaaaattgtagttttgtgataacttaaatattaaatatgtagtttcatcataacttcagtataaaatatgtaattttacgaaacttggcattaaatatgtacttgtgtgataaatttaccgctaaatatgtagttttatcatacaacgtcttcaatctatagtcaaaatatctgtagttctatgaaatttactatatttataaactcatggcatcatgttgttcatcttgaccggcttttattattgcttatcgaatcatttttctatgttcatcttggtttctacctctgatatctttttggcttatggattatgaattatcataggtacacttttcaagctttaaattgtactatttctttgaactctcttcatcaacacttataaacatgcctctttaaattagcttttcaaatctataatatttagttcgttcgtttgtgtcctctaattgttataaagtcaactttatccatcatccatcagcactttagaacaagatcttaaaattaatttgagaaaatccactcgaacatcgattcctcgagtggcgactttacaagtatatggttctcagaagagtatatgggttgctataattccgtttggttggaggaagtttttaggagagattgggagtttagagggatgatgctattaactgttttgtttggttgggagacatgagatttttggtaggatggggatggggaattgaggaagtaactccctccttttcaatacctgggtaggggtggtaattgcgagggaattcctcctttacttagcctaaacaaatctcaactatccgttttcaataatgaactaatctccaactaaactccctaccaatttccaccacctctaccaaacaagatattgggattaaaaatcaaattcccatctcaccatcaattccctcgtgtaaactcccaatccccttccttcaagttgccagacaagcctaagtcatttggttggagagatggactagttttcatgaataaaccaaaatttaactcgcttgctagcctggtactataaaattagaagagtaaatttcacataactacaaatttcttgtcaaaactattactttgctacaactttagttagacatttttcaaagctgcaacaacaaagtattttcaatcccctatcaacctatttggcaagaaaagggaaaaggaatgggagtttgaaggagggagttgatcgtgggattggtcataggagtacatttttagtccccatccattgtttggtttttgtatggaattccctcccagtctcatgaattaacaggcctccccagtaagagatcggtgggagctggatcccttaattctccatcccaaaccctctcgaattccaagtctttgaaccaaactacaaacttaaactcctattccctatcaccaacttcctccaactaaataggacgtatgtttttttacgtcagcccaattttcaacagtgtgcctgataggtggagccggttaaacatttgtaattctctggtaaaatcattgatgcacttttgtgaaactctcagctgaagttgaagcaaatactccatctgtcctaaaatatgcccatatctatagtactatatggtatcttcataaggaaaccagattcgtgcatctttcttaaaaccttcgtagaagctgcagaaccagtccttgagcagctcgaccgacagctttgctccaacatcggttggtgtggatgcatattcttcatatgacatgcatctgcgatgggtgcgctctttttcttcatcttccacaatcggctctggcagtgggaattcagcttctgttacagagggccgattgacaaccttcatgactatcaggtttaaccaagtttgcagcagccaccatggtccacctgctccaactactgagccgacggctattttagccgatgcattgttcaacatttgatacagatagcggagaagtattttgcccaaagggaattctttctttgattctagggcttcggctacaaactgccagttggttatagggccacagctggatccacagaagaggaacttttccagccacataagcaagaaagctacatgctctcgaggggtaacggatccttggcccatatatgccgccacatagccagactaaccacctatgcttttggtcttgaagtcaaattggttcttagtgttcatactcatggggttagccgatgaagtcacatctaatccagtaatcatggtgatgtcgattaaagttggagtcatcggcccttggttgaataagaaagcattgatggtattcgaccagaagtaggtggtggcagccatcagaggttcatccttaacagaattggctatggtgagagcaagtgcttggccgattccaatctcatcccagtgaactttcttactagccgatacgcgttggtaccaggtggtccagctcttatcaggtgtgggtttttcgagatatggccaagacttgaaggtattcttccagtgacccaagtcagggttggctagcctgaaggggatccggttggtttcaccaatgatgaaatcagtggggtcgagattgccgattgggctgagaaaatagtggtttttgtgtgaaaggctgggaatcgcgacttggtttgagagatgctacaaatccaagacaaccgagagaaagagagcgatgtaagataggagaaaatcgatctgctgctaagaaaggggatctagccgatggggacttacctcagcatactcggctgatggcgcattagatggattggtggaagacgacatcgctacaggcggaggtctcgtcggagatgaagtcgcccgggagtcgcttttgcgtcggaggaatcgccggagagagagaggataaagtttcgcttgagcggtgaaaacggaagtcacggtgtgagattcctcgagggtgacggttagtatttaaagcacggcaataatggtcggaaaacggcaaagtgtgaaacttgctcggagttgatttacagcaaatccgaaacattaccaaatattccggacttagggggcatgtgttaacaaccaaatttggtaatatcggcattggaaaggaagattagattgaagcgaagtcggaggcagagatcgagttcgaaaacagagcagggatcggctggagtccagatcggctacgatgagatcggctgagtctgggtcggactaggtaagctgatgtagccgatcctagcaatacaacttgatgtgtgatgtcgggttggattgaggtacttcaaggtgattgccgcacatggataaagtcctgaggaggcaattgtatctattaattaggatgttttatgtaatttccttagagatatgattgggcaaaagtctgccgcaaagacttatagtatcttagagtttgttagagacagtagtcgtgtccgttatggacatatcttgtaattctcgggtataaatagacccgagccctatgtaacttttaacacacacgttcaatacaatttcggcgcatcgccacctttttgctttagttttatttcgacgagttcttgctttcgggttgagctgcatcggtttcgatcttcaacaagaggtaaaacttgttatgacggcttgcattctcgggattagtgcttccatctttatgacactctaatcttgtttatgtaattcgtcgagttatcatatattttatataatctctggcaacaccgctatctaatctacaatcggctaacgtccgtcgaagagggcagtcgattaggttagatttcgacgttgacctagattatataagatatctaccactgtatgaaacttctagcggcttgattgtctagatattgatattcttttcatacttaatgctgcatcagttgagtttgatatattaagtcgtgcttagaatatcaatctctagcctgctttctggttgccaattagggtagcatcggagtttcagccgatcttatctgatttaattatatttgctctatatgttttattgacatgttaaatctgccctttatgccaagatattactgtatttgaatatattaggcttttgcttgatattctatacctgttttaatatcctgatataaagtagtatcggagtattagccaatacatgctatatctatctgatcggctatgctataaacatatatagtcatgttattaatatatatttcggtctaagtgatttatactgtctcggtatggcaaccgatctatcccaatcacttgatttaagtatatatcgatataaggagttcatatcgttaacatctacagccaatcaagtagatttagttctttcttacttattcaagattgccgatcgatacacataggacatcggctcaaacataaatgatatgtcatcagcatttagccgatcggctatcatttatagatttaactacgctttctttgcttctatttcttgttgattataggatcaaatcaactggcacgctagcacatccgaaggcgagctttggacctgcactggagttaagcagatctcccaggcctcgtgttttctgtcaacaagtatataattgcaaaattggctccatgccttcaaaagttcccgggttttgatttacacatcgagagtttccgatgcacttaaatactatccaaagtttctattacctttttataccacaaccgttacctttctatggccttgggactccatttgagatggttttgcaagaccaggatgtattatatctggtactgcggttcaaaacattcttaaactcgctgtcaaaattttgttaaacttgccgtcaaaaataagacctaaaatgaacttgttcttagaagtctttcaggacaatattaattaggccaggcccgtttagttcgtacaaggctttttctcggcccaattcctaagcccggcctgaaatatctggacttacatgggtctctctggcccaaaaggcccacataaaccaaacgaaaccacgcgagatgacatggcacattcaagccctcccattggccatgccacggcaccaccccgcgtgggccccaccacctcccttcgccgaaactttcccctcctccttcctcccgaagcaaaatccgagcatctccgacgagtccgccatatttaaacacacccacgagcggcaacccaccgcgagagacaaaaatatctccatcgcgatctccatggatgtagagttcttcgccgacctcgacctcgacgcgctcctcgcctccttctcctcctccgccgccgccgccggctccggcgtctcgggcctcttcgccccgtcaccgccgcacgatgcggaggcggggtcgccggagtcggtgagctcccggcggcccagcccttcccgggaggcggcgctgtcggagatcgagaggttcctgatggaggagggccccgcggcggaggagggggtcggcgcggaggatttcttcgacgcgctgctcgtcgacggcggggaggaggaggaggaagaagaggggaaggggagtgaggcggggggaagcacggatggggattccgggaaggagaatgaggtggctaccccggacgcggagaaggaggatgtggaggcggaggtggatggcgatgatcccatgagcaagaaggggaagaggaggtatgtatgaattgcctaaaaacttgggatttctaaaaatcagggggatttcgtgtgtacaaagatttgtgaatttacataggtagctaggaataatggtcaggttttagttcaacacaattgatcttattcagtgagtgccagaagtccagaaccgcactacacccatagtacattttttttattaattaaaacattatatatgtacatacatgagtatatgatctaatttgtcgtaataagatgcatggtctttttagtgctaatcctttgtgaaattgtaagaaattgctaggctttcaattataagagtgtatggtcttttcaactataagatgttttccgtaatcaaagatgttctagttagacaataatctaatagtatgtgttatgaatttatcaggcagatgagaaatagggattctgccatgaaatcgagggagaggaagaagatgtatgttaaggacctagagactaagagcaagtatctagaggccgagtgtcgtcgcctcagctacgcgcttcagtgctgcgcagctgagaacatggcgctgcgccagagcttgttgaaggataggcctgtcggtgccgccacagccatgcaggagtctgccgtactcacgggtaagacatatcgacaacattttctgtttcatacttctatttcgacatggatgaacaaatcttttcttgccgatcattttgaattgctcagtatgctgacaaacttgtgcttggcatcaatatattcggtgtggtctcatggatgatccgcctaagctaatttttgttgaattcccatgaaatcaaacagctagctattgtagttatagccaattgttgactacattttctgtgtacaagtatgcgtggtttatgcacaaatctgcattgtttatacaataacacttgcttagccttttgttttccaactttggacctaatcagtcaccgaccgaagttgacattaactggaacatggtttctttgctatcctacagtatgcttgagtcataatcctgatgctcctacagtatatttgtgtcataaacctgatgctaaaggtaaccttttcctgtttgcagaaaccctgccgctggtttccctgctttggctcgtgagcatcgtgtgcctactcccggtgcccggtctacccaaccgaaacccggtggctcgaagcagcgccggaagagatctcgcgacggtaaccggaaagggaacaagcagtgaacaacagctagaagaaacattactactccatgggaggcgttgcaagggctcgagggcgaggatcaagctagataccggaccgttccgtttagcagcagctgcttgctaggctgccgcttccttgcaaagttgtttccagtctgtattgtagctagcaaatcaaattggcgtgtctatcgcctgtcgtgctgccgcttatccatggactatctttttctttttttggttccttccccccttgtttttataatatcctcctatgcataatgcattatccaggtagttttgaaatctggctttgttgagttgtttgctggcttctcatcttgtcggaagatttacagttgctcctacactcctacttgccaggctctctggaagtgtatggcagtaaaaaacagatatattgttcctcagcagtatttgccttgatgtgagtaaatgaaacaaataaacaaacaagcgcaaacatagttgatctttgctttccattaatcattaatcgtgaacatataatctaccataaattttcgacagtaaacgcaacttcctgtccggtatgattttcagggaaattttcccatttgcttcagttcattatagttctgtcgaaagcttaattgtatgcccacccaaaatcaccattgagtaagataaacagtttctcgtagctactactaacccgaactgtgattacgcaacacaaacaaagttggccatggtgttgacagttcaactgttcaaggttaaggtcctgtttgaaacagctactgtatttccttagattattgatacgggttgtttacacatgattagtatgataaattagaaaaataaaattcacaaatagcttaggatagacagtctaatgcagcagaagaaagcttctaaaaaaatcatctttttaaaaacgtgaagcaaataatctgtagcaaagatcttagcaaaaatctgggaagacgggctaagctacacaagtagtaaggctgtgtttagttcacactgaagtttaaaaattttgttgaaattgatacgatgtgatagaaaagttgtgtgtgtatgaaaggtttgatgtgatggaaagttggaagtttggaaaaaaaaacttttgaactaaacagggcctaactgagaagacgggctaagctacacaagtaatgagaaacgtttaggggtttttcagctagcttcataagatggtggacagtggtggactagttggtttgggttcgaagtctcaccccattctatttatttgatattaggccattccataaatttgtggtttttacacaattaataaagacaaactaatttctatacgcatagggcttggttgtcacatcggatatacggacacacatttgaagtattaaacgtagtctaataacaaaaaattacagattccaccagaaaaccgcgagacaaatttattaagcctaattaatccgttattagtaaatgtttgctgtagcaccacattgtcaaatcatggtgcaattaggctcaaaagattcgtcttgcaatttccgtcagaactgtgtaattggtttgttttttttcacatttaggacttgtttagttggggaaaaattttagatttagttgtcacattagatatacgggcacacatttaaagtattagatgtagtctaataacaaagcaaattacagattccgtcaggaaactacgagacaaatttattaagcctcattaatccatcattagcaaatgcttactgtagcaccacattatcaaatcatggcgcaattagacttaaaagattcatctcgcaatttacgtgcaaactgtgtaattgttttttttttgtccaaaattaatactccatgtatgttctaaaacattcgatatgatgggtgaaaagtttttgttctagaaactaaataagtccttaatactccatacatacatctaaacattcgatgtgatgagtgaaaagtttttttttgaaactaagggccagttcactttgatgccattttcaaccttaataaattttgataaagttgccaaaaaatagctacatttagtttgctaccaattttttggtaactatataagaaatcatgccaaaatttgataagttgccaaaatttttataatgccaaaatttggtaggtttttttttcatcaaagtgaataggccctaaacgagcccattaagttggtcatgctattattaagcaaaaggtacagtatctacttataatctgaaggagaatcagatgttgggctggtggctgctgctggttctcagctcacccgccgtggtggtggggactttctagaagaagacggcaagtgtcaagacttgtagtttactccgttgatctgctccaaccaaacctcccatctccctcccccctcccctgccacctccacctccactctccccttccaaccacaaccccccatcagcgcgagctcccccagatctccccccacctccactgccgatgacctccgccgcctagcttcccatccaccgcaatgtcgtcgccggctgcgggcgaggccgacgccgccgcccgcgtgctcgcccgcgccctcgacaaggtcatcaagcactcctcctggcgcaagcactccgcgctcgtcgccggctccaagtccgccctcgacctcctctccgcctccccggatgtcgacgaggccgcctccgcctccgcttcccctatccagggggtcgccgcggccccccccgacgcggcaatccgcgctctcctgatcgcgctcgacccggcctcccccaaggtcgccgagcccgcgctggagtgcgtttccaccctcctctccctccgccttctccacggcgaggtcgtagccgtcgctgccgctggcgctgctgacgccgacgacgccgcctcgccggtatccaagctcttcgcggccgtggtctcctgcggggggctcggggacgagggcctcgagctcgccgcgctccgcgtgctggtcgccttcgcgcggtgcccctcggtctccgtctccggggactgcctgggccacgtcgtgagggcgtgctacaacctatacctcggcagcgcgagcggcgggaaccagctctgcgcgaagctggcgctcgcgcaggtgctcgccatcgtgttcgcgcgcgtcgaggcggatgccatggacgtgcgcgtgcgcaccgtctccgccgccgacatgatggacctctccgatcgcagcctgaatgactccagcgtagtgcaggcggcacaggcgttcataaacgaggcaatggaggggagcgatgtgccagaggaggttcccccatcggatttgccagctgaggcagatgaaaatggagatgatgtggggatgagcaggatcagggaggatgggctggcattgttcaaaaacctttgcaagctgtcgatgaagtttgccacgccggataaccccgatgatccggtgctgctgcgggggaaggttttgtcacttgagctgcttagaacagtcgttgacaatgcagggccattctggaaatcaaatgaaatgtatgtatgttttggattgatacatgcttgtgctaattatatccattagaattcagcattgcctattttgttcattaattttgccatgagtcttgatatgtgctaaaagacgataattaaggtggatttgccaaatgtagaaaaacttcagctaacaatagtggatttttttttttggtgggggggggggtaaggtttacgatttggggtatgggagagtagtatttactatttctctagccagatgacatctgcccgtgttgtttctgcatgataggttggccaggtgaagatgcatgtcgcatatgaacaaggcagttgttgtggagactgatgtgtttagaaatatacttttagctatgcatgctttgataagttcttgatcaatctaaaaagaatattcctgatattagatcaattttgtttatagttagagtcagaatcgtaaggaattactgttagataatgaatcttctagctcttccaaatgatataccgattattgagcaactgattctgggttctattggagattttcaatttctagtcaatttgtggcatcccttcaaatcctcaataaatgttccaaacgctggcagaccatgtagagacagtggcgcatgcaccctgtgacttgcagacctgcactgatcatttgttaggaaagaagagcaaatgtcacttgacacttatgaagtcatggttaccaatctaaagttgtggggttttagtttatatgttgatgtccccacttcatgttgcgtattaaatcatttttcatcaatagtttaaagtttaatattcaattcatacatataggaatgcatcaaataattgcacccaaacaaattcatgcatgaggaatttgggtcattccatgtctaaatgttgaactgaatattgggttcaacagaaggtatagctcagtaatactgaccttctcccctactgatgcaggtatcttgaagcgattaagaagcacctatttttatcattgctgaagaacagtgccttgtcagcaatgagtgttttccagcttctgtgctccatttttgttggtctgctgtcaaggtttagatctggcttgaaagaggaaattggattattttttcctatgcttatcctaagagttcttgaaaatgtccttcagcctagctttctgcagaaaatgacagttctaaactttttggagaaaatatgtaaagagcctcaggttatcattgatatttttgtgaactatgattgtgatgttgatgcgccaaatatttttgaaaggtactctacttttcttcttgatggacacacacccttatttttgttttgtagtcaataagaaccattagcattacttctactgaaaatatttgtcactctctttataactttcctatcaataagagccattagcatcacttctactaaaagtatatgtcactctatgatttcttagtaaagcaattttaattccatcagatcttcacaggattgtcaatggactagtaaagactgctttaggtgtccctgctggatcaacaacaacattaactgttgcacaagaccaaacatttcgaattgaatctgtcaagtgccttgcagttattgttaagtcaatgtgttcatggatggaccgacaactgagaattggtgaattttccctgattagttcagaaactccaggctcaatggacaatcatactaccaatggagatggaagtggaatggattatgacatgcaacctgacacaagcagctctgacatatctgattcttcctcacttgagcaacgacgtgcttataaaatagaacttcaggtgtaacttttttccaatttgaattaggtttcctaatttttacgttgtttctctctttctttaggctgaagtgttttttttttcttctgttcaatagtttgtactttggatgactgatgggcctacaatttcttttggcagaaaggaattgccttgtttaacaggaagccttccaaaggtatcgattttcttgtccgcagcaagaaaataggccattcgccggaagatgtggctcttttcttgaaaaacactgctggcttaaatgcaacaatggtaggagactatttgggtgaaagggatgacttccccctaaaagtcatgcatgcttatgtggatgcactgaactttaaaggcatggacttcggtgaagcaatcaggtttttcttgcaaggtttcagattaccaggggaagcacagaaaattgaccggatcatggaaaaatttgctgaacgctactgtaaatgcaatccaaatgcttttactagtgcagatactgcctatattcttgcttactctgttatcttgctaaacactgatgctcacagtgtcatggtgaaagataaggttagtctttggtgatcttcctattttgtcatctgggaatggctcgcttatattgcaagatttcttgtgcagatgtctaaggctgatttcatgcgcaataaccgaggaattgatgatgggaaggacttacctgaagattatcttagtgcattatatgaccaaattgtcaataaggaaattaaaatgagtgctgattcttcaacgacacaaatcaaacaacccaatagcataagcaagcttcttggcttagacaatatcatcaattttgtcaactggggacaggcagaagacaaagcattaggtgcaaatgacttgctcattaagcacatacaggagaaatttaaagcaaaatgcaggaaatcggagtaagatcaacatgatttttctttgttaagtactcatatgctctgatatttgatgaggttaagcttgtgcatgatgcaggtctgtgttctatactgtttctgatgcaaccattttaagattcatgatggaggcctgttgggctcctatgatggcagcattcagtgtgacactagaccaaagcgatgataaggcttctgcagcgcagtgtttaaagggattaagatttgctgtgcatatcacatctgttatgtgcatgcagacacagagagatgcttttttgacaaccatagccaaattcacatccctccattctgctgcagacatgaaacaaaaaaatgtcgatgctatgaaggtaaaaggccacacaaaaacattacccttttttgtgcaatttacataaaaatgttgcttctgacttccaagtaaccaacttctactttaaaaaaagcatataaatttataatctttgaagcatatagatggagcatattagatgtgtttgaacgatttcagctcatatgttctgtatgtgcattccatgtctggcatatctgactgttttgaaacagtggaatgatatacttagtctataatttcgacaggctattatatccatcgcaatcgaagatggcaattacttgcaggaagcatgggaacatgtattgacttgtttgtcacggtttgagcatttgcacctgcttggagaaggggtacctactgactcgtcgtttcttacagtacccttagttgagtccgaacaaaaaaatcataagtccagctctggtctatcttcaaagagaaccaatgctcttcagaatcctgctgtaatggctgctgttagaggaggttcttacgacagcacagtggcaaaaaccagtgcctcgtcattggttactcctgaacagatcagtaatttcatatcgaacttaaatttgttggaccagattggtattgttgagttaaatcatatatttacccacagccaaagattaaacagtgatgccattgttgcttttgtgaaagctctttgcaaggtctcaatgactgagttgcagtctccaacggatcctcgtatcttctgccttacaaaaatagtagaaatcgcgtaagaatttcctagatccacttgtaaaacctacctttcactagcagatagtagctgtgacccagtacttgtcaactattctaattctgaactaaattcgtgcaggcattacaacgtgaaccgcatacgtttggtgtggtctcgaatttggaaagttctgtcagaattttttgtatctgttggactgctagaaaatctttctgttgcaatatttgtgatggattctctgaggcagctggcaatgaagtttctggaaagagaggaactggcaaactataacttccagaatgagttccttagacctttcgtgattgttatgcagaagagtaatgctccagaagtacgagagctgattgtccggtgtgtctcacagatggttctaagtcgtgtcaacaacataaaatctggctggaagggtgtttttatggtatgtattgcagcaacgtttctctcatgaaaagaagactaaaatatgcattattatggtgtttattgaattatttttgcactgtgcaggtatttacttctgctgcagctgatgatacaaaaagtattgtcctattggcatttgaaactatggaaaaaattgttcgagattactttccatacataactgagacggagaacaccacattcactgattgtgttaactgtcttattgcgtttacaagcagccaatttaatagtgatgctaatctcaatgctattgcgtttctccgattctgtgctgttaaacttgccgatgaaggatttggttgtcaggaaaagtgtactgatgaacccaggaatttaggcatgtcagatggaaatgccactgtggacaaggatgattctatttccttatggattcctctccttgcaggtgtggcaatcttttagtgttagttactatcatgcagtgtgaatcttgttggattaaaaaacgtaaggactggttcatttgtaagattattattttatatttccttttaacctttcaggtttagctaaattgactagtgattcaagatcaaccatcaagagaagtgctgtgggagtactttttgacattttgaaggatcatggacaactcttctcagagtccttttggaccaacatccttgaatctgttatttatcctctatttagcagtgaaaggtcttcatcaaatgatccgacctcaacaccgagtatccctgaggatgacttttcaaatcttgaaacccaaacattggcagtgaaatgtttagtgggtttgtttattaatttctttgatgtgatgcgtccagaacttgctagggttgcatctatagtcacatattttatccgaagtccctacaaacattctgctagcataggtgtatctgctttgatgcgcttaattgagggagttggtggtgaactttccaaggaggaatggaaagacatattgctgcgcttcaaggaatcggtggcacatacttttcttgtattctccaaaattgtgagaatgatgcaagatattgaaattcctgatagatttgaatcttattcagaaaatgatcagtactcagatcatgaaaattatggtaatgaagaagaggaagctaatatggagacaacttcttatgctattgtcaaactgaagaatcatatggctctgctcctcttagttgttcaggtacttttctctgttaaacaaattatcttgttaatccacccataacatgttaagtttgattaatggcactttttattcacgtcgactctgggcctaactctacaattgggaacctagtcctaggctgtttacttgccgtccaatactccaatgctctagtgactatgacctgaaaattttagtcgtcaattaaggcagtaacttttgaaagagcagagtggaataatgatgttattacgaaaagcaagggtgtgagaatcaaataatcaatcactacatatcttgaccttgcctagctacctctatggaacagtttggtttttacctaacggttatgccagttcttatggcaaagtagggttacgaagcatgttccttttctaggtgataattgggaatctcttgtcctttcctaggtggacaacaggacaagtgacccagatgtgccatttgctgtggcttctatttcgctctaacatttccagccacatcactgtatctctcagtcttttgcccttttttgcagggaataattaaattatatgaagaacacagaaaatatctgtcttccgatcatattaatattcttttggagatgatatcagctattgcgacacatgcaagtgaagtgagctctgaatcttccttgctgctgaagtttcataaagcatgttcccttatggaagtatctgagccagcaattgtccatttcgaaaatgagtcataccagacctacctcaagcttctgcaagcgctgtttcgtgactatccatccatgtcggaagaaatggacattgaatcacaaatacttcgtgtttgtgagaaaatacttcggatatatctacagtgtgcacagcgagaaccatccaatgaagctttgcacagaaacgcatctatacattgcatagtgccactgggtgctgctaaaaaagaggaattggctgctaggacttcattggtcctcctcgtgatgcagttactgggaaacctggaggaggattcatttaggagagtactgccctggtttttcccgttgctagttgatctgatccgttgtgagcatagctctggagaagttcaacatgcactgtacaaaatcttccaatcatcaataggccccatgctaacagtataatagcacatatttgttctgctaggtctacgattttgttactctattttgttcacgttattccagttaactaagggggcccaggactatctttcgacatccttgatttatcttatctgtttcgaaatcctggagttcaaggtaaaaattcattagttctgtgcacttgcatattatgctgtatgttataaattcaactgagatcaacctgcttatcttatattttgcagtttaatatgatcaatccagatacgtgagggaatagaatcgattttgccagcattcatttcaggcaatacgagactatcagtaaatgaacattgtagactgacatagaatttgccccttatggctggactctcttgagaccgatgatgtgttgaggtaatatttcgcaaccctataatgcggacataagatttacccgatgtgtggaggtaatatgttattgtcaaactgaaggacagcatgctcattgctcgcaaagccacaatccatcatgtatattactagttccatagtactttcaaccatgtgccgtggaaacacctgagctactagatgaattcgctctatgaaattctgtttttgtttttctttttgtaatagcttttgttgtgaaactaaagtagagctagactagccttgtacctaaaatgagcaatgttttgtatcgtattcctttgtttaatgcataatatagcgaaaagaatgttgttttggctactgacatatgcaaactgggatcaaacagattgctaggagcgtttttaaaggcaatgaatatagaattttgctagtgttgagtggaaaaatatttgtctcggacacagctctccaaactatctacaagacaatataggtgatgtgaagtactccatattagagacaacaactgtcttt

SEQ ID NO: 20597 - DNA, 25351 bp, Oryza sativa
  unsure (1)..(25351): unsure at all n locations
agttgattattttctaggattggaactgccattatttagttacacgttgcatataaagtgatataaacagttttacagttttgggatgaataatttacacaaccagccgaggacgcgacccaacgccctaatgctgtacataatgcaacacaatcacatgcattggagatgacgagaaggacgaagatgagagaattgggctatacacaactgtaaccagacgcatcagcaacgtttgaaagaattgactagctctacgattttggaccctacttgagctattatacacagggctggattccggactccatttccggcatccagttttggtccatgtacaggccaccagctatcagaattcctggcaggagatggggaatgcacagacacttgacagaagcagcgcaagagtggctttgaaactctcacgccttcctgcccctttcaacggagcagcttgacattcacattttatatggatcaggtaaccatggataaggagaacctgtggaataaagcgataaacagatgattcaatctagaatatagatgtagcattctccaggtgaaaaaaataaaacagaagcatggtcaggttagatgaatttggataaccaacctttagaatgcaaaagatgacagtttgcaagaaaagaagcatgccgcccaattagcagttctgctgttcttagtcctgctgcagactataggatacctgcaatgacaaaaggcaagtgtcagaatattatatctgacaggagctgaaaacatataataacaaggtggatgcacctcaaatttgtacttgttggcatccttatgtcagcccgacgtttgttccgaaatgttgtttggtgtgaattgtgcacgagcagggatcaagagctgttgctgagggcgtggagctcctgtttccacaaaagtggcagatgttagaaatattaataatatagggtgtgcgcgcaaaagtattctcaatccattcatcaaagattgacttcttgcctggaggatattgttgctgaactgttgacatgcgtacaacatttgcagcattctgattagatagcggcagaatgtgacctggtacatagccaggtgaatacggttgatcacctggcacaggttggccaaactgcccatatgggtaaactgctgggcctactgtcctgggaccgccatatactggaacatactgttgcccaacatatgaaccatatgcattctacagaactaaaagtataataaattagcaaaagtaattgctaagaaggaacacgttatataatataccaagaaaaatgggaacaaaagattctggagttctcaacctgaggatacatgtattctggcccataagttgatggtctgcatttgaaaaaacaatcgatcatttacttgcaacagacaggttgttcatttgaaaacaaaagaaacacacaaagacgttatctatactacaatcccacaaagcacaattccagactagctatgactttaacaatgtgacagatattcacagcctaacaggagatcagatccttagctgtgcatgatcattgcaaagtatgcgttgaatgagctgttaacctacccataagaaggatatacaaatgcctgtggatagttgtaggggggttgctgatatgttgggctttgcacatacatgccccctggaaccgccacacctccattgtatgggatgaccggccttaaaggtgctattaccacattacaaagaagggaacaaattatcacaataattgaacatacacacggacctcataaggtgtttaagcatgcataaaccagtaagagagctttgcaactatatatttttgttgtagagtcctgacaatggcagaatataaaagaaacttaagaataaagcaaggacttcatcccttttccagggtaaccatgagctgtttagcaactgatctttctactaatgcatactgctctatctgagtttttgcgatgtaaagattttctagttagggataaaaatcagtggataccaggagctatacgctattttgtatacttgattttttttaatcctatttactattatgtgttgtatgaagttcacattttcagaaattttcaccaaaaatttgggtagaaattgaatttgttccaagattgaacaataactcattggttactggctggttggtctaggtgcaagagaaacattccagacaggaattccatcttatgccagatcactaactttccagcaaaatctgagaatccatctgtcattgcaagttgcaggccatgaaaaagatgtctggcttgtaaattaccaattttgtcgaaaagcaataatgattgtaccaactaccaaatcatgagtcatgagttgtcccctttctgttatcgattctgttacctaattttcatttaaaccaaatcctgcaatacctttcctctaaaatttataaaagaaaaaggactagtagcacttgatcatctccatttttttcccataaaaaatcaagcttctatcagaaattgattttgtactagactctacagctttggatgacattttttatatcaactagctttcatatcataaataacttaatagactctacacatttgcttttattaatcgtacaatgacaagtcccttttttcttttagaattataattaatgaaaaaaaaaaccattagttagcaaatgaaagaaaagatgtaacaagaaaaagctatgggcaacaactctggcatggtacaaaatatctaatcatgataactccagtttgttgggaacggataatggttaaaaaaaatatgcattacaacaaaattttaagctggaggaaacaatagtatatggatatgacagttatgcaattagggtagctgaaaactaagctagaagacctaccgaaaggtatgtctggcccaggacggcctaggatggcaaggttacagtttgcgcggcgcccgtcgatcaccgggtacgggtccatgcacgccattctcgccgagtctgggtcccggaaggtcacctgtacaagcctccacgcgaaattaagactaaacgttaaaaccagaagacccgatttccccttgcggaacgaaattgcttcaaattccctcttcaattccaaattcacactggaaaaaacgcgaaattgaactccaatttggaagctcggaaaggtagcaaacgaactaaaaacgatagcaacatccaaaccctagacctcattagcagcgaggctttggactccaattccccactaaatttcaaacgctttccccatttccgcaccacaatcataaaattccccaaattaccaccagggaattcaaagctcccaaaagattcacaaaccttcccggccgatcaccaccaatagccaccacacaacctcccaattcaaccccaaaatcaatccccgagccacaaaaaataaaaccccgcaacatctagcttcaaaaaaaggggaaaaaagaaagaaagaaagaagagagaaacacaggaaggaggatttggggaggactcacgaatccgtagcccttggacctccccgtggcgcggtcggtgatgacgacggcctcgaggatctccccggacccctcgaagtgcgccctcagcccctcggtcggcgtctcccacgcgagccccccgacgaacaccttggtgtacgtcgtgtccccgtacggcccgctcaggtagtgcagcgcgggcgtgccccctccccccgccgccgccgccgccggagaccgctgcggcgtcatcnccaccaccaccaccagcccacgcgcatccacccctccccaccccaaaccctaaccctagaagcagcagcagcaaacagcaaacagcgaagccgaggtggtggcgtgttagcgagcgttgcctagggctaatcagccaatcgcgcgcggtattatagccgcgctaatccgaaggcggttataattaagcggttaaactcgcgcgcgcgggagaggtgaggagggaagggaagcgaagcgaagtggtggggagttggtgccaactgcgtgcgaagaaagatcacgcgaagagaaggggagagagagggtggtttggggattttatatttttttgggttggatagggacttgtctcgtgctgattaattattgttatttggattttatatggactctctcagcctggatgatcttttttctgtttctgcttctgtgcttttctgtatctgtaattgcaaaatatctccttccttgctaaatttttttattaaaacgtatcagatataaatcatgtttaaaatactttaagtgatataacaactcacaacaaaataaattatgtattttttttaaaataagacggatggttaaacatgtgacaacggcattatctattaatataattgaaggtagtatatcctactcgcctgttttagttggtgttttagttggggggttttttatgtatattttagtccttttaaaaaatcttatttttataaattgatccctgaaattttcttggtgccaaggtatttgtaatataattgctttaccttcaacgaaatatccttcatggctaaattgatttatatatatcctgcttccctgtttcacaatgtaagatagttttggttttgtcttaagttaaactttataaaatttaaaatataataacatctatacgttaaattaattctattaaatcctccacctttatatagtataggtgaaaaaaaaaggatgtgatggagcttgggggtggagcaagctcagcgttacatgcaatgctttattgtgctttaatgccaagttgattctcaagtttagaattttatttatcgacgtcatctgttttcataatattttcataataccacgaagacatgaaaaaaatctgtcttattgtacttcaaaattaagctttcaaattcaagataaatttggactatgagctggtttggtttaaggtctaaattggctttaccaatatttgtcaatttcaatagtgtttattgtctatttggtttggagccaaattttagcatgcctaagaaaataggccattcaaacagttaatttaggctattttggcttcaatccaaacacaattttacctttaccaaaattagccatgccaaaaattgccaaaatttgacattgacaaaaattggtaaggccaatttaggccacaaaccaaaccagccctataatccaaagcacaatcgcattgccctactccatatggttgaattataaattattttagaattgtacacaagtgacacaagaattagtaactcaaatgacactattgccctgaatatataacattggaaatcatgaagacaaatcatcggcacgcgtaaaaaaaattcttataaacttgaaagaaaaatgatgtggcatactatgaatatattttttttcataaccacgaactaagtagatttaatggttgagatcttagtttgtaaaagttctataagattttttttaaaaaaaagtttgtatagcactgctcgtttgtgagaacgatagcatttatgtatcaaaggtaggcatagaataaaagatggaaacagtgtttaaaagtttaacacaagttactatagaaaaaattacgaaaactaaaatgattagtatctgaaattagagggagcaagtagtaattcagaatgcataaagcaggatccacctgacattgcagtgagagactaaacaaaaaaaaattgatatgtcttgtgtactaacaacatctgacttattctcgccatacaagcaaaaggttgtacatgtcttgaacaaacgagcacaaattaaaatattagggacaccttttattcaattttcgaatatgctaatataaaaatgtattttagttaatctcgattttagttataattatataacatagtgaaaaaatgataacacagctcttcagcagtgttaaatcatcaaactaggatttggcagtcaaaatctcgatttttttaattataaattgagtagtgcatatcacatggattgttcaagcctaatattttgattttccagaaaaaaggaactacttgggttagtgcacgtcattccggaaggatgaaagaacaataaacatatccactgattagagtaactgaattaagtggtcccctactttgtgtcctgatacttctagacgtctatgtccatgccatctcagccaatactcatctttgcagaatgatgcttactaatccacctcttgtgtgaaaaggtctcctgtccggaaaaaaagtgccggcatttcactattttatcattttaccattattgatgtgtgtaatacaggcttctactctttttaggtttagagtttgttttctaaaacaccgtacaccacatatgcgctgacaatacacgcacaatatgcgtaacacacgtaaatgttgtgagattaaccaaatcatcacatgtgtcttaccatcgatgagtacgtcatccactgttgaaagaacaactagcctcatgtcaattttacaagttgaatctgggtaataagcaggttccactataaaaaacccctcactttgctttaggcttagatttatttttgcatagaaaatgtaactaaaatttaaattttaaaatttaattttggatttggtttcaatattattattgtagtttattttttagcatgtcacttagagcatatataaaaaagttttgcgtaaaactttttctactgctaataagtgttacggtttataatgtcaaaggatgggctactaattctgtttgaacagttttgtggatttgcgatcgagattttgcaggaagaagcacccttcccccttttgccgtaaagagtggaggagttctgaataaattatgagaaaacaaaggggctaaagagacatggtctctgtatgtttatccaaaactgcagggaaagggttcctcgaaaaaaaaaaactgcagggaaagaactaaagaagcttcttgacccaaactcccaatgaacctattatattctgctgcgtatgcaaattccattccactttgccgaagtgccatatcccaatcgagatagtaatgcttgcacgtaccacacagaaaaagattcttgacccaattcgaactggatacaaatatgcagctacaccatgcaggtatgcaacaggacatctggagttgaggtaacttttttttattttaaatatagtgaaatttatttcggtctatgttttaaagaagatatagccaactactccctctgtcccataatataagggattttcaatttttgcttgcaacgtttgaccactcgtcttatttaaatttttttgcaaatataaaaaacaaaaagttgtgcttaaagtactgtagataataaagtaagtcacaaataaaataattaataatttcaaaaaattttgaataagacgagtgatcaaacgttataagtaaaaactcaaaatcccttatattatgggacggagggagtattatagagaacgtagtatgaatgaccacgacgaggtaaatttggtgaaagaaattagttgtcggtccttctgcttaattgccttcttttctcagacactatggtggtgtttggatctagggacttaactttagtccttgtatttagacactaatttagagtattaaatatagactacttacaaaactaattacataaatgaaaactaatttgcgagacagagtttataagcctaattaatccataattagagaatgtttactgtagcatcacataggctaatcatggattaattaggctcaatagattcgtcttgcgaattagtccaagattatggatgggttttattaatagtctatatttaatatttataatcaatatccaaacattcaatgtgatagggacttaaaagttttagtacaatctaaacaggtcatataattgggtccatagccatgcatggtaaagtacggactttgcgacagttgagctcccatgggtcgctcattttccctaataaaccaaaactacgtgttctttgcgacttaaaaccaaatgttgaagaagaaattacgttgaaaatagcttaaaatcttcttcaaaattgagtttaaaaatttaaattttagcgttggcttattatggcaaccaatagagctctttgatgtttatgttctctcttcaggcgatttagcagcagagaatgggaggttgcaagctgaaccaaattcttgcttctgccgttctgacttcagcggcacatatgtacgagtgaatagcactagtatcagcgagaagaattccaaaaaaaaaagaaaaaaagtggaggtagactatgtgtttatgtgtttagttccaaagttttttttccaaacttccaactttccatcacatcaaacctttcatacacacataacttttcagtcataattttttaatttcaactaaattttaaactttggccggactaaacacagcctagctagaggaacacgcttgcacagaaagtgccggtgctattgacatcacagtccagtttttttggtgaaataatttgaggggcattgcaatgcaacatgccgtcacgtctgatgctggcgtcagagtctgttgcttgaccttacgtaatcgctactagtacatgggtagcactttgtgaatgttgctgcaatggtgatagtatttgccggtttggcacggatagttgctgggattaacaccttgactcgaggtcaggattcacccaggattgttggaaccttcttcttcttttttttttttcatttttttgttgggtacatagtcgcaagatggttggaacttggaaatgctcaactggttatatttctcgtggtggaataagttcgtgggtttcagtacgaatgtttatatttaagaaaaagtacaaattaccccccccaaactatcgtggtcgtccgaattaccccccgaaccacaaaaccggacattcttcacccccaactatgaattccggacgaattacccccctcgaccaaatccatggtggttttggtctacgtggcgtacacgtggcagtccagtcagcattctatttataaaaaaaattgtaggacccacctgtcatacactactctctcttctctctctcacgggtcggcggcgcggcttcccccctccctgcccagggtccgaaaacagcattggtccatctcagttggtccacacctaacactgcaactcactgcgtttttcgtcctcgctttaacgcaaaaatcctgaaatcggagtttacagtctcggacagctcatccttataagctgctctccacctctccaaactaacgaggtgggactatatatagggggtgtttagatggggctaaaactttttagtccatgtcacatcgaatgtttggacgctaatttgaagtattaaacatagattaataaaaaaaataatttcataaatgagagctaatctgcgagacgaattttttaagcctaattaatccataattatgaaaagtttactgtagcatcacattgtcaaatcatggcgtagtaattagactcaaaagattcgtctcgcgaattagtccaaggttatggaatgggttttataattagtgtatgtttaatactctaaattaatgtccaaacatccgatgtgacatggatttaaaataagtccatatttcccaaacaggccgctacagtaccacgcaatactgtagcgctgctgctctgctcgctgctgggccgcatgcacgcatgcactctatggcctgctgctgctagcttttccttttttttttaagggtgttacacgagcggtggccgagtcgcggcggctagcggagctcaacaaccatgcgacgtctcgggtgcacggagctacgtgactaccgacgacgacgcgcccgagccggtcaaccccgccgtccgcagcctcgcctcctactcgggccacgccatcgccgctaagaggtcccgccgtatcgtcggctgcgatggcgagtaccaccgccggcacccgatccgcggcatctcaaccccgccgcccgcgcgccgtcgtcatctcccctcgagccccgcccgtgccgcgcgccgtcgtccgtcgccccccgccaaccgcctcgccgccgctgccgcctcgcctcctccgccgcaccccgccgccgccgcctcgcctcctccaccgccgcagtcttgcctcgcctcctccgccgcaccccgcggccgcgcgccgccccatcccccgcttgccgtctcctctgctgccgtgcgcatgtgagacaaagagtgaaagaagagagaggaagagtgagagagagaagtggaatatgagtatgacatgtgggctccatattttttaataaataaaatgctgactggaccgccaccgtacgccacgtagaccaaaaccaccgcagattaggtcgaggggggtaatttgtccggtttgcatagttgggggtgaagaatgcccgattttgtggtttagggggggtaattcggacaaccgcgatagttcgggggtaattagtactttttccttatatttatgactatttatacttttagtccacctggtttttattgatagacgatgcacccgttagcagtaagacatcgctaaatctttggaagtaggtgagtgtgcgtgttacatacatatgcgacatatttcttaagatctttgttttaagaaaaaccaacttctcacaacaaacgaattagttttgagattgttgtgttggagggaccgtagtcgccgttgcttccggtcagcaccgtggcctagcaggagagcgtccgagaagggcctaattgggacgcacgatgtggtcacgggccttttggggtaacgcgcacacggcccatccggtttccctgctgcatcgcgcggcacgcgacgcaacaccggtccacttattgatcttatagccaagcttgattcacttggcacgaagtcaagatggccgagttggtctaaggcgccagtttcaggtactggtccgaaagggcatgggttcgaatcccattcttgacaatattttttttgaccttgggttgggttcgaatcccattcttgacattgttttttttcctttgtttaaatttaaccatttaaccgcggccaaaaattttaattttttttgctttgttttaaccacaccacggccaaaaattttaaaatttttttgctttgttttaaccacggtcaaaattaacacggacaaaatttttttgctttgttttaaccacacccaattcttttcctttgtttaaatttaaccacaccagacaatattttttaaaaaattaaccatggataattttttttgctttgtttaaatttaaccacacccaattcttttcctttgtttaaatttaactacacccagccaaaaatttttgttgccttgtttaatttaaacacagccttttttcctttgtttaaatttaaccacacccaaaacaagctcaacctataatttgtttttttcctgggtttctgttatggttttctacttacgtacatgaacaacacccaaaacaagaacgaactatattttttagttttatactttacatgcataaaccacaccggaaaaacaagcactcctgctgtggtcggtggtcctatcaaattgttgttattacttattactgccaagaggtagggaaccaaactctcactcctcaggcaacctggtttcacaatcaacatacaatgcactctccagtcttaaaatctctccttttctttcctctaagaaaagagtgcacacacatttaactgcctaccgatgcaattcgtaaattaacaagttttattgcattgcacacagatgaaattattccaaccttcaacaattcactacgctagtttaaaatttttctttcaaatcccaatatctagctcatttcaggatcccagcagccttgtaggattgaacgctatccctcaggcattcctccaccgtcctgaacttccaccccagcttctgcagcttcttggagctcaaaatcctctcatcctcccctcccacaaacctgccattaattaatcatcaccaagctaaaaaaactgcaagttttacgtttatatgattcactcacatgtatatcaagcaatttaaacaatgttttttttattttatcgaactaattaaccaacgtcatgtaaataaaaatagagggagagctcttgacatgacaacagcctcacaggtgcattggggatatgtatacactccatctgtccataaatataagagatttcaggttgtttagtacttcatccgtttcatattataagttatttgactttttttcctatttaaattattttaagtttgaccaaatttatgaaaaaaaaatatgagaatgattagagccgggcgtccggcgtggggggagctgtatcgggcgctccccccgcgcgcccctccccccacgtgcaaacctatgggcccactcacttttctcttcccttttcccacaaaagatgtttcacctaatataattacaatgtttcattatttatagatctaatattgcagtgaattaaaatactcttttgcaaaaaaaaaaaccacatattttggaaactccctattaagggaatttggtttattttttgttccaccaaaaatgtttcacatagtgtactcacaatgtttcactatgtatagatctaatgttgcaatgaacgaaacattccattgcaagaaaaaaatccacatattttggaaaacccctattaagggaatttggtttattttttgtttcacctagtataataacaatgtttcactgtgtacagatctaatgttgcagtgaactgaaacattctttcgctatttgctgaaacattgtttttatataaggtgaaacaacacccgatttaaacgagtgaaatattttcgatcttcttagtgaaacaattccgatatacctggtggaacatcgtgcaacatttaaaaataattcaataataagctaattttttttcatcgaaatatatccatgtgtggtcttgttttgaagatttaattgcaacgaatttaatggaacaatcagatcatgatttggataagtaatttaggagaaaaatcagtttaaagcagttttgcacgtaaatcgggcgctgacgtaaaaaaatatggtagtattttcaacataaaacaaacatgttatcaaactatatttaatgaaactaattttatattttagatattgttaaatttttctataaacttagtcaaacttaatagccgctacccgtcatcaatagataaagtgcctggatagattgaaagatagcactcaagtgactggatagattgaaagatagcactccttacttttttttaatatatggcatcattgatattttaagatatgacatcattttgtcttatgcaaaaatattatgtaattatcattattttgttgtgacttgatttattattaaatgttctttaagcatgaactcatatttttttattttttatatttgatgtttttctgaaaaaataaaatgaatgaaaaaacagatgaagtattccataacccttagatcaatggagaaaaaagaattcgaaccacataatcctatggagggagtacagtatggatttggatcctctaccttcacggcttgaaggcacgagcgtgcagtcggcacctcatccaccgttcaaataatccaatggctcacgtcgcctgtgcacgtctgaatggatatctgtctgtcaaagcccacgaagcactactgctatatttcagtccgaataccaatgatgtttgcattataagtttcgtaatttttcttatcaatcctatgctctaatcataatttttcttttgcttttatgatgtgacttgacattgcgtcatactcccccattagttcccaaaataaaaactttttatgtggaaaaaaactaattacacagtgtgcgtgtaaattgcgagatgaatcttttaagcctaattgcaccatgatttaacaatgtggtgctacagtaaacatttactaataacgaattaattaggcttaataaatttgtctcgcagtttcctagcgaaatctgtaatttgttttgttattagactacgtttagtatttcaaatgtgtgtccgtatattcgatgtgacaaccaaacccaaaaattttctcaaactaaacaaggcctaagtcgcttgacttttttttttctagtcaaacttcttttttttaactttttaacacaaaataaatatattataaaaatatattcaacgttagatttaataaagctaatttgatattttatatattactattttttatataaattagtcaaacttaacgatttttgactagaaaaaagtcaaatgacttataatatgaaaaagatggagaactactttgtaatgaattagtattgttatttgaaactttcggttttcttgtatttttaatttagtgatatcatccattttttttatgtgtattagcactaatatagtttgtaagtttcttcagctcgcgtatacttcccagaccaaaacaatcatcgtgggatttttttttttttgcgatagaaccatcgcagtcttttacagacaaatttattcgtctttttaagcgcacatgcgacgtaagccgttggattacttcaatgggggataaggggctgactgcatgctcgtgccttcactctgcgaaggcagacgatccaaatccgtagagtatgtgcttactttgggtagttgatatccgggaagaagcgcctgacgatgtcaaccatttcagacaccttgatgtcgtatgcgctgcagatgtagcggccggaagccgccggattttcgtacgtcaggatgagtgcggcggcgacatcacgcacgtcaaccacgttcctcctcttgtccgtggtggcggccttctcctcatcatcaccgccgccgcctgccgccgccgccggcgagcacgtgcataaaagcaattaaccggtgagaaacacatctaggaattcagtttctgtcagatgttcatatgctactagctcttggaattcagtcggtattactgtcagatgcagatgcatttgctgtttaatcatgatcgagcttaatcaatttctgaatatatgtaaaagacagtcttctgaatatttcttaattacctttgatcaggttgatgaggatggagctgctggtgttcacggtcgattggagcagaggtccaagaattaatggcggacagacggtgacgacgtccatggcggcggcgttgtcagccgcgaaacgccacgcctcgcgctcggcgagcgtcttggagaggcagtaccagttctaaccaagatcgtctcataatttcagttcgatgcatggcaactcaaaatacgtgcgaatgattttatttctatttttctttttgaatattgatcgatggtttaatttgtttgtgttgcattttgacacatttcggttgtgtttacctctatggatcggcagtagtgctcgtccgaccacgcgtcctcgtcgaggacggcgtcgcgggggaaggccgggttgaggatgacgggggcgggggaggacaccaccacgacgcgggggacgcccgccttgtggctcgcctcgaccacgttccgcgttcccgccaccgccggagccagcacctccgcctggcagcgccagcgccggagaaattaaaaatcaaacggggacgggacgccgtacgtcgccggtcaggtctggtctcggctgctggactccggtaccaaatatcgtgcctcggcgttattatcggggttagatcttctacgacgtttcttccgggtttagtttctaatgtgatttcggggttgtggggcttggaggcggggacggggctggcgacgtggaagacgccggcgcagccggcgacggggggggccacgctggcgcggtccagcacgtcgggcttgaacagccgcagccgccgctcgccggcgccgtagtccatctccctcaggtgaccgttcttggcatcacctgcactaacggccggcggccatcaacgcgcgtgcattcgattcgattcgattggtcgtcgcgatatcttacttgggtcacggacggtgccatgcacgacgtagtcgccggaggagaggaggcgatggacgagccacgaggcgacgaagccgccggcgccggtgacgcacaccgtcttcttcttgttcttcgtcgtctccctccctgcggcggcggcggcggcagcgccgtcgtccatggtggttttctctcctcgtcccctcgatcgccggaagcctccatttatatacgcgagcggtggctgcccggctgcacgcgcgcgcgacacgtatcgcaggctgccgggacacgtgcgcccgccacgccgcccgtacagcctgtgcggctgctccctctatggatagcatttcgtaggtgatatgtactggcatattccctaattcctccgcaaaatatttgacccattttaaggaatgaaattgctaatcatttttcgacagaaaattcagtcccaatcttacatattttggatcactagatgtgcttcgtgatttgtgttttaggtgtttcttctctaactccgatcctagcgacaacccaaactctggcggagggccgacgaattagggtcccaggttgaggtgggagggaaagggagaagaggggggagttcgttgtctttataggatggtcgtgggaggcggcagccccgccgccaaggtcggaagcgagcagtgggctggtgtaggcggcgggggcaaagcaggaggactgttaggaggaggtggccggtggtgatgccccgtcgtcgaagatggggaagacggcgatgcgaggatagctcgccaccaccgattgaggaaaaggataggagaaagagggggaaagatagggggaaggggccagtcggggcccgggagggcctcgccggtggttgacgctttccggctagccagcaaagccgaagtagcggcgcaggaggtggtgtaaaggaggcgtcgggaagcagcgcactcaagggctttgtgcggtggcgaggagggaaaaggaaaagagttagggttttgtggacttcttacgaatctaaacgtaatccaacggtctaaatttacaaaatattaggaggggtttctatcaaatgaggagtagatggtccctttaaaaagaatctagattggacattttagttttaaaaagatggattacatcccttcgttttttaaaagatagattaaatcccatcatagacaaaaaaaattgtgactatattttttaagaatttcgttttttgaacaaaccaccattttaaattacttcgttttagttttttcttaataaaacttttctatctttcattgttaaattaaaatctctactattataaaacttgaagatgtttttgccggtaatttagtacgtcatccatgtatgagtcggtttttaagttcgtttgcttttggaaatacatatccttatttgagtcgatttttaagatcgtttacttttggtaatacagaaggaatcatataagaaatctgtttaaaaaaacttgcatgctaacttgagatgatcggactcttaattgcagttcatgattttctatatatatatatatatatatatatatatatatatatatccaagcgaactcccacagtgaattttatcttaactaaaccatataacaataataataagattaaaataaacttctcccgttggtcattgcaacgcacgagcatttttttctagtatatatataaagtttaaaagcataagattttgttttgttttttcaaacatggaagaaacgcaggtgctcacatgctgacatgtacacgctacccctatgagtacatccaaaagacttagctgatatatcttgagattaataaaatcaccacgggctaaggatggaaacaatataattatttcattactattttcggaaatgaacggaaacaattaggaaattttcatatttatgaatttaactaaactgtcaacttcaatgtcacaccgacagaaattggaaaaactaaaatttgaaatcagtaaccatctgtaataataatattattattatattagttttgcggaaacagattaatatgatagtgaaattgggacaaacactgagggaaaaaaacattttttttagttaagtacatgccacgaatgaaatcttaggattgatcctcagtccacctaattgggaatgtgctaattgttgccttatttaatgtttgcaaattgcaatggtcatcaagggaaggtcacgcaaagaagatggcagagagaacgttggtaatttaggtgaacatggaaagagtatgatgccttgagccaagtaactacggaactaatgtgcacagcacactagtacataacttcatataggcaagattcaaaactaatccatcaccaactgaattagcgcaagaacaaaccagtttatattaaggccctctttgtttagtattataagccaacttaaaagccgaaaagtttaagcctaaacaaacaagcagcttattcgtttagctttttaaaagacataagccactctaacactattaagccaaaagctaggttggagaagcttttttagcttatatgaggtagatgtatgactccaccactaaacttataagctgacttaaaagtctaaaccaataagcctaagcctaaacaaagagggcctaagccgtcctcaccaccgagccaacaactgtcaactatatatatctgcattgctcaatggacaagattcaggaatcaggatacaccgatacacttgtggtttttgtttttgttttgttttgtttttacggaaatgcactggtggttttaataacgattctttattgacccggttgatctcaacacagattacatgaatcatggagagtttaacagacactgaagttctcacagtttggatcctcaatcaaggatgccaaatgctttgtaggattccacgctgtcccggagggtttcctcaataggcctgaaactccagccaagcttctgaagtttctcaaaactgtatatggtgttctcttccacatccacaaagctacaaaatcattggatgagaggagaataagttgcatgaaagttaagcatagagaagctgaagataggaacaaatatgacgcatctagttcttgtaaaaaaaagaagcatttactggtctagtgaaataattgcccataaaaatttcacaccgctttgataaacttggtactcagttgtattttattgaaccaagtgatgtgggtgtatgaattcaggaaaaatattatggatcttcaattctacctagctatctcaagtttatgtaccctccccttttatgaaatgccagccatatctgttgtacaaatgcagagttaacagctacaacacaggtaaaacacatccagtaacttgttgaggggttgggcttactttttgggataagtataagttggatataaggtctttaaaatgtttatcatatcagagactcttattggagctgagctgcagatgtatcgtccggatgctggattttcatacgccaaaaggagagcattggcaacatcacgaacatccactacattccggagtctattttcgacagtgtcacgatctcctgcaaaagatgagtacttcattttaacagaaagcttaaagcctaaaatactttattgattgaaataacttgatcttagtattaagttctttcacgctattcgttagtaagctttcctttttggaacacaagaaggtggatatcatttctgataacacagctcaaacataatactgcttagaattatgattttaactatctaactccatgtaaaccaagaggaaactaatataacgatgtaacacggttacctttgaaatagttaatgagaactttactactcgcgtttactgtagattgcattaagggtccaatcaccaatgatgggcaaatagttacaatgtccagcccagtttttgctgcataagcaaaagcctcacgctctgccaccgttttcgaaaggtaataccaatcctgccagaataacaacacagataacttcttttgagtgggtaatacagcacagggagttatgtaccacaaacaacaagagtcacgaatattctttgtcaatataggaagatcatttattatgagaaagcacaaagtaactatatgtcatagcaatcaatttgcccagtagcaacatatactgaaaaaggtatctgaaattttgctcctctcaaggacattagtacatataaatttagcaacggaaaaggcattggcttacttgaaggattaagagcattacctgattctttctgcataattcctcatctgaccaactgtcttcagtgaaagccttatcctttggccagttaggattactgaacacggcagcaatggaagacaccatgacaactcgcttaacttttgcctcatggcaggccttcaacacattaagtgtgcctgttacagcaggagctatgacctctacctgcaaaacaacaatagttatataatgtcgacataggaatacaagatcatagagccaggagtcaacgatggtgcaaagcataaatcagaatgaattgtctgtaatcattaattttatggggaacacagatatcctgaaatatgtgacttcacttctgatctaacatcaactgctttatactaatatcaccaatttcaccatgttaaaaccataaccagcgatggccccttgattcaacacaaaaaaatcaccctattttccattgttcgacatcaacccaactgacaacaaatatatgttcttgtcaaatgttaacctcagggttggtggatcggcccgagggtacagggctggcgacatggaagacgccctcacagccggcaaccgctgaagctacactgtcatagtccaacagatcagccttgagcagctgcaacctctcctcggcaccttgtagcgccctgagatgatcattcttggcatcacctacagcatacagaagcaggcacaccacgtcaccaccatcatacatagcaaaacttttgtcccgccataataagtatacaatgtaattttaaaataacttcaaagattaggaccttcaaaattcttgtgattcgacctaaagataaacaaatagttgtacgaagaccaaactaacatttcaggccaacaaaaaaaactcaaaattaggaactagaaactctcctctttgcttccagcaacatacggatcattatttatttatttatttattcatttatttgagtattgcacccctgaaccctttttgcttctttttttctttttgagataataccctctgaaacctaactccatcatccacgcttccacctcgcatacttccgccccaaatttcaccaactccggggcgacgaatcaaaaaagcaaggcgaggtttggaggggctgtgaaggtgtatgtgtgagcggcctcacctggatcccgcacggtgccgcggaccgcgtagttcccccgggagaggagcagctcgacgtgcgacgaggccatgaaccccccggcgccggtgacgcacaccgtctgcctcgccgccgccgctgccatgccttcggacttccgacttcctcaaccccacactcctcttcgctgcggagctcggtttggccgcacggcgccgtctcgattatggcctcccattcgtttttgggaaaaaaaaaagtcgatatcgcctccttgattatgggaaataaatttgtattaaatataagaaaaaggggtgaatagttaatttagtcccttaagttttaccgaagtctcaatttagtctttcaggtttcattttgttcacataggtcctctaagagcaggtataataacaggctattagccagttataaacatattttaatgcgataaacgatgagagagatgagcaacgggctacagatttgtagccagttgcagtaaggactccaagacgcaaggtgtgtatgacaggtgggaccatatattaacaatatagtaagtaactattgtataaattagctattagattggctatagattgaagttagcagtgggctatactattgaacttgctctaagtatttgttttggcctaaaattatccttgggcccacttaatatgccatatgactatttctagtcaacaattatattagaaaatatccattttgcccttaatttgtgtacaactatacattagaaaaaagaaaaccaaaatgaataaacaacattgcatatatacttcccattatttcaacatgtgcatatgaacttgagcctcatggctatcgaatacacttgcaagtacataatttgtttttgttttacataaattgctatgtattatctataaaaagaattcatagcatgcaattttttctcttatatatgtgaatgagggggtataagtgtcatttattaagagagttattggttatgtgggttcaattataagtttgaattaaattaaaaacttgaaggactaatatggacagattgaaacattaaagactaaattgatccttgcatgaaacctggaggatcactttggctatttacccaaaaaaaagccaacctgtagaaaatgtgacccctgctcagggtttacgattccgacaggcccttccgtttcgggcaccggcggaattcggaatttcatgaaatacagtgaaaaaccggtaaatcctgaacaaatttcataaaccaaattttgaatacaaatccctgagtttgccgacaagttctcgaaaaccgatcggttttggcgaaattccgatcgaaatcatagaaattccgatcggtaatttgtttctttttttaattctttatttttttctttcctgatgtaagttttagtaaatacacacaatacatcatttttttcgaaaatttatatcccaataagttctatgaatatcatagtatttataagatttttttctttttttatcaattcaaatttgaatttggatgacactcctcgaaatcttagatggtttctactttcgagcctcgccgaaatttcgcgaaatccaaccggatttcgtcggaatcgtaaaccctgcccctgctactcaagtaatctagacagcgggatggtataaactaggttggccttttatttttttttacggagggagttctttatttctcacttacccacccacttttgtactaatttattctacgtctatcatttttaaattagtttataccatctcttttgtaccatcaattgtacttcgcgttctttttacatccttaatttttacaataaagagagtaacctgttatattatattataggacgaagagagtaattcaaaaccagatacaaagcttcttttcatctttcaatgctaaaaccaattcatttcgtctcccgagtggtctagatgataatttcatccttacgtgacatttacatgataattatgacgtgtcacatctcattacatgcaaaactttttttttaaggaaaataaaagaaccatcaacacccacatgtatctccttcacgaattaagtttgaaaatacactattcattcaattttttccacaaatattcgggatgcaatttatttgacagaaatatatcattcatctcacataaccgatgtgtgaaaacaatgggctggtttgttttgtgacctaaattggccttaccaacttttgtcaatgctaaattttttcaagttttggcatggctaattttggcaagacaaagttgtgtttggattgaagccaaaatagtctaagttaactattgaaatggcatattttctaagttaattttttttctagaagttatttatatcgctgttactgaagacatctcgactgaaattatttttccttgcgcctgcaacagtagaaagttcagtagtacatgttgatttagggataaccctaactgtttaaacaaaaaaggttaactcacacaagatgtagttttggccaacatcggcccatattaggatgcttcattctgatcctattttattttgcatcagcaggcactgcacagctgcagcgttgtaattaaatcatcgacatcagtggtggggccttatgcttgggtacgcagcggaggagggagaaataaattatctgtactgaccatcggtaagtaatatttacacctatccttatttttccaagtgccagtaaaatgtcttagactacttgatcaagcatagaattgagctataagagcaatgagtttcaatgatattttgtgtatgtgtagaagtgtgaatgatgtgtcgacaggaagaatgggttctcgtttaaaattaaacaaggcatatttacaagaaagaattataatacgttaattgccagctttgtgattatgcaccacccataaatcttgcttagaagtttaattaacggtattatggtaatttccacgaacccgtagattctttactgtcctaataggcctaggtgcatttcttatcaatccaaaggcaataccatgcatactgctattggaatatttggcagagctttagatattggattatcatatggcacctatctatatctgtaatactgtagtactccgtactcattaatcattgtacaaattgaggagcatatctttctatcatttttacatgagactatgtccttactggtccttctcatatgagattagctcataagaatttcatactttttgtttttgtgggtgaataccaacgtgcatttggtggaagaacataaatcaactggtcctgctaatctatgatttgctcttaaaaagattatattttttatgtttccaggtgaataccacggtaccaccatgcatttggtggaagaacacaaagctactacatttgtttttgttattttattagatttgggatcaaattttttgtgggcatgtacattataatgtactactacgtatcacaatataaatgcttaggatcaagttgttacttaggggtcttggccacgtagatgattgtgtttgtgtatgggtggatgccattgacacaggttcttaaacatgtatttagagttgcgcaaagcgcaaccatgtggctagtatttttactaaaagaattacatcccgaatatttgtgaaaaaataaatagcatattttcaaatttaattctctccttcactttcttcctctcgatctcaccccctccctgccgtgctcgttgcctctagggacggcccttcctcgcatggtgactgttgggatctgggttactgttcgatgctctttcgagccatccaaactgctacccctaagtaaatgaaattttagtttgccaccaaaaactgctatcatcaaaattttagtgagatttac

SEQ ID NO: 20598 - DNA, 4774 bp, Oryza sativa
gggtggatgccattgacacaggttcttaaacatgtatttagagttgcgcaaagcgcaaccatgtggctagtatttttactaaaagaattacatcccgaatatttgtgaaaaaataaatagcatattttcaaatttaattctctccttcactttcttcctctcgatctcaccccctccctgcggtgctcgttgcctcctagggacggcccttcctcgcatggtgactgttgggatctgggttactgttcgatgctctttcgagccatccaaactgctacccctaagtaaatgaaattttagtttgccaccaaaaactgctatcatcaaaattttagtgagatttacaaaattattaaccaaacaaacaatttggtctactcaggaatatatcctttggagtacatgattccgaaaaatacagaaacatgaaaatgccatgagtaaaatatcatgcttcaacgaatccgacagaaaaatgaatctagaagattttgttttaaaaaaattgtttggtaataccactgaaaaggcatagaaattttgagcctcattcgttcgaaacaagccattctattgtaattttaaggactttgtaagattcatttgtaaggggttttggaatggagcccttagaatctgtttgatttaggttcttgaatctgtttgattttgatttagcaccaatggagttttgcatcgacagcgtactaggggtggccgcgactggtagacttccactcgtcaaatctggccgtttcaggagaatatggcgggacgcagagaagcatgatgtacgtgctgaggtcgtttggttttcttttcatttttttgttgtattctcctccttgttgaggtgtgagtttaagaactcttgtatcattttgttgtgtatatccttcgtggatatagaggctgaattactgaaaatccattattaaaaaaacaaactgatacacttgtatattactattatgatacacgggcaaaggaatcaaaatcacacaaataatgcataaatctagcacgatataagtacaaattaatgctacatctagatactcttgacgactccgacatatggcaattcaacatttcccatgtatattttgccatccttcctctccatcacttcagttggtctcaagctctttggtcctctcatctgttgcaccagctttccaccagcactaactctcattgcaaccaagtgattgtccggaccaaatggaagctcatacttctcacgatggagcgctacccagtaaccacctttctcatcaggcctcacattatcaggatagcctggcaagtcgacaaatggttcggacttaccaacctttggacctcgaatccaatacctcaacttacatgggccggtcaacgcaacgatcaaatgtgttcggtcagcgctaatggcgacaccgttcgggtaggttatgttggattgaagaacggtgacttggttagttcgtgggtcatacttcatgagccgtccggtcgaatccttggtcgccgtgacttgctcgtgctgagatcgttggtagttcatgctgctgtcagtgaaatacacatctccggtaacctgatcaatgtccaccccattggtgaagcgaagtggcacgccatcagccttcgtggctagcactgttgcctcaccacctcctggcccaactcgcatcaatcccatgtaggcgtcggcgatgtacaggttgccggttttgaagtgaaaccgtaggcccaacgaacggccgcatttgctctcggtctgaaccgtggggagagtcgatgccgcgcacttgttgttcgtgtagctggggctgtacgtgtaggtgctccagccagccgcctcgccgttccacctcatgacgcggccgtcggagacgccgctgtatgggccgtgtcccttgccgtcgaacgcgacgctctctggcccgaccagtgatccgccgaggtccagatgctggctccgtcgggcgtcgatggtcttgaacattctcgctgcggcagcggtgcgggggacggcgagaacaccaggacgaggatgagcgcgagcgccgtcgccgccgccgttggcctcgccgtggtcctcatggctagctgcaggggagggagagctcgttggtgcacgcgtctcgtctgcttgatctctgttgctgcacgtacggttggtgctcgtgcagtcgtgctcgttcgctgctggtggaggagcagcgtggtgattatatactgctgggttttggcgtgttgccaatggccagcttccgaatcggagaagacgagcggagcactcgatcgactcggactcgggtgtacttagccgatcgtgggcccggcctgtcatggaatataacgataaatgggcctggtgggcctaactgggcggcttctctctccattacaagcccagcccgtttagaactgaacttacacgactgagtcttctaacagaaaatcatcgatgggtttcaatgaagttcagtgttacaagtgcaatacaacaggtttttttttttttctaaacaaggattcagagtttcagacgttgagcaaatccaacgagcttggcgcgatcagataattacagtgaatgctgaaatgcaggatgcagcagctaacgagcccacaacgccacaaaagcctccggcatcggtcaatgcacgcaacgatcagatatgttgggtcagtgctaatggcaaattggcactgcaacaacgtctagacttcagcgggctcgcgtcaatgtcacccaaaggggaagaagatcctgcggcttggacctttcaggcttcaccagtatgaactgatctgatttgttacagtagtgcactagcttttcttttagaaacacagtacaaagttagaaacgtaggtgcttagaacacacgcaacacacgcacacccacccttaaaaacgcacgtacaccctatccctatgagcaccttcgaaggaatcggtcggcatatttttatattgatgaagtcaccatagacgtctcgctgtcgacgggtatgtcgcctaccactgaaagaataaataggagtaaatgtgagcacatgtgtgatttctcaaacttcgttattgagctcgcgccaaatgtgacagttgtcaaacgttgtggtaactgattggagagaacaatactgcaaagggcaaactgacatcttcaggccctatttgaaacaaatgatttgttgagaaattctacaagattcaaatcttatatgaatcctttcaaaaaaagagttgtagtttctcaaatcctatgaaatttctaaggaatggctcaatacacgtagattttaaagaagagttagcgtgagtttttacctattgaaaatttttcttttaagtctatctctcttatcctttcttgcatgtgaaaatttgtcatacctatttaatttaaatgacatacgagaaatgaggaatatttattggcatcaaaatgactttgctactatatataaggatactgagtaaacgttgttgactgtaaatgttactaaaaaaaatgacaaaaagttcaatgttcgtattatacattttggtaataacatatcaagcgctgttgttccaccgttgtattatgtctttttcttttcaatggtaaagacggacaacagacaccagccatataaaccatgtacaagcagtcaatcgtatcttattctagaatatctgcaacggtgctcatagatctgtgagcaccgttgcagatattcatttccaaacactaaacaatataaaaaaaatctcaacaacaagatcaagtaaaacactccagtactaaattattattggccacgggagcatatcctatgcacacaggccctcgcgtgtacacaccgtgtacaccaactaaaaattatcacaaaaaattctaggaaaattcatacatgtattttcaatagtattacatctacgtataaagtcgcatcttcaaattcattctacatagagaataacaaaaaagataaaattctgacaaaattgcaaccttaaaactgtcagattttttgtttttttttgttacggctaaaatataatgaatttgatgttaagattttaaccctaggtgtaatacaattgaaaatatatatatgattttttctagattttttggtgacattttttaattggtgtgcacgtgtgtacacgtgagggcctgtgtacataggatatgttgcctattggccacaccggaatatgagaacaatacaagatttgattatatattatggtgtttcggggagagaactgcacaaatacacaagtttttatgcttccatcctgcaaaatacgacctggaattttaatcttcgctcaatttcagcctggccaagatccttactcaatttttccagtcttatctttttcttatgcatatacttatctgaattgcttattatcaacttaaaaaataatttgtgaacgaaaattttatatgtgtgtcctttatggttcaaaagcaaatgttgtaaaaaaattatgatgaaaaaaaccaaaaggtcaaataaaataattaagttttaaaatttaaaatttagcttataagtatagtaagtcaaataaaattttaaaattttataataagctataaaatacatatattcatatagcaatgtaatatctgttctgctagtcagaaacaagaaatcgacacctcatggaatgaacaaacggatcagatagtggtggatataggaagagatagctgggaagtttaaacaaactagataaagttagagcccccttcctatctatatatagcaa

SEQ ID NO: 20599 - DNA, 16893 bp, Oryza sativa
atcagagatatgtctagatacaaatgaacaaaaagaattataagcatctgagttctcatccatatacgaatcatgttccttgccatccttggccccagcaagaatgctagagtgctagacattcccaacttccaaaatgagcaaccaactactacatacgaactaagctggtgggaacccttctccccagcacgcaaaacaaagcatatattattgtatgattaattaagtatttactaattttttttaaaaaaggattaatatgactttttaaagcaactttcgtatataaattttttgcaaaaaacacaccgtttagtagtttgaaagcgtacacttggaaaacaatggagagatgttggaaagggaggtaaccaactgagccagtgtatccatttgctaatcatgcgtagaaaaccattttcaccgaccaatttgtgttgaattctgaggcgggcttcggattctacaggcccatgtcacaacacccaaaccgagctgatccggcccaaccagcccattatcatctggcctacttggctacttgtccaaactagcctaggaaaagtttcactgggccttctaactcggcaaactctgacaaactctgggagccccgaatccgagtcgactgtcaagcgagccatgctgcctgcctactcggattctccgactcaaaacttgtccgactcggagcttggcattgttggcaatggcacaacgcgcgcgccgcggcctagctatataatccccacgcttctcctccaccaaagccaaccaaaaccaacaccaacagccaacgatcacgagctcgcgagctcgatcgtgcaaccatgaggaccacggcgaggccaacggcggcggcgacggcgctcgcgctcatcgtcgtcctggtgttctcgccgtcccccgccaccgccgccacagcgagaatgttcaagaccattgacgcccgacggagccagcatctggacctcaccggatcactcgtcgggccggagagcgtcgcgttcgacggcaagggacacggcccatacagcggcgtctccgacggccgcgtcatgaggtggaacggcgaggcggctggctggagcacctacacgtacagccccagctacacgaacaacaagtgcgcggcatcgactctccccacggttcagaccgagagcaaatgcggccgtccgttaggcctccggtttcacttcaaaaccggcaacctgtacatcgccgacgcctacatgggattgatgcgagttgggccaggaggaggggaggcaaccgtcttagccacgaaagctgatggcgtgccacttcgcttcaccaatggggtggacattgatcaggttaccggagatgtttatttcaccgatagcagcatgaactaccaacgatctcagcacgagcaagtcacggcgaccaaggactcgacgggacggcttatgaagtatgatccacgaaccaaccaagtcaccgtgcttcaatccaacataacctacccgaacggtgtcgccattggtgttgaccgaacacatctgattgttgcactgacggggccatgtaagttgatgaggtattggattcaaggctcaaaggctggtaagtccgaaccatttgccgagttgccaggctatcctgataatgtgaggcctgatgggaaaggtggttattgggtagccctccatcgtgagaagtatgagctcccctttggtccggacaatcacttggttgctatgagggttagtgctggtgggaagctggtgcaacagatgagaggaccaaagagcctgagaccaactgaagtgatgggagaggaaggatggtaaaatatacatgggaaatgttgagatgccgtatgtcggagtcgtgaagagtacctagatttatttaggatgtgcacttagggagtgtttgaggagaagtggattgaggagattgggaagatacgtaaaaagaggtgagccactagctcataattaattgagtattaactattttaaattttaaaaatggattaatatgattttttaaagcaactttcatatagaaatttttttgcaaaaaacgcaccgtttagtagtttgaaaagcgtgcgcgcggaaaaagagagccaatctcccctatcacccctaaacgaacgatgccttaggttttagcatgtgtaagatctatgcgtaatttgtgtacttttgattcctttgctgtgtactgtaatttgtaagcagattagtttggttacatgtgcattttagtgattttcattcctctggttatgcatccagattctcccgtaaggcctcatataaagcttatcacacaggtacatcaagtcactctcatgttcagggcataaatggcataattctcagcgcaaatccatcaccaaaagataattttatcttctactcccagctgctgccaaataggcagctcttacatacagatgttgccaaagaggccagatccaattaaggtcgatcaaaacaaacacctatgtagtagatctattaaactaagcctagaacccgatcaatgtgttggtaattccttcaattgtgttggtatatacacaggacaccatttgctcaatccaggacacctgcagctctataagattcaacactgtccctgagtgtttcctcaaatggcttgattttccatcctagcttctctagcttccccgagttgaattgcggctcatcgctcacttccacaaacctgtaattgaaatgtaggggtttcatagaattcatatggaaactttactaattcaaaatgcagcaaaagcataacgattgccgtgttctacagatgcaaagtgcaatacttcatacatacgaaggaaagatttcgctattctacatttcaacccaagagcagaggctcacttgtcggcaaatttgtaaccgggataccagctctttagtaagtcaatgatatgaggcatccttcttgcgtgtgaactgcagatgtatcgtccggagacccctggggtttcatacagtaaaagaagagcatcggcaacatccctgacatccacaaagttcctcagtttgatttttacctcacaatcacctgccgagagataataaaatggatctcaatctgaagcagccacagaaacaaagataatttatactccctccgtttcaaaatgtttgacaccgttgactttttaatacgtgtttgaccgttcgttttattcaaaaaatttaagtaattatttattcttttcatatcatttgattcattgttaaatatacttttcatgtacacatatagttttacatatttcataaaagtttttgaataagacgaacgatcaaatatgtttaaaaaagtcaacggtgtcgaatatttagggatggagggagtattatatagttggcaatggaggagatcgacaggcaccgatcactgttagtgtcaaccttcatctcaagatggccatgctccatctcagcacttttgccgcgacttgctggtctctcgcaaaaaagagagaaaaaaattgtaggagccatccaattcgatcagtagcttgattgagtgaaagcgataaatctctaaaccataccctcgataggaaaaacaacaaaaaaaagaaaaagaaaatcggtcggagaataaaagtccgaccccctcactcgtccaggtttgcaaaatcactgaatcccagagtctcaaatgaaatgtaaacagtttggaattgttgatgcttgcaacaatggcgataatgtagcaccgcagaagacaggaaaaaacagaggtgggcagcccgtctaggtcctcaccccttctaattatttaatatcagaccatttcataatattcatgttttttatttaattggagtggtttatgcaattttaccttttttctgaactagaaaaaaaagcccaaccattttgaaacggagggagtataatgaatcactggagcatagcaaagtgaggcaaaatgctcaacctttcagacatccaagtatgactgtactgctcgcattcacagttggttgcagcaaaggtccaatcaccaacgatgggcagagtgtcacaagatccaatccacttctcttcgcataatcaaaggcctcaatctccgcaagtgttttcccaagggtataccaattctgccaaaccgatgtatcaagcgaaattggaacatatgagaaccatatgcctacatgaccaagatatgtaaagaagaaaaaaggcaaagtattgcactattgctcacttgaattaatcatctcagactaaagtctcaaggcaccgaatatttaagcaacagcaaaaactagtgaactaacagaaacagtattccaactagcgttgactatcaagatgtttattcatgcaaatttgctttgtaatttctaatagtaagtttttttggatacttatctagtaaatccaacatcatgttgcaagcaaaatctgttactccctccgtttcacattgtaagtcattctagcatttctcatattcatattgatgttaacgaatctagacttatatatatgtctagattcgttaacatcaatatgaatgtggaaaatactagaatgacttacattgtgaaacgggggaagtacttgtcaagagttcaaggctcctttgatttgtaggaaaaatataggaattttggaaagattttaatcctataggaaaatttcctatgaaggcatttgaaacaaaggattgaatcatatcctatcatttgaaattcctatgaaacggataatcctatagaaattttgaaggaaacttagcaagagctccaacctcttagaatatttcctttgagtctatctctctaatccgattcgtgtgtttttcctgcggtctaatcaaacggtcattcctgtgtattgcaattctctattttacaattaaattcctatcaaaatcctatatttttccttttcctttgttttttcattcctacgattcgaaggggcccctcagtcatttatctcattgcatatagtacatgagcaataagccttgtgttggtttggttggtatcaccttagtggctctgcagtaatcgacatcagaccagcaatcttcatctatggccttgccctcagaccagttaggattcaccatcgcagcagagacagatgacaccaccacaaccctcccaaccttagcttctgaacaagccttcagcacattcgtcgtgcccgttacagcaggagcaagtatatcaacctacagcaacatcaattcattagctacaagaacatgacggtttacaactctctgcagacttcagctactactgcttgttgagaaatcaactgtttcaacaaatcatttctagtagaaactgttgattttgtcgattttcagtaactgcagtctacagtttgaacaagtcaatggagaagagaaggaattgttttgctgaaaaagagagagagaggtgtgcctctgggttgggggcggagaggagcacggggcaggccacatggaagacgtcgtcgcagccggcgatggccgccgccacgctgccgtagtcgagcaggtcggccttgaacagccgcagcctctccgcggcgccgtccagagacatcaggtgggcgttcttggcgtcgccttcgcacaaaatcgccagcacacgcgcaccaatcaatcaatcaagaacaagagcagaacgccgtaaatatcaaaatctctgagcagcatcagaaggaaatttctgaatggttcatccaagaactcagcaaggaggagatcgatttcgtcaaagatcccaggaagtgagggtatacctggatcacggacggtgccatggacggtgtagcagccgcgggagaggaggagcttaacgagccacgacgccacgaagcccccggcgccggtcacgcacaccgtcttcgttctcccgtcgccgcccaacattgctatggtacaactgctgctacagcacgacgtctagacttcggttagctcgtgtcagtgtcacccaagaggagaaatcctgtttcctgtctgtggcttgtagagttgtagtactaccgtctaccggtagtgtgctagttctactatattatgtcgcatggatatcaaaatttaagtcttatacaagttaattttgagattaattttaaaggttttgtttcattgtagttttcttttttaatattaacgcttaaataattaagaatatgtatgtaaaagtttaaattctaaattatcttttctgctaatacgttaaacgatatagtttcagcaattggccagccgatgtcacctttagtctacttcgagcagcactgattaattaactcaccagacaaactggttattgagcctgtgcagaacgtgagagttgacaaatgttgtagcagctgattgggactggatagtgatctttttttttttcaaaaactgaactggatagagacgagtataattatttgggacagaggataaggatagcactgcaggttcacatctcgagaacccctaattagaccatttttaattcgaagtaaaaacatatcatattggattttttttatatgatccttggaaataacaatttgttagatcatatgaaatttctaagaaatgccctctatccacataagttttgaaggattttttaacataagattcagtctcatgaaaagtttcgaatggatctatctctcttatccaattctaatgttttttttatggttcaatcaaacgattatttttttcttttctttttctgtattgcacaactatattttttttcttattccttcgttttcttaatcacgtgtttcgaagaaacctttaatatgtaaaggaccaatagtaaaaccatgaagtttatttggtttctagccacaaccaaacttgagacttaggctgagttcgtttctcatgattcctaacccctctccctcgttttccacgcacacacttttcaaacttttaaacggtacgttttttttcaaaaagtttctatataaaagttgtttaaaaaatcatattgatccactttatttaaaaaaatagctaataattaattaattatgcgctaatggaatatttcattttccgtgtttcttgtggaaacgaacacagccttaaaatttaacatgtggagtgtctgcacatcctattcacacagtcgccctttgcacatcccctcccaccataccgcgcacaaagggaaaaaacaaacataaaaaaccaaacatgcccaccttctcccataagtaattatttcctatttcttcggatcccattatagtgtacggcattattgttggcacataatgagaagtgtgggtcgtcataattattgtgttctagaaaaaaaaagagaataattatgggtagtcaccaaatgcataatactcctccgtctcataatataaaggattttgaatttttgcttttaatgtttgaccactcgtcttattcaaaaaattttgaaattattatttatttcatttgtgacttactttattatccacagtactttaagcacaacttttcgttttttatatttgcaaaaaaaaaattaaataaaacgagtggtcaaacattgcaagcaaaaactcaaaatcccttatattgtgggacggagggagtatcatggctaaagggagtgcctaggcccaaaaaataataatttcatttgaagctagtgcgctttgttggtcaatctgacgttgccgtaatgataaattttttaaccataagaaattgtctaacattataggttatcttcatgtgtttcaatttactccattcttgggtacgatgttttataggaataacatgatactatgcgcattggtgctacatgtttagaattggtagccaaggagcttttattccaatttggatggtacagtacctacagaatttcgtgctagaatctacgtaattttgaaaacgttatttcagttgacccttttattggcgggcgggagttggggggtttgtcccatcacatcttttttaagttcttctaagacttgttggatgtgtgtccatgagcagaggccggagatatagcccttttctattatgtaagaaaaaaaaccataatatcaaattgtagccaacattaaaaaatgggtccaggctagctatctcgttagctaaaagttgcagtcaactaaccaagtttagcaaggtgtggaggctagccatcccaagtccttcctcagtactccctccgtaaaaaaaacaaatttaaaactgaatatggtacttcttagtacaataaatctagacaaatatctatctagattcgttgtactaagatgtataaaatctagtgctagattgatttttttatcggacggaaagagtacaaatttgcaatctagtgtcaacgactgtaccatctctatgaatttgcagttttttacaacagctcaaatgaaatccaacagcttagggtattatttattaagtaggtgatagcctagtcggtgacctatttttccaacaacgctgttatagacaagagtattgtaaccgacaaccatgttgcataatattgtcagaccacacttttacaataatagatttgttatacatgagttcatggtacatgagttttgttatgtatgctaagaaaagttaacgagaaactatatacttccatagaaattggacttctgcaagactgcaacggattgtgctgaataactgaattctgagagatgggcttcggagtccgcaggtccatgttccaataaaccgagcccggtccggcccaacagtccattatcatctggcctgtcaaccctctgcaaccgggcctctcccgactcggaatctctcaaaactcggagtccgaatcgagcgaacataccttgcgatcgatcgagctcggatcgcaggtcaccccgcggccgagctccgattcggacctggctgacaaaacccagccgcatattactatataagcaccacgctgctcctccaatctctcaaccaaaccaaagcctgcagctgcagcgaacgagagcaccagcacgagagccaagcgtacgtgcagtgcagccaactgatcagactgagacagcgcgcgtacacggccgagctcctacaggctacagccatgagaagcacggcgaggcaagcggcgaccgcggcggcgttcgcgctcattgtcttcctcgtgctgctctcgccgtcccctactgccgccgccacagccacaacgagaatgttcaagaccattgacgcccggcggagccagcatctggacctcggcggatcactggtcggcccggagagcgtcgcgttcgacggcaaaggccgcggcccgtacagcggcgtctccgacggccgcatcatgaggtggaacggcgaggccgctggctggagcacctacacgtacagccccagctacacgaaaaacaagtgcgcggcatcgactctccccacggtccagaccgagagcaaatgcggccgcccgttaggcctacggtttcactacaaaaccggcaacctgtacatcgccgacgcctacatgggattgatgcgagttggtccaaaaggcggggaggcaaccgtgctagccatgaaggctgatggcgtgccacttcgcttcaccaatggggtggacattgatcaggttaccggagatgtttatttcaccgacagcagcatgaactaccaacgatctcagcacgagcaagtcacggcgaccaaggattcgaccggacggctcatgaagtatgacccacgaactaaccaagtcaccgttcttcaatccaacataacctacccgaacggtgtcgccatgagcgctgaccgaacacatctgatcgttgcattgaccgggccatgtaagttgatgaggcattggatccgaggcccgaagactggcaaatctgaaccatttgttgacctgccaggctatcctgataatgtgaggcctgatggaaaaggtggttattggatagcgcttcatcgcgagaagtatgagcttccctttggtccggatagtcacttggttgctatgagggttagtgctggtgggaagctggttcaacagatgagaggaccaaagagcttgaggccaaccgaagtgatggagaggaaggatggcaaaatatacatgggaaatgttgaattgccgtatgtcggagtcgtcaaaagcagctagattatttaggttgtgcacttagatttaggatatatgttagatttctgcattatctgtgtgcttttgattcttttgcaatgtacctatatagtttgtaagcagattagtttatttacatgtgtatcacttcttgaacttgcaaaaggcagaccgaagttgtaacttcaaggctcccattatttgtcctacaacttataaattgctactaaaaaggttaaaatttaaaacttaaatttattttgtgacttttcaccataccttattgtacaacattgataagtttttaaatctcatagaacacatatataagtatttcactaatggtttttctctagtaagccatatggcttataatctgcattaggggaaccgatggcgacccaggtctggaatgaatactcgtccagactctcggactaggtccccaaataaaactcatcacgcaagtacaccaagctaatactagtacatcaccaaagataccttgtcttgtgctcccagctaatgccaaatggccaactctgacagaggttgcaaaaggggccagatccacctaagatcgatcagagatcacctcacattgtcacacacacacacacacacacactggtcggcacaaaagccctgatggggcaccacttcaaccacagcttaattagctttcaatcacgcagcagatcaattaaactaatccaagaacaacaccccccaagctgtgacagcaacacaggatggattagggccctggaaaacgctttccgaggcggccatggccatgatgattttgtcgctaatctaatctctctctctcgatcgcatcgggctggctcgctcgcgcacatgggcgttcaccctcgcggcacggcacggcgccgctgccgcctactataatacacgcgattacacgacacgttggagggtttaggcgttagccatggggattaattaagggtttaatctcccctgcccgggggtgactcgatctgtttgtcgccgagttcgaagggctagggatgattggcatgttatgaggctgattaatttaaagattttggttgtgtgtgtacagctgtgtgagaagaaaggttaattaagagtggagttgtgaagtggtttagctgctagctgtgtgtgcatggtggtgacatggtgtggtgtgggtgaaagctgaaaagggcatgcttggcatggtccagattccaggatgcaggatggttcaatttgatcaagggttttttttttcctttttggaactcatgcattttaagatattaagcacatcataccagtttagcttttgcagtaattctctgtttcaaggaaggcatcaaagttctatgaaattaagcactttctaatatttttattttttttgggtgtggaattggtggttctcgtttcagcatatacagaaaaaaaaacttttctgttctgatttctaaatagggtctaaggcgcagtttgatttagattattgagtgcattattactacaaattatctagtcgatggtatagacaaattaaatattttttaaaaaaaacttaacaatattctatctgttttagaaaaaaaatattgaacttttgataagttcgactctggacatcgagaatgtctatattggactctaaaaatagttttgtctaagacaggggagtattatcatgataaaacaagtggtttaagaaattattttttaagaaagcatatttttttgaagatatctaaaccagtcataatctagatgctatatgttcagattttttaagtgttcgtactccataaatgttactattatcttgtggatgtttgcaacgtacggccttcctgatagggcaacaaactagggtcattatctatgagcagggatagatagactatacctgaagataatatggaaaagtcatatgatcagacgccgatattccggaccagttcttcaataaacacgcattgaacggtcaagcatagatcagtggcctgaatatctttaatttattttccatgaagtcattaagccattaacccagccagctgattacagtcgctgttaattttgtccaattccagcagcaggtagttattgattttgtaaccatcaactgaagactgcagggaacaaggcagctgaacattatgattgttgcagcggattgcattctgatagtaccattgaatcatagtactatcagatagactatcatctgattggtgcaagtaaaatcttgtcgctgtgtgtaaactacaaaatgattgatttattatattatggagtaataattctgtgaactcaattcgagtataacaaaattgcaatagctagatagagattggttgtcgcggcctgaatagtttgaaacctggatcaaccagttgactaagagccacttgcactcaataatagattaacgagaaggataatcatattttaggacctcgtattattataggccaagagatgcagaatgcaaggtcaggtacagaggattagcatcatttgcggtcagtttgacaggtttgtacgtattttagctccgtccatcccagacagatcactaaccatatccatcaaatcagatatatctgtcctactcaccctctaaaccaaggaactctctacactatggttaaatcacttaaatcgaactgttcagcgtaaaattcctgtaaaatatataatgtacaacaaagtgttaatctagctccagagatgtaggttttgtctgaacttcgttaataaaatcatgtgttcctatatcgtcatctgacgtgtctggggagcgatcgagaagtttaaccatcgttctgctatatcgtaacttttataacaatgagaatttggagtgagtgtatgtgttctgtactagcgtctacttcgaacggtactagattaatttattatgtgatggagggtacctccatatgatgttttgaaagaaaaaaatagagatctacctataaccattaatgcacaacaaggttgtttttttttctttttgaaaggaaaataaatgggctgtttagattatagccaaaataaaccttacaaaattttgttaatgtcaaaatcatggtaagttagcaatattactaaaattttgataggattacttatttatttaccaaagtttgacaacaaaccaaatatagatactctttagcaactttacccaaaaaataatatggtggaaaaatggtatcatggtctggatcccctagcaaaatttttcaccatgtcacattgaatgtttggacacatgctgcatgtaatattaaatatatgcaaaaaaaaaaactaattacacatattgcgtgtaaattgcgacatgaatcttttaagcctaattgctccataatctaacaatgtggtgctacagtatacatttgctaatgacagataaattaggcttaataaattcatcttaaaatttacaggcagattctataatttttttcattattaatctacgtttaatattttgaatgtgtgttcatatatctgatgttacacaccaaaactttttaccccctaatttaaacacagcctcaatcagaacagccccaaagttaactcgtcgatccgtataaagatgtaaaacgaacaattctcggcggtttctgcgtcgggtggtgaaaaagggtcgccggaaacgtacgcgggggggcggatggagacgacgtcgtttcgtttacaggttggcgccgagccgacgggacggtgtctgcctccggcgacacgtatccggtgtcccgcgactgcagcagcgaactgctgcactggacaccacaccgccctccacctgtccacgcccccgtcgcgaccctcccctcccctccatatgcttctctctctcatggttacaacttagcaagcaaaagggcaaccccaacccgaaacagccgcaccaaagcagcagcaacagcaaagccagccaagacgagacgacccaaccccatctcccatctctcactctttcttctctctctctctctctacactctatctctatagccatcgccttcgagatctgaccggcgacgccagagcagcgagagcgcgagaagctgatcgatacgtgcatggccgccagcaacaacaagtggtggcaagcggccctggacttcccgcctccgccgccgccggtgaccgttccgccggcggctccgccgggggccgcgtccccgaagagcaaccagcagccgccggcgggggccatcgtgccgctgcgccgcccaagggggaggccgctggggtcgaagaacaagccgaacccgccggtgatcatcacgcgggacagccccgacgcgctccactcccacatcatgaaggtggcgccgggggccgacgtgccggcgtgcgtcgcggagtacgcccgccggcgcgggcgcggggtgtgcctaatgggcgcgtcgggcgccgtcgcggacgtcaccgtgcgcggcgcggcggcgccgctcccgggaaggttcgagctcctctccgtaacgggcaccgtgctcccgccccccgcgccgcccggcgcgtccggcctctccgtgctgctctccgccggccagggccaggtcgtcggcggatgcgtcgtggggcccctcgtcgccgccggccccgtcaccctattcgccgccaccttcgccaacgccgtctacgagcgcctcccgctcgccgacgccgccgacgtcgccgacgtcaagcccgacctttcctccgccgccgccgccgccacgtccacctcggcgccgcaagaagtgcaacagcagcagctgccattgccgccatcctcgcaccaccctcaagccatgcccgcgacctaccccgaccaccgctcgccgccatacgcctgggcaggcggcgtatgatcatgatctgagctgaatcatccatggcgttcttcaacctaacaatctctagggaagctaggtttttcgcgagttcgtgcaattgattagcggaaaatgctcttcttgggctagtcttgtaattttgtttcaccttttcattgtgattttattgtggagaaaatatgggaaatggtgtgtgacctcaaggaagcaaattaagctcgagttaagatatcagtagaattcaaagggtggtgaggtgcatcgatcagttagcccaagcattttgtgtgataatttgaggctaatgttccaactttttctagtttcaaaatcttggttaatgcttgtgggttgtgttttgtttttatcttaagctaaattagggaaaaactcaattatcttctcttattccatttacttgcctcgtggcagtcatatccgattccaatttgcttttgtttatacttgttggacgttttagacagtttgtttacacatgctctcgtgtttgtatatgccattcaattagtcaaaaagaaatcctaaagaaagtgacaatgtagatttttatgtaaggataaattccatctagcatatgtagagagaaaacagatcagatgtatacactcgagattgtttttgtccgacaaagatggtatcttaaatttccctttgttctcgaataaatattactgtttactatagccgtctcactttgatcacaaatttcctttaatgatcacaaaatacctttagtaattacattaaagtgaatgaaagttgtttgattacatttacgacgctaaacaattcgataatgtagaatattttttttaagtatttctcttctctttttttcaaaaaagatgagtgatgaaagttcaaacatgaatgtgccagtgtcatttattcgagaacgttgaagtattaatgccttcactcttttttctaaaaagaattgatatatatttgctcgcatttgtaacgtacataaaagcatctccaacaacagtcaagctatcacgaatgccatccagaagatagcacgtctgagcgaaaaacccgcaaacatgccatctcgagcaccaaaagtagtgtctcctccatctgacatgatcgcacgccatattttgtgtttctctctcctcacaccatcccactattacccatctcaggattgaactctcgccctccattcgaatggtatgaaaattaaattcaaaggttatgtttgaaatacttttttttctatcttcaataagaactgaaataattcctccaaaaaccttgccccagctccttcagacgggactaggtgatgatctgcttgatttatcctttgtataatatggtgtacattaagttcaatttgctttgatcattggtcagttctacttgaatttcaattgaccatatcttgtgttttcatttccttctttggcctggttttatatggctatttttactagaaaacagaaaagttcgattcagcagcatcttgcttgcagcaaagcaccatagcctggatgttttctaaagaagcagcagcctgccattgtaacttccaaaggctaggcttttgcatgtgcatggaacccactgaacccagcatccttctcttctttcccttttcttttcacttttagcactggtcagactatcagagagaaaggatcacacacatgacagtgtgaaacttgatagactgctagcaaacttccaacttctatagaaggtgtttattgggtaaaggtttaaagggaaatgaactccgtgtatgtctatataatacaaaccaaagactatcttaagataaaaatattcgtctgggatttatccatgttattatgagtaaatttttactatgagtaactttcctacaacagtttctaggtatgcattacacac

SEQ ID NO: 20600 - DNA, 717 bp, Oryza sativa
  unsure (1)..(717): unsure at all n locations
nnnnnnnnnnnnnnnnnnnnnnnnnnnnnnnnnnnnnnnnnnnnnntgttattgtataaacaatgcagatttgtgcataaaccacgcatacttgtacacagaaaatgtagtcaacaattggctataactacaatagctagctgtttgatttcatgggaattcaacaaaaattagcttaggcggatcatccatgagaccacaccgaatatattgatgccaagcacaagtttgtcagcatactgagcaattcaaaatgatcggcaagaaaagatttgttcatccatgtcgaaatagaagtatgaaacagaaaatgttgtcgatatgtcttacccgtgagtacggcagactcctgcatggctgtggcggcaccgacaggcctatccttcaacaagctctggcgcagcgccatgttctcagctgcgcagcactgaagcgcgtagctgaggcgacgacactcggcctctagatacttgctcttagtctctaggtccttaacatacatcttcttcctctccctcgatttcatggcagaatccctatttctcatctgcctgataattcataacacatactattagattattgtctaactagaacatctttgattacggaaaacatcttatagttgaaaagaccatacactcttataattgaagcctacaatttcttacatttcacaaaggattaacactaaaaagaccatgcatcttattacga

SEQ ID NO: 20601 - DNA, 4800 bp, Oryza sativa
  unsure (1)..(4800): unsure at all n locations
nnnnnnnnnnnnnnnnnnnnnnnnnnnnnnnnnnnnnnnnnnnnnnnncgacatgtgggacccctacaccggcatcccccgccggccatctttcatgcgtcgaagaccacgccacatccaccggcaactcctcctcacacctaggtcgcctcctccactgccggccacgcctctcgcgccaagccagcctccatctccgctgcccgcgcctctcgcgccgagccggcctccgctaccatcgactgcgactctttgcgccaagccggtctccgacccctccaccgaacgatgccgcgcctgccagaagcagccgtctcccacgccctcggctagccgtccgagactgtcatgcctccggtgaccgcagtcgcagtcaccaccaccacagccactgttgtcgaacgcccagccactcgcacccgactccttccccgccgccgacgtcaccaccgcctccacagtcacggccgccgtcgccgctgccaccggcaccagtcatcgcctccgcagaccgctgctgcaccgtcgctctccgccaccaaggagccagcaacgccccgatgccgcctccatgccctccgccgtcgtcgccagccgacgccgccgctgctgctgtcgccagccgaccaccaaacccggccacccctcgaccgtcgtcgcagccaccgcacctccttctccagcgtctccgcgccgtcacgcccgtcgccgccggatccggccgcctcctcggcagtcgtcgtccggctccaccgccgccagttccggccgccgtggcaccggcaccgtcgtcgctatcgccctgaggacgccgacctcctccgccggcgccggacccccaccgggggccgccggaaacctccccgccagatccgcgccggatctggcggcctcttccaccgccgccagcgcctccaaagctccgccgccatccccgccaaaggccgcgcccgagcacactgccccaccgccggcttaactccccgcgaactccggctggccgacgcagatctgggcggtttctgcctcccgatgccggcagacctccccctgcccttgtgcggcgagacgaagcgaagccccgccgccgctgtccttgccgctgcgcggctttactggcggccggtcgggcggcggaggcagaggaggagggagggagggcgggcgacggcggcctgggcacctcccgtgccgcccgagaggagacgacgctagaggaaaagttgttagcagattctcgttttacttgcttagtaaaatgacatgccacgaacagatggtctcctgtttctggggcaagagtgctcaaagaactattaagccttcatggataactgatcctgccatattgcactgttacactgggtttaatgagcatcattttaattgtgcctatacctataagccaaattttaaatctcatgagttaattttatgatttttaatcatagtttattttactacattaacttttgaatttttaatcatggcatatatataaaagttttactcagaaattcagtattattaagtttttgataagctatatggataaacatgagcaaaagtgcaaaactacgtctgctatggtatttatctcagtatcaccgtgcaattaaaccataagaattctgcatatctgcaggggggaaaacttatcgcgttgatcataacgcccttgtaatttgcaagagatggatcagacgttcattatgactttgagtaactacatgcacaaaaacttaaatcaatcgtacagaaaaaaaatgacagcacatgaccaatttatggagaaattatgatacaaccgctaggagaccaaccaatcaaccgtgacatcctaacccaattagatgcggcgtggcccataaaagctgtgtacgcatgtttattaccaccttactagtttagcaaggtgaaacaacttataaggccttgtccctctaactatgccacttccaggttaacccttttacacgaagtgaggacgaatgtgtaagtggagtggtatgtgtaagtagaccagcctgtcggttgggctgggctatgcggttctggagatagggctattacaaatggtatcagagccgaccctcgcggttgcgcgggttagtgtgttatggtgcatggcgcatgtggcttctatgtgagacacatggcatgacatatagccccagcattggacgtgtgctaagagggggcgtgttgctggatatttgcctatatgcatgtgtggctacgtgggtgagtttatatgcatgtgtggctatgtgggtgagtttatatgcatgtgtggctatgtgggtgagatgtatgcatgtgttcctaaaagggggcatgtttctggacattatgcatgtgtggctatgtggtgagttggtccagtgctaaaagggggcatgtttctggacatttgcatgtgtggttatgtgggtgagttggtccagtgctaagagggggcatgtttctggacatttgcctatcttcttggtggttatgtgggtgagttggtccaatgctaagagggagcgtgttcctgtacatttgcctatatgcttgtgtggctatgtggtgagttggaccgacaggacataagtcctttgagggaggtgtacgtgacattctggtccaattaagatgcggcatgtgtggcccatgagagctgtgtgcgtatgtttattaacacattgctaatttagtaaaggtgaaaccaacttataagccttgtctcttcaaccatgccactctcgggttaacccttttacacgaagcgaggacgaaaatgtaagtgtgaaatggtatgtgtaattgggcccacccgtcggttgggctaggctacgcggttctatagggctgttacatcaactgatactaataaagcataagttgcaacgtgtgtggtgcatccaatgtgttcttccagaatcacaatcaagttatccttcaagaataaaaaataatttccttgatgaggaataaccgtgactaactttaatgagttgcacaatcattattcggttgaacagtgtgtggtgcatccaatgtgttaacatccgtaaatgcaccagcatgataaattggtaatacgatgttcgatttcctgtcttttaggaaaaacgagtccggtttaaaatggaacaaatatacannnnnnnnnnnnnnnnnnnnnnnnnnnnnnnnnnnnnagggccatgatgcaaaatgatcaacatatcacaacagctcatattaccctcggagagcttactaagggaaactggacgagcttgctgcagaatcagttgcatgaactcgattgccctgaatggaaatcctggtaagatcatccgccataagtacttctttggctatctctgcagtagattggaatcaataggagtcagtcaattgacgttttatttttgcaacaaagaaattgtagattcatcatcatcaaaattcaaatattatgtgcctgaatttcacagacagcaatccgaggatgggagatgtttaccttcgatatcttctattgatttatcagcaaagaaacaaaacggcaacacttcatacttctcccattcactaccatttttctggtcaaactgttcctccagcactggatggcatccagccaaatacaaacaattaagggacacaggaagaccatcttctggtaaagaaactacttcagggcagttttttatgatcaagactctgagggaagagaaactaatcatctgaggcaaagccattaacttcatacaatttctgaccaccagttttgagaggaaagaaaggtctcgcaggttcctcagtgatattagcgcgttgcagtgttccacaaccagtgcagttaatgttgttaggttaccattttcaggtagttccttgagctcagggcaattctttatgatcaagttctggagggctggaagacacctaaagtctggcactgacgttaacttggggcaacttgcaatttctattgtgcttaaccttaagaatgtttctaggcccatgaaagctgtcaacccatcacagcttaaaatacacagcttctcaagtactccagtcactgactttggcatggccaacacacgttcaggagttgaataagtgatgttgcaatcgtttatccacaatgaaaggaaactaatgttctgaaacacactaagaaaaatgtccactgtcaggttgcagccaatcattttgagacattgaatagatgccgaagaaaagacattcccatcctcttcccgctgtttactagctgcaaaagcatgctgcagatcagaacatcccctgataaccaactcttcaagggatggcagatttgttgttacatctttaagtccatcttccagagtgtttgctccttcaaagatgatatttacacatttcacaggttccagacgacgaagatgcaacatatccaagagtgtgcttaagctcacctcctgagtaaaacatgtctccaggcgattatgatttcgcagcctgcaaacttcggtagatacatatatactcattcttacaggtgggagaacaactggtggcaattgtttcagcttggggcatcctctgatgcacacctcaagaagagcaggaaaaaaacagtccacagaagaccattctgccaattctggcaactctatcatttccagaatctccagtgagggaaagccagcagtcccataaaactcggggcctatacaaaccactgcattcagtctagcaatacgaagtgtcctgagagattgtatttggcctaaagatggaagcaacttccaacacttgcaatcagaaatgctaatgtgt

SEQ ID NO: 20602 - DNA, 5006 bp, Oryza sativa
gtcttaaagcatcgaacacatcattcgctttgtcagacttgctagaagcattaaaagaaccccattgcagtttcagtttaaaaatttgactctttctgaatagttgagcatcagttccctcatccctgcttttcacattctcaagagatgtaatagcaagcgacccctgaagttcattcatctgcttcagcacctctagtccctgcactttactcttatcaacacagaattccccagccgctcgaagacatggcatatggctgctggcagctaaatcaacagtgcacatacgatgaacatcaatacacaaaatgctgctcaaggtgcccaagcacttaggaaaagtaacaagtcgcctgtccatgaaacatgaatgccagcgtatggacaacacaagtaaatggtgaagtttacagagtgaatttggaagcgagttttgcgtatgttgtgttagaatttcaatggttactctcattgagaagaggatggcactcgagatggggcaattttctggttttcttcattcacaaaaacacaaaagccatacctacccgagggaggttggatacatatatatagccatagctggctgctagcctattgctgcaccctcctagtctaaaattcaaaatttgaatgggatgttgtcctagaaggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcacgaccaaggatcacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcttccaagtagcttcggatgaagtggtacctcacccggatgtgcttgctccgttcgtgaaaaacggggttctttgtcagggccagagcggacttgctatccaccctgagctccaccgttccagtgtctctgccgaggagatcactaagcagtcgagcaagccagagcgcctgggtcgaagcggcggaggccgccatgtactcggcctcgcagctggacagggccaccacctgctgcttgaccgactgccagctaacgagcacttgccgaggaagaagagaatcccgctcgtgctcttgctggtgtcgatgtcgccggcgtggtcgctgtcgctgtacccgacgaagtgtgccttgccaggacaccttgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgccggtactgtgtagcatccacctcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagtcgtcctggtgcacttcgatccccaggtagaaggagagaggccccagatcactcatctagaaggtggccttcatctcctccttgaacgccgcgacctccgcatccttggtgccggtgatcaccaagtcgtcgacgtagacacccaccagcaaggcatttcctccattgccccgccggtagatggccgcctcgtgtgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgttcagaaacgccgacttgacgtccatgtgatggacgccccagcctttctgagcagccagcgcatgaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctctaggtcgcgaggcaccagtcccggcaccggctggtcgccgagaagatcctccatcgtacggtaccgtagctgctcaccgtcgtggtatgcgatgcgctccccgtcgtgggagagcggagtagcgaactccaccgggctgcgctcaacacgagctggcgtcgaagtagacgtgcttggaggagtgactgttggtgctggagcatgtggagtcactggctggggtggtgtcgacgaagagctcgtcgtagtcgaagtcgtggcccgagggtgtgttggtgtcggagtcggtggagattcgggggctggggtagacacgctcgatgaagaagagctgcctactcccccagctccctcgaagtggacgtactcgacggtgaagtcgtcgtacatcggagtcgaaccatcgtccaccgccttgtcccatacccaccctcgcccttcgtcgaacacaacgtcgcgcgcagtgcgcacacgctgtgtctccaggtcgaggatgcggtaggccttcgagccctccgcgtagccgatgaacacccctggggtgctcctgtcgtcgagcttgccgatgtggccaagctccttggcgaacgcgaggcagccgaagacccataggtgggagaccgccggcttgcgcccatgccaagcctcgtacggtgtcctgccatcgagggccttggtaggcgagcggttgaggatgtaggcggccgtcaccaccgcctccccccaaaagatggccggcatccccctctgcttgaggagggcccgagccatccccacaaccgtctggttgcgccgctcgacgacgccgttctactgcgggctgtacggcgtggtgtagtggcgctgaatgccctcatcagcgcagtacgacgcgaactgaatttgccgccgttgtcggtgcgcagcacgcgcagcttgcggtcgcactccgcctctgcagtagcttgcgcatgcctgatggcgtccgcagcctctcccttgctgccgaggaccatcacccacatgtaacgggagaggtcgtcgacgagcagcaggaagtaacgtcgtcctcctggtgtggccgctgtcactgggccacacaagtccccgtgcacgagctcgagccgctccttggctcggaagctcgtctgctggggaaaggggagccgccgctgcttcgtcaccacgcaaacgtcgcagagctgctccacgtggtccaggcacggcatgcctcgcaccatctccttagcactgagctgcttcagggcctcgaagtggaggtgcccgaagcgctcgtgccactgccacgcctcgtcgtcccgacgagcggcgaggcaaactggttgtgcgacctgcgcgctgaggatgtagagttgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcagtgaaggtgacggagccaacacccttgatctccacgccggaggcgtccccgaacttgacggagccttggacgctggagtcgaactcggtgaagaactcccgtcagccggtcatgtgatgggtggcgccggtgtcaaagtaccacccatcagccttgtcgttgctggagccgttgcagagggagacgagtaccttcggctcatcaaggtggaggaaagccgctgcggccggtgccgctggaggtagctcgatgcttgcatgagccaggagcagagccggctcttcctcctccacccgtgcgacgtgggcctggccacgtcgtggctgtcgacagtctttggcccaatggccaagcttgccacagttgcggcaggcgttgtctcgtgccggcttgtggttgccggtggcaacgccctgggcgcctctgcgggcgccaccctcggcacgttttcgcgcccaccgtagctggacacctccccgcgccttgcgcggcttacggccgcctgtcggggaagatgactcccccttcctcccgtcaccctgagaggcctcccactgctcccgagtgagattgagcttcccgccgatggtgatgggccccgagagaggctgtggctcatcaccatcgacgaccttgaggcgacctaacgcctcctcgatcgacatcgtggagaggtccagcagagattcgatcgagcgagcgatctgcctgtacttctcagggacacagcggaagagcttctcgacagctctctcctcgtcgtaggtgtcgtcgccgtactgcaccattttctgcaagagagtgttgagacggagagcaaagtcatcaacatcctcacctggcttgaagggcaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcagcgatgagggcatccagtgcccgccgatcctcgtcgtag

SEQ ID NO: 20603 - DNA, 9990 bp, Oryza sativa
gcccaccgctttgcccgctcccatgcccttcctcttgccaactcctcaagctccctgtcggcggtgatgtcgccggcgatggagccgttgatgctgctgcgcaaggtctcaacctctacctccgccgcacgtgccgcatcttccgccgcctccgcctccgcctccgccctggctgctgccaactccactgccgccagtttggccaccctcgctgctgctgctgcagcggtctgagccgttgctcgcctgcgctcttctgctgcggcgagctcggcgtcctgctgacgccaagtgctcgaggcgaccaaacgccgagaccgagcgtcggacatggcgcacctccggggggctgctgcgtggagagggggaagggaaaggggaaggaggagcaaccagtgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcacaaaaacacaaaagccatacctacccgagggaggttggatacatatatatagccagagctggctgctagcctattgctacaccctcctagtctaaaattcgaaatttgaatgggatgctgtcctagagggcatccaaactgaataaagcataaaggaggcataaagaagatgctaactgttgctgtcctactaaccgcagctgtcctagcacctgaaaaatatgctaaagggtagatgctgtcctgaaaaaggtgaaactatccaaaagcaaaaagaagaatcacaaccaaggatcacaaagacttatccaacatgttggagataaagaaatctgagatgtatcaaatgatcaatatatgtaggcagaaattctaagcaacagccacttaaatccaatactcttatgcacttgaattccttaaaaacatccgcctgcagacaaagttttgagcaaagagacctgccttcgttcagaaactattagcgtgcgcagcctttgcaagttatggaatccatggagttcatttactctttcgacaggtatagacagatgccgagttgttcctgaaatttctgcaagattaccatctctttctattctggagtactcacctctggaaatgtgagaagcaaggtcattcatgaggtcatgcataacataacgtattgtatggccatactgaagttcctgaaaaaatgatctagataatagttcattgaaataacttctaccagtttctctcatactttcatatgtgcctatatgaccatgaacaaatttatgggctatccacatattcaccaacaagtcaggctcaagagaatagcctttggggaacaggctgcaaaaagtaaaacattgctggaggtgacctggcaagcattcatagctcagacgcaaaatttgcataatgtcttccttgtttgatgaactacttttcataactcgtgtccactcttcaacgttgaggttagcattcaaatgtgcaccaacaacctttatgactaatgctgagccattcaacttttggacaatacattcaccgatagactctagttctggataatttcctggatcttcagcgccaaatgcgcagatcctgaagaggttccaactatcttcacccttcagaccctccaaatggaatggtgctgggcaacccaaaatccttgaaacaatatttgttcgagcagtaacaagaattttgcttcctttagctccatagcataaaggagcaaacaattctctccatctatcagcatttgtaagctcaccaatcttttcatcataccacacatcatctagcacaagtagaaacttctttgctgttaacttgttcttaagatcttcctggagcatgttaaaactgaaatttgttatatcactgtttctatcaattgatttcaaaatctctttggtgattttgaccttattgaagatatttgaaacatatatccatgtcctcagatcaaaaccactgactattcttctgtcattgtaaataagctgagctaatgcagttttcccaatgccaccactgccaactatggtaattatagatggtgttggtgatattgttagtcctctgcttggctctggtccatcagcttctctcagaagtcggtgcactagatcatcctgctcattttgtcggccaatgataatttggccaggagaaattgagctggtgacacgccattgaagtggctgaggaggcatatatgaattagagttttcagccccaatcactttgatgagcatgtcagcacattcttttactctaatcaggctattgaggaccctccttaacttggatctgaacttgtcttggccaaccaaacgctttactatggcaagagaactggaggccaagctacttagcttgctcttctgctgagcatttgccttcagaatcaggtaatcaaattcatccatgacgtcgtcggcatcataggcagaatctttcattttggcaaagtagagcttcttggttgcaatctagcatttgcgacctttcagcagcacccagcaccaattggatttttatcaaagtggattcgatcttttttagatcatcctccaagtcagattgccacttgtactgggttgatgtataagattggaccttctcaaagataagcttgatgataggacaaactacccacccaatgccggtggctattggtagtgtagccatgttggtcaatgtacaaacctatttccctttttttcaaaatatactgttttcttcaaatgaccattacagcttgaaactcaataatccattcacctaataaacattgaaaataattagaactaaccaaaataagaaattattgctcaaagatgcagtcaatatgggctactctactcttaaactctatcaggccatgtataagaagaccgaaatatgggcctcaaacacaaatttgcaactttaacggcaaaaattggatacacgagtaagagtaaatattgtcttcattcttcaatgatgcagtcagaaaacagaataggacaactgccagctagtgattattgaaatattgtttacctgactagtagtaagatcagaactgcagctcactcctagaagaagaggcccttgatctttcttcttgctgatcaaatgcaaggctgctttcagagagaaactaggaggagagccagattcaaacagagggaaatgggagtaaaccacaaatggatgtgcaagaaagttgacttccacctcttcaaacaaagaaaaaaggagaggttttttcaactttgagtaaagaattactccgtatcttgtatgcatcccacgttctcacacaaacaacagctggagggctttattagccgggttgaccaaagagacgaccaaccaaatcttataacagctggagagcggaggtaggtacactccacctagcagaataggtggaatcaccgtgaaattccagcggtttggcttccgatgcatcaaagcaggcagtggcagtcggtctgtggagaaagttttactaacaaattgttccgtatgagatgccaagaaaataatatacagactgttttgccacttagagtcttgaggaaggggaggagtttagatgaaagtgttggtgtgggattaaagtctatcttctattaccaatcctagctctgtgtgtaatgctgattgcgttttaccaagcaactacaatataaaatatctggttggttataaaaaaattagcttggatgtagtatcataaggagctaagatctactcatctctctgctttaaaaaaaaaggatttctctcctgtattgaaatgatggtgttgatcccttatattttccatccctgttgaattcctacatccatcaacagacaagaaaaaaaatggtattgaaatgatggtgtatcaatcccttatattttccatccctgttaaattcctacatccatccactgacaagaaaaaaaaatgttaataataacatcaaacccgctcaactcctattagtttcattccctctcaataatccactaatccactaatcattcccttaggacaacacatgattgacttcaccgatgtgcgacatttaaaaactctacggagactttaccctaagattaagaaaaagcgttaccagggcgggccagccggctctgcaaaacgaggcggtggcggcggcacggcggagccgagcggcgccaaacaagccattggtctgggggacatacttccaccgtgtgcagccacaagcgcgctctcacctcgcgccaccacccaatcggtgaattgggaggcgccgccatcgccgccgccgccttcttccctttcggcggtgcagcgctcccggatctcggttcgcgaggggaggccatgggcgaacccgccggtggaattccccagcctgcgccggccgcgacggaggcgttcgccggccgccggtggccgcgggcgatgaaatctgttgacgagacaggtggaccaaattttccagtgggctgaatttggtgacgggaattttgtggtccaaattccctcgtgggctgcatttgctgacgagaattcagtggaccaaattcattggtgggccaaattgtcgactgcaattaggtgggccatatttattcttggcccagttcgtagattggaattaaagttgggccaataatattcatgggcctaattcgttcatacgcagtagctgggccaatttcttttgtaggctgaatttgttatgggaatttaagtgggccgaattcattttagcctttattgggctgactttgttgatgggatgtttgtgggctgaattcacttctgggcccaaattgctgacatgaactaaccaagccgaattcattggaatcagtcagtggaccgaattcattgacgagaaaatagtgggctgaattcattcatgaccgccagcaagttttagacgtccaaaacatactcccccttccaagttttagcaactgataatttcgactttctcatttaaactttaaccatcaattaattacctatatattgttggatcgaaatggacttttttttatgtgtatatttaggaaataacccattttaataccataacatcatttctagcgttcataattatttaagaagaaagatgagtggttaaagtttaagagcaggtacaatagcaggctataagccagctataaacatattttaaagagataaaggaagagagagaagagcagcgggtgtcacgccctgaagttcccctttccagctttaaaatttgtaaaataaatcgtccgaagaaattgttcaatttaatctagagctaattcctcaaattaataaatgcaaataataatcgaaatcggacgcacggacttcaagacataatgtgtgtatgacatgtaggaccaggtattactagtacagtaagtaactaggggatagaattggctattacattagctatagaagatatagagctagtagtgggctatactattgtatgaattagctattacattggctatagtgaagcattcaccggttagtatcagttgttatgaaacggatgtgctagcaacttcgtagagatgtcggcatggctgtcatggcctcatgggaacaaaggctgttcttcctattttcgaaaaaaaaaatggttgttcttccgagaaggatggatacaacagtagagcaggagccaggaacagggcatggtcgcatggagcgtgtagcaacgtggaatatggcaatgctgagatctactgacaccgaggaatccaaacaaaccttactggtggataaccagcctgtattctccatacttaagaataaggaaattaaggtggtagactagactgtaaaaataatctctgtatgccaatcaccaaaatattcagaagttgaaccagaagatcaatgcaatcaaatgtttccacaagtttgtgctcggttgatgtgttcaactgtttctttatttgttgcctgatttaaccatatcctaattcatattgtaaaacatattaacagaaggaggatgtcttgccaggtgacactgatcctactaacacactatcccacggtatcacaccatcagactcctccatggccgcgaaagaaaaagtaatcgcgttgcttgcaatttgtaccgcgtgagatggatcagacgccaagtacggtttcgagcaattacatgcctggcctttgtccagaagtctagagctactagtactacgagctaagggcctgtttaatagtccaaaaaaaaaattgcccccgcatatatcagatatatgaacacactcacacacatttaaagtattaaacgtagtctaataacaaagcaaattacagattccgctaggtgcgagacgaatttattaagcctaattaatccgttattagcaaatatttactgtagcaccacattgtcaaatcatgacacgattagacttaaaaaattcgtctcgtaatttcctggcgaactgtgtaattggtttttttctatatttaatactccatacatgtgtccaaaccgcgtgaaaaattgcagctacgtgacagcgagaaaaatttcgtttgggaactaaacattccctaaagctcggatcaagatcgcagctaatcctggtgtaagtgtaactgcgctgctcagttcacaatcactgttactggctcatgctcatgctcatgctgcccccaaccccgagtccgtagcccgtaggcctgaaaaggcctagcacgaatgtagatcaatcgaaactgttgatgtgctatactccttcctctatcccataaaaattaaatttagaattgaatgtaatatatccaaatataacaaatatgaataaaaacctatccaaattcgttgttgtgtgctcctgcaggaatcatagacctaatagaccaggaatgtaatccttttctccgtgattaataaagtttccctctttaagctcaaaaaaaattcgttgtttggacaaagaaagtattttagataaatttattttacatccaatagaatgtattatatgtcacagagtttgttccagttcgacaatatactattgatgttgtttatttctgcaatatgccgatgagtttattaattcttctccaatatgccattcggctagatcatttttatgaaaaatacgcagaatacccttaaagacatcgaagttagcattaatttataggtttaatttatagttgtctttatttcttgttgattacaggatcaaatcaactggtacgctagcatacccgaagacgatttttggacctgcactggaattaagcagatctctcaggcctcgtgtttttcatcaatatttaaataagatataaaattgtctatatagcatccttacacaatatgaaagtttgcatatagattttcaagttattggggcatttttatttttttaaaagaaataattttatgtgataactgatagagaaattgcttacgtaaaatataatagcataaaattatgttgggtaggatatgaaatatgatttatattaaaaacaaagacaaaatattttatatagcataaatggataaattataatattttataaaaaatgaaatacaaaaatctttaaacttatacacaaactttcacattgtgtatagaggctaaaaaaattcataattttttttaaaaacttttaataggataaatcaatagttaatcttacatgtaaggccaacctaatgatatactcccttcatattagtaaagaaagtcgttgagtacaatgtttaagttaaatcttgagaatataagtgatgaataactctcaagttgttgagtttgaaaatgtaaaattatatgaatagatttgtcttgaaaaatactttcataaaagaatatatatatatatatatatatatatatatatatatatatatatatatatatatatatatatatatatatatatatataacttttcaataaatatttttatggaaacaagaactcaaagttgtgttttggagaccgtgctgctgtctaaaatgacttcatttacgagtacggagggagtattaatgccaattataaatcattaaactatgataaactcaatattatagagtatattctctataccgtgtcatctcgatggtaaaaaacagttgctctctccggtcatccggtcacacactcgagtcactctcactcaccacagttcttttttcttccaaccaaaaatcactctcaagttctgagtagtgatttttgccgtctaggtttgaagctaaaacttccgttaccaaaatgccggcattttgaatagtattttggctatgtttggtttcctacagcaacaagtaaatattactatcaaaatatcgataatgtcaaaagacagggtaaaaaccaaccttcgttttggtgaggtgacaagataagcagaactctcaagtctcacaatcgctctgactgcaagctggggatcttggagcttgcagaaacacggatcagcgagaggtgctactgcttttgcaaaatcacaagttgccgagggtgcaatagcaaaagaaggcaacctttgctaattgcttcgctactcgtccttaaaagggaagccgccgcgtctgcagctgctgcaaatcccaataaagcgagagcagaaaggaaggaccccttccaccactctccccctgtgttgtgcctgtgctcctctcatctttgactacccacgattccagtctcccaccacaggccaaaacactgcaacatttcagacttcacagttcacagtgagttcagaccaagaacacaagaataccaaaaagaacagcaccaagaactctcctccaatccatcacagacatttttcttccctccaagagaggcattgatcatcagagagtagagccagggcgtgtgtgtgtgtgatgagctcagtgctgctgttcttgcttctgctgctgctttctggagtgagcttgagtggctgcataaggcttggcaatggcgggtatgaggagtggaggatgggctcggcgacctacatcaaggagtccctggggcacccgctgaatgatggtatgtgcaatctgtgtgtgtgttttttaacagattaagcttctgaatctttgtcagttggtaggatcaagaacatatgccctttttctgcatttttctttggatggattcatcatggagatggtgaatgtagtttgcaaggatgaatggtgggcagatggtgtagtattgtgcagatccggcatagtgggaagtgaagttcaagttagaagtaggaaacaggagtgaagattcactgctgaaacttgttcttccctttctctttcttcagatagattgtgactcttcgaactgaacttccaatgtgtgtcctgttgttggcaggtccattttgttttaatttgtaaaaaaggttagtaaaaaggtttctttcagggttataaaagaatgttggtgccaatgctaataaagctatcattccaatcaaatattttgtctaatatcattagataaaaccttttatgtgcattagtgcactaatgctttcctagtcggacgaaaaaaacaaacgataatactacattattggactaagtgggccttaaattattggactaatgctgtcctagtagtaccagttatcttttttccttttaggtaggttatagaaaagctgaggcacattgaatgcatttgacaataatactactatagttatgacaggcaatctggtactatcatatgatatttccttgctgtttactgtccatgacgtagtacacatttaagtccttgagagtacatttgcagtaattgctccatggattattaagtgtcaaagtaacgcaacatatattgtcagatcaagattcatggcagcccaaccacactgcatttcctcacttgggatatcctgaattcaaggacatctcaacatg

SEQ ID NO: 20604 - DNA, 4355 bp, Oryza sativa
ccacggcaataatctgctcaaaactctatcttgaaacagggccttaatcttgacatcttgttggctactgtaaagctgatcatctccatctcacttgacaacggggcaaaaattatcaattttttgtctgaatgcaatgtgttgtctgaagtctgaactttgaacctgcaaatgcaaggcggtggagcctgtgggtacggcgacctggacatcttcaggtacgggaggtacaccgccggcgtgagcggcgcgctgttcgggcgcggcagcgcgtgcggcggctgctacgaggtgcggtgcgtgaaccacgtgctgtggtgcctccgcggcagcccgacggtggtggtgacggccaccgacttctgcgcgcccaacctcggactctccgacgactacgggggctggtgcaacttccccaaggagcacttcgagatgtcggaggccgcgttcctccgcgtcgccaaggccaaggccgacattgtgccggtgcagttccggaggtaaaacaataagcttctcccacacttttcttttacatcaccatagtctccaatacatgtttttgttacttatagttatatgttagtgaagtgaaacgagtagagcgacatggagatatacatttttaggacaaattcactacttgcttcgtctcaaaatatagcaagctaatactagattagatctagtgtgtgttagcttcggctctgctagtatgggttgtttatcgatcctattggtgtgagagttttgactcttgttttttttccctgtactgttctgaatgttctccttcttggtacaatgtttggtcggaaaagccggcgcggcaaaaaaaagtactagattggactcaattagttgtgttcagatttgtagtactaggttgtgtctaatctaatactactagattactgtattttaggacggagagagtactatcttagtacgattgagtagtccaagcagttttaagtttgattgcccgtattctggaacttcatctatcagagggagtattagagcaggtacaatagcagactattagccagctataaatatattttaatgagataaaagatgagagagaagagcagcgggctatagatctgtagccagctgcaacacggactccaagacgcagtgtgtgtatgacatgtgggaccatatattaatagtatagtaagcaactgctattagattgactatagatgaattggagctagtagtgggctatactattaaacttgctcttagagcaggtacaatagcaggctataagccagctataaacatattttaaagagataaaggaagagagagaagagcagtgggctatagatctgtagctagctgcaacacgggacttcaagagtcgtaatacaggcatgacagatgggaccaagtattaatagtatagtaagcaactattgtatgaattagctattacattggctataaataatttggagttagtagtgagctactattaaacttgctcttagtactgcacacatcatgttcatgatttgctcgctggtcattgatcacttgtagcgtatcattctgcaactagctgatgtgtgaattctgaccatgcaaaaagggcatggcgctatcattcttgagtagtgcatttggagtgtgtttctctaggctgaaccagtgctgcttttgcgaaagttcagaatgatgtttgatcattggagatggaacacagaatatgcggacagtgcgtgtttcctgctgctttgcatggagcaaagagcagctttaaatctttaatcactgctgctagcttccccctttttaaatctgacttgtgctttgttaattatgagcacctccacagtttcagacaattgccatgagtgtgtcccattgccccaactgctgatgcaggagtacactccaagtattccatttttctagaactgtagtagtactacaactctaacaagataaggttaaatcttactgccaatctgctgaattccgcatgagtcaaagcatcactttttttaacgactcgtattaaacagtatgaagttttataacgaactaccgcaatttgggttttcatgacattagccattgatggatgaactctagatagtactacaactccaataaaagacccaaaaatttagctgcaactactgatcagctctgcgtgaatcaagcatcaaacacatccatgggcgtcggagctagagtaagattaaggggggtgctacttgtttaattaactctgtcttatattaagtttaagctaatgcggatgtctaaatttgtattgagaatggtgcacacggggaaaataggttaggtatagctataatttttttttgaccaggttcctgggcatgccaccttaatactctagctccgccccagaacacatcggcacattgctcatatcgggttccatctaatgaatgaacgaaatgagtggtggtggtgcagggtgagctgtgacagggcaggggggatgaggttcaccatcaccggcggcgccagcttcctgcaggtgctgatcacgaacgtggcggcggacggggaggtggcggcggtgaaggtgaaagggtcgaggaccgggtggatcccgatggggaggaactggggccagaactggcagtgcgacgccgacctccgcggccagccgctgtcgttcgaggtcaccggcgggaggggccgcacggtcgtcgcctacagcgtcgcgccgccggactggatgttcgcgcagaccttcgaaggcaagcagttcgtcgagtaggtgtcgacgatgtgggtgtcattcttggaatgattgtaattattatggttataattatattatacaggtgaaaaacaactgttttggtttggttttggtttggatgttgttgtttgatctgctcagcatggcaaacgaaattattatagagttaatcagttaatgaaggattgacaaaaaaaatgtttggctaatcagagcagttatgtgctatcagtggtccagtgttggagtagcatcatctgaagaaaaaacaattgagtacggagtaccatttttttggttggtgacataatagaggtgcataaactacataaaaaagtgcatgtagagtacacaataaataacagggaaaacactgctttgtggtaggacatgtcatgggcatagtattcttgaatcaattcgcgaggcctggagtgaatgaatcattgggtgaacatgcaaatggcactggggttcacactcaccacaggcacagtgacgaaaaactacgaagagagtagcagtaaagcacacgctagtgcagtgaagaagttttctagtcatactggtgatgatcatcacacaacaatcatgctatcgaaactgtcgcgcctagcttgctgacaggctactgtacacatttcagcacctaaaagctaaagcctatatatagaacttccatgagcgaggatgcacactacttacagacgaggtcgcagtttttttttcatatataaacaagccgctacgattgatgagttgagttttgcttaagcaagcagagacaaatcgggaaccaactacaccacgggaagagctgctttggcaagagaagcatcacgcatcggcatctaaacaaaggaatctattgctagctgcagagaaaagaactaatcagaggcatgaagcagatagcaagagagaacaggcaagatttcatattacggtgagtgagactctgagaattgactccaacataacaagagagtaaatgctcaagcctcgttacagctgaaaaaaagggaaagaacaggtacctggcaattttcgttcttcatgactgcttacaacttctagcagggcccctacgtatcctcttcaaaacagggcgaggggtaccaggctgagtttgtgaggagtcgccttcagcatcatctgatagcagattgttagttcacgaaaaggagatcagcagaaaatatgcactttcattgattgtgttttcgtctacacaccatgcttatcttcgctgttgtttttgtccatcgaccgggtcccattggatgatttccttttcttgttgacaaccgttgagattagtttgacgtcctgaaggcataacaagaataatttatttccttccgttagtttaccctccaacaaattgtacaagatttggatttctagttaccttcacatcttcatcttgagtaaatttttgagactggctgtcatcggacctagtttctcttgcatttaccttagccacctcttcctgctgggtaatcctatcacgcttatcatgttcagatcgtttctcacctatcacaatgacaccacgtgccattggtgctctgcaacctcacatttccca

SEQ ID NO: 20605 - DNA, 12090 bp, Oryza sativa
cccaaatataactgcaacctgaatattcaactggtgaactggtgagccaacaagatgaacttggctagtattctttctatacagaaatctctcatcaagttcaccccagaagggtgcaattgatcttgcaaactaagaaatgaactttaacatatagctgatataacattggtatgccacaaaaaatacccttacaatagaaaatgcaaacccaaatgttaaaagagaatggttggttgatacaaaccattcatctggcagagactttgtatcgaagcctgcattcaatattctccatttacgacagctgtagcactgaacccactcatgatcagccttatagctccccctcccttttctctggataaagaaagttaaatggagtgaatagtgcttaaaaagagaagagaatggaatattctgaaagtcaaaccagtaggatgtactagtagcctggtggtgggagggaatgagtcatgaccaagatcgacagtgtgccaatgcaattgtgtgcattcaacaggaaagcacatctcctgatctacaaaattattaacacatgtacacatgcaatttatatgtagcttaagtggggtgcttgtgaggcgtgtcttctctgtgctctgtaccgaaaaggaaggcaaaatgaggacttaactaatgtatacaacaatctaaaactggatttgagagcatgctataacgagaacgattatagtacatataacataatctatgcactttttacataaacttaacccattatccatttatcaacctacaatagtgaaagaaatattgagacagcatttttaattaaaggttcatgtactatagctatcccctgattataataaattctgtctcagtaattttcaaaataaatctgctcatgtccttttttacacagcccatctaaatatccattaatcctaaatattctgagtgcagccatgttaggacaactttttctcctttttttcttgactgagggttgttaacttgttactccatatatgcatgatcaaaagctgtgtcagctgtcagcatatgctgtcagctactctataccttgttattgtcatttgggagatctagtgaccattgaattcaaagaaaaattaaagaggacttcatggccagagatgcaagtgttatctaaaatattttcaaatatgaactaaatcatgcattcataccaattcgagagtgtcaaaatttgtatcccagtattcatccgctttcctaccaagccactcctccagtttagcatacatttcacaatcttggaacccttgtttactgttaagaacccatgaattaccatcttcatcatcctgcagaaaagaggaacataaaagtttgttcaagggacaccacaaggaaaagtaacaggaactgaattacatggcagataagtatatttggaaatatacaataaggtctgtgatatctgcaactccaattactccacgtcccatgtcagcattatgcttttgacctccaactcgttttaagactgagaagagaacacaaaatagaagttcagaataagggtgcacatgtcacgagggaaggttatcgttcatactaatttatttattgtgcaacatgaaagccaaaaagtgcaaatagtttccacaactaaacattaaacaaaatatgtgattaagacctgtttgcaactacagctaaataaaattcaataagaagaggcacaatctcattataattcctgcagatagttgttgcatagcattcaacagacctcaaatttcccatgatcaacaaagatggggctaaattttgccctccaactctacactagagagagagggagagggagactttatgcagcctgtttgtgtaaatgtattacggtttgtgttctactgttctatatcaaatgttgatcttgaacagttgcatttgcatgtgtgcttcaacacggagaaattattctagtgcaaaaatggttttggagaattttgtaggggaacatgctgaacggaagaggacaaaaatgctgactttacctctattagacggccatgccaatacaagaaaattccacagttcattctgtcccattctacattgctccttccaagggtcaattgaatagtcctacccattatttcaccagatataacagatgtcttgttaagggtctttgctaaagggcgagttttgacctaccaagaaaataaacagtaaaagaaaagaatatgaatgtgccaaaacatagagagaaatgacatatgggtatttaccgaagacccttggacagagatcttcatccgaggattcaggaacataacttccaaataggactgaagagaatagtccaatggtacctaaaaaataccatgaaacaattagtgaagccagaccatgttttcagcatttccatggaacaaagtttactggaaaaataagccattaacactgatgtcttgattaaaaatcatgcacacacacacacacagtacattcagaataagagtacagattgtgaagcctatgcggctacatctcatcaaggttaatcaaccttcaagggcaatatacagaccataaataatttacatttcccaatgccacagcaacccatcagaaggatataataaatttcaggtttatatgtaattgaaactgataattggctcccatctacaagataaaaattaaaaataaaagagtaaacttcacaaaactacaggtactttgatcaatatatcagaaaactacagatttaacatcagttttatcacaaaactacaacttttgtaaccacaatagtgctatggatataaactctaaaaatctgtagttctttgataacctcattactaaatctgtagttttgtgatacgatgctttaaatctgtagttctggtacaaatttcgcgctaaatctgaagttttgtaatacaaattttcaaaaatttgtagttttgcgatagtttggtcaaagtatctgtagttttgtgaaatttgtcaaggaaagattgtaatccatacattgttacttgtttgtcctgggcgcaatctgactcttcttgaacggattagtatgtctccacgaccatggtggacaggatcttcagatggcttccctgaactccagtccaaggtgtaatctgcaccccatctatctaaattccatatataaatctgtgttccagtaccgtcttcaccaaatatccctagcttttctccaatgaaatactcattggagggagaaaattccttaatagcattcaagttatattcagcagtagcttcagattggacacttgaatcaacttccatgtattgcccttctttacgatatgtcaccacaggtatctcaagattctgcagcaaatagcactgtgttagctacgttttacaactgagctacctagctttagagttcccagtagactaagaatgaagtacatagagccgtgcttacatctttattttcattaaaagactgagataggaaggccactgatctggaagatgaagtttgggttagcacaattgcatctctgccaagtttcatagcaccagtctacaaaataagcaccaagaaaacagtaaactcaacaagaataagaacaatttttcacataaacaaacatctgcaagtataaatttaggtcgaacaagaatgcaatacggtaactgttttgaacactagcacatgaagtgtatggatttgcctcttaaaatcaataaaagggctaaaggagcatgaacagagggtgtgtttactgaatagatattcctaacttctaattgacataactaacatttattcaagttcattggttgagcagttaaatactgtacagtccaagacttttaagtcatgctagcttacagacagaaaaaagaaatgaaaggacgtcagctttgagatgctgttcactgcatagcaaaatgttacactctgcctccaaaatccgtgttagcgcagttcttatgtggagcaggcctatgtttgcatagcactccgcttacactttcatcccggctcgtacaatggttggagaaccaaggctataagccgctgaccctcacccacctaaacttccaagatggtactaaaccacctcctacaaccacaattgggccatgggcctcaactacaccacactacaggtggcaaacgggctacagtgttacacaaaacctacctaactagcacccatggtgaataatatgctgcagaaagcatgttcagaagtgtattggataatacagaaacaagttctaatttactcacaggtaatgcatcatataagccgataaccaaagttttgtatatggaatgcagacaacagagttcccggtacattttaaacaagtcagacatgccacatcaatacagcataaaatcggcttgagatgtgaaataaattattttttaaattattaaatatcagaaatgttaagaaactgataaccggagaggaggatgacgccaacaggttaccttaaatccaattccaaacctcccaatttgatcctggcgttgcttatccggtcttttgtgaccgaatgagatcattctcatcatttcagcacaagtcattccatgcccatcatcaattacagacaagacagggatttttttgtctgctttcttcgaaaacaatgatttgactgaaatattcaaccttcaagaaaggtaggagaacaaataagaagtcagctcaatcaaaataacacaaatgcacccccccccaaaaaaaaagggggggtaatcttcaaaatacgctaacaacacagtcaaattagcaaaagcctcaaatagtctttaaattatgtatacaacactaccctcagagaggaaatgcttcctacacaactacacatattactgagattacattctgtaaatactacaacaaaagcagtaaatatgtaaagtttgtatactaatagaatgggcatgtgcatattcatctggaagagatgtaaaacaagacaataaagaaaacttagtttggcatagtggaagattgtagtctagagctttagttcactgttttgccacaatagaaatattttgtaactataatcagtaaagaaacccttaactaattagatcgcatgttgcagcacagcacaataccggaaatgccaaatcagccctaaaaattatctcaagaaaaaacagcacccaatctctggctacacaaccttgaagaaatgggcataccttgatgcatctgcatctctagagttgtcaatgagctctgctattgctccaaagacccagccagcatgtgtctgactgagtgttcgcagataactaggatccgtgctgacaaaattttttgcaagagtggtggttctctttttcactattggatctaaaattctagggccatcttcaacagactcacatggtgatgattctggaactgatttgtgcagctctgtgacacgcgaggcattcatctccttaggatttgggccactatcacaaatctcctctctcaaatatgactttggattcatcgagccagattggaaatcacttctgtatgacctttttaaagcatctgtcatagcaatattcatgtgtcattctggtggcataatagacaagtgaataaagttaaataccacaaagaaacgaatcagcaaatagctcatagctgactacacgcatattatggtgtatatctttgatgttaactatagagagagcttcctccaacaccatggacaagtgagaatacaaatgaagtaataaaaaaaaagaagggactccaattgcaactcttggggattaatagaccaatattgatgaaacaaagattactggaatgtattgccaattgttaaatttcaagtttttttttatataaaattagcatagggtcagccaaaataaaaggagaagtaaaccatccaagcatagcattcctgttcaacaatcagcataggaaaactctcaccagatactccagccatcggtttgcagtctccaggatctttttgctcatacatgaccaccgcatgtgagaagttagggcgttcatgagattcatgagattgaggagggaaaatatgtaaggcaaaggagctgaatctaactacagcaaccttcaaaaaagcaccgaaaaagaacaaggaccccacattacaggcaagaaaagaacagagaacattgctaatgatgttaataataaaatacaaaatggcaagtagagaacagaacaatgctaatagtgctaataataaaatacaacatgcctactgacttgcaggggaacaaaaccctgacaaaagttgattaattggaagataaaaggtactacagtgcatggcctcccccctatcagcctatatgtccctgttatttgtcccatgtccgacacctaccccacctagtgcgggttctcagtaagaagtacgatagtatccaaatggtcaatcctttgccccattttacttgaacaaataagtaacaaaaaaagataaaatatcttgtatatatttttttagagcacctatcttgtatatttttattagcaattatgacatgcaatagaaacaataattaccctctgattgtcccagaggaaacgcatgaactttccccattcaatattctgacgatcatcttcaggttcaggaagcagtgaaaatttcaggaaatcacactgctggtacaccttagttggcacaaacctaacaattgaccaaaccgagggcctgtaaatgtgaaaagcacagacataagatacctccatgaaattaagaaacaaatcaccccaccccccacaacaacacacccaaaaaaaagtcatggtttttttaccgacatgttgattaaatgtttgtagatttgagtaaattaacagtatagctgcagcaattcactttagtagtatatatttttacaaaagctctaccactattttgatgatagcatatgagattgggtagttgtagcatggcatttaacagggggtatgtatggttgaaatcattgctggtgactatttattttgactgagagcaatggagggctcagggtctctgacaagtactgtgaaacagcgggagcagtcagatgatgctagtatgaaaacatgaacacaccagcattgaactttataacagaagaggaaaacccactaatacacactgtagattgtagatttaaccaatcgatgacagtatgcgatagagaacatcaacaatatttatctgacaatagttttggccaatggatgatgatgtaaaacttgtaaagtattcacagatcaggaaaagaaaaagagatcaacttacactttaactggaatatcacagactttggtgcggcatatgttcttagaatctttttgtaataatacatagttcaagccaccacctaccacaaaaaaatatatccttcaggcaaaaattcacacagtatgtattctaccaaaaaggataattctaacaacaatataaaagaagcaagcatcattcataattgatgtgaataaatgttaacatattggcattactaccatttttaagttataaaaaaaggctggacaggtttgccacttcatcacatgttaaagtgaggtactaggaccctatccacatctatcaacactgttgatcagttaaaagtacaaaactagagctgttaatataaacttaggagtataggtgatagagtttccacagattttgcaatatgtgaagtttcaggggtacaagtggacttggtgcagtttcctcttaattttgcagtggaacctggtctacagaaaggatatggccaattggccatcctttatggcaacgcatctcatataatcataccttgattttcatgtggcggctcattcaaatcaagtgtttcatccgccatctccttctcttcaccccctatgaacagcaacaaccatcaaatgataactatattttctaaaagcaaaagatcatcatgcatgtaaactgaaactgaaaccaagcatgagtattaactaagcaggtcaattgtcattctggagtaacatatgaccattaaacaagccagtagatccagaaatgtggtatagtagactcacagtatcgtacatcattaattgttcaaactagaggaagcaaacttatcaaatcccaagttacatgactattcatctataagttattaaataatgccaaaagaaaaaaaaatcagctgggcaaacaggccaatccgaccaaaactcatcacaaaggtcaaacacgacaagaatttgctggtgaataatatatcccagaatgctaaatacatgccagataacatgcttaaaactatccagatgaatcgaactaagcaatgctacaaattataaaaacatcagattcagccctacataactacataagtcaggtacaagcaagcagcaacgaggctcaactctccagtatattaaaatgttaaatgcagctccaaggcttcaatgaaggccatgactcatcaaatgccctccttacagcctcgcataactcaacatattaatgtgattccactatagaagaaagaaagcaacaaaaagtacttgagatcacggtccaaagtggtgatttatgtcacttaacacctccaatcataaatatttggcatttaggacaagatttgattaaacttttaaaacattcaccattagaataagcttatgatgctatgatagaacttttcaaggcaaatctacacaaaactaagcatttgagaagttactcatggtcaaagtttcaaaagtttaaccaaatcttgtccgaaacattaagcatttattgcaggagtgaatactttggttacacaccgagctcggtaaaagacaccaccttcaacccccacaaaaatcccaaaagactccgtcttctataaagaccatgagcacccaaaaaaaaaatctcagaaaacaagttcttaatgcgcatcaaaggcatcaataggattgcaaagtaaattaccaaaaaaaacagagagagaaataaaactgaaagcggagagagaatggaccacctccacacatttctaaccaagagaaaattttgggcacccgaatctcccgatcacgcaccaaccactacgcgagcaaccgcaaagcacgtcacgaacaccaccactacccacttcacctcaaaacccaaacgtcaaaggccacgcacagtaacttttacccccaaaaaaaagaacaggagaaaaaaatcagagcggtgaggggtttgaactagacacatttttctaaagggagaaaatgaaaaaaaaaatcgagcctccgatcgcgtaccaaaccactgcacgcaagcgagtcgtgaaaccaccaccaaaaaccccacttggcctcaaaaccccaaacccccccaagccccggttctcgcaaaaaacaaccacccacgagcactccggcgccggccgcggagcgcatgcacacacgcacacacgaaccaccggaatccacggcggtggtagcgaaccaacccccccaccaccaaaaaaaaaaacgaagcgcgagtgatagcggaaggaagctagggcttggcggtggcggcgggcattaccgggagggatcggaggcgaggcggaaacggaggcggcggccacggcggcgagcgcgcagcgggtgaggaggcgccgccgtgggattttgggcccggcgaaccggggcgtgttttgtgctggcgatacgaaggagcattgaaggcggacgccgcttccgctcgcctactagccttagggcttattcggatcggagggtaaactcaggaaaaacataggatctgcattcctatggattcgggtactgtagcagcattcggatcaaaggaatcccctgtaggaaaatcagaggaaattcgaaggaaaatttccttggccatccattccacaggaaaacaaacaatccactccaacctctttttatttttcctgtgcatgggaacgaggcaatcaacaaactaatcttcacaagcttcactcctctgacacatgatgattttagttagtgggtaggttctttaaaaattcctatgtttttcctacgctctatccgaacgcatgtttatatagtattcctatgtttttcaattctctgttttacacgtgcattcctatcatattcctatgattttcctattcctgtgttttttcaatcctccattccgaataagccctaagcctatatagcctcgccacgtgggattgttctttttgtttctttttcttttttttttaccgttgcagtaattgtgaccgtccgccaacctcacacatcaaaacaagtcttttctttttcaccgttacagtaatttttgaccgtccgccaacgtcacacatcaaaacaagtcttttctttttcaccgttgcagtaattttgaccgtccgccaacgtcacacgtcaaaacaagtcacaaggttatctcttctaccataacggcagtagtattagagcaagtttaatagtacagccaacaacggacttcaaattatttatagctaatctaatagcttattcatataatagttaactataaaaatatactccctccgtcttataatataagggactttgagtttttgtttgcactgtttgaccacttgtcttattcaaaaaaaatttagaattattattttttttgacttactttgttatccaaagtactttaagcgtagcttttcgttttttatatttgcacaattttttttaataagacaagtggtcaaacaatgcaaataaaaactcaaaatctcttatattatagaacggagagagtactacactattaatatttggtcacacctctcatacacatataatgtcttggagtccatgttgacatataatgtcttggagtccatgttgcagctggctacaaatctgtagcccgcttttttctctctcttctggatatgtggttatagctcaatatgtggttatagcttgtttatattctgctattgtacctgctcttaaagattgacacgagggaacccacattggaagatatacggtccccacatattaatggctataatggtagtgtcgttatgatagagaataattaatcatccagtcatgaaacaatttatattagagtaaatttcataaaactacagatactttgcacgatctatcacaaaactatatatttaaaaaattgtttcacaaaactacagatttagtgtcttcatttagcacaaaactacaggtactttgcacagtatatcacaaaactatatatttaagaatttgtttcacaaatctatagatttaatatcttcatttatcacgaaactacaggtttagtgtctccattatcacaaagctatatgttttacactaaatctatagttttgtaaaacaagttcttaaatatatagttttgtaataaattatacaaagtatatgtagttttgtaatagattgtacactaaatctatagttttatgaaacaagttcttaaatatataatttgtgataaattatgcaaaatacctgtagttttgtgaaatttactctttatattaaaataataaatacatttttaatttatttaaaatttaattgggttattgggtttgccatctacacttttattatctcaccgcgtgaaatcaccgtgcataccttgtgtattgtctaactaaccgccatgagtgcctcacaaccaccaaaattaagtgtgttgtgtgcatgggcatgatcaggtgaaatttaggtgcttgtttccgtagtttggttttaattgaaattacgttgttttgcaggagaagatgggtaaacttcggtatcattatcttcctctaataatcacattagttgacaattatgactaaccaagcacacttaatgctctaatgttttgtggcaaggtttagaaataatacaacattataaataatacacttttaatggaaaattgtcaaaaaaaaagatgttgattgttcaaatcacaaatttagcaccctatataataaccgtagtttgataaggtacctgtgttcgacaggtacgcctgtcgaataacaacagttcgataaattagttggcttgattaaaaaaggaaaagagcaaccatggatcccaa

SEQ ID NO: 20606 - DNA, 8852 bp, Oryza sativa
ccctattgaaacacctcttcatatatattttgtaatcattaaaaaaatcaagaacaaatcatcaacatataaaatttaaataagtttatatattcaattcttaatatcttaatgaaaaatttcaaattgacaaataataactctataaaaaataaaataatccatataagcacatgatggcctagactcacgagccaaacaaagcagctcacgagtcagctcgggctcggctcattttagcaacgagctgaaaaagaggcttaggtttggctcatttgacttacgagctgagctaagccaaccaagcccgagctgatgagttcatgcgcccgagctttttttccacctctacccacagcccactcacattcactcatcactgtccagattcatagtattataatgcgtcacatccggtattagattcgttttttttaaacggtggagtatagaccaaacggcatatcttagccttagtaaaatactataaatttaaagttatgtatccatgacttcactactatatcaccagatattatttgtggcttcttctactatatttgttgggcatttatttatgagaagttcaacatattattatagtcccaaaaataatggttaaaaattgtagtgcgagaattaaggccgtgttcttttcaactgtaacatcgaattgttaaaatggattatttactccacacttcgatatgtacattttaaaaaaatctacctcatttcttaaattacttgttataaactatctataaagtttatttcttacaatatttcatttatacctataatatattaataattcatagtataataatctaaatcacgacctaataagatcatactagtagtatgtagagctatcattctaactaccatagcagtcattgaatcgctataattagcgttatggaaactttcgtcgtagagtccgagcctcagttcattggaaaagagtccatgagtcatcatggcctcgtatggtatggaggacaaaatataggctatatagccacaagcacatggaaaggggttaggaatagtatctaatactgtcacaactcaccttagattaggtacaataaactattaaccaactataaatatattttaaagagataaaagataagagaggagagcagtgggctactacagcacgaacttcaaaacataatgtatatataacaagtgagatcatatattaatattaatagtatagtaaacaactattatatgaattgactattatattggttataaatgaattgaaactagtagggggttatactactccctccatcccatattagttgttgttccaggtaatttagcatcgattaaggtttgagaaaaaaagactatagtatctctaattaaatattgtatggttggatataggagggtggttaggggtagaaaagagataaatttgaattagagtgattgatgggacaaatactatttcattgtgataactattttaggataaagtttaaatgctgaagagacaagtaatttgggacagaggggtattaaacttgctcttatactccagtaaggctgccacagttttttgttggtcacaattaagataaagttagctaagcgtttaataagtctaacatgtgagctaagatgctaagaaaatactatggcaatagtaactgagacaataaatccaatatataactaatgaggaataagtaaggtatagcgtaatgtacgtgataagttgggattttcaacgaacctgctctcgctatgcacgatccgtgctaacccagacagagatggaatagccgagtagtagccagacaattcaacatcctctcacgcgttcctggaacgctagttgtttatatatatcgagcatagaaatatgtataatcactttctagtgatactaatactactagtatcataccctatattttattgtgaatcacacgaataaatgtatgttaactatataaaaattatataaagaatatgaagatgatgatttgatatacttgtataggttgaactctataatgaaatgttaatgatgtgtgttatgtttgcacgatatttaagggcatgttcggctgcccgttaacgcggctgggctgtagcagcttaaacaatgctactattgatgattcagttgttgcagacgtgagatgcaacgctgcggctgcacagcaatggctgccaaacacagtcttgggtgataatcaatctttgtgataatcaattaagatgttttaaaatagtaatactattgggtgatgatgtacatctttgtgataatcaatctggaaatataggaagaaccgaaggattggtgcagattccgagaaggcacattagatacagaaaatatcaaaagaatccacaatgcatacgtgatgacctttggctattgtctgcatatttgtagctaagagctcgtttgcgtcaagccaatgtgaaacttaaagtagggccaaagcgaaaaaggatattactataaaaattagagaaggttatatatattgaccctgttttgaaaaagagaatagaaatatcatagtaagtctcaaataaatttcacactaaaaaaagaggagttctttgattccccccctccccccaacaccttgatggcacgagagggcgaggagatcatcgcccagaaacatagtacgtggtcctcccgccaagggagctacaaactaggcttcgcgtgcaaactcacaataatttcattagaaactatgttttttaaattgacgtgagaaactatgctaggaaaatgtctaattttcctatctcaaccgtaaatctaggcataatacctccctcaaatatcaaatcatatcagtttaccttggttttgaaggtggcttcatctgacatggtgtctacatgactacgtggcatcacaattggaaaaaaaagaatttaaccagtaagaaccgaactctaattctttctcccctacctcctctctctagcatcgctcaatgactgtcccaaagctcgctgacctccccactactccctccctcggcaccagccttcactgttgtcggtgatatgggcccgggggtatcaggtttagagggaggaggctgccccccgatgccacgtggccctcccccgaggggagtcaggcccgaggtggggtggcggccactccttccccaaagactagtcggaggaggctgccccccgatgccacgtggccctcccccgaagggagtcaggcccgaggtagggccgcggccactccttcccagagactggatggagaagactaccctccaatgccacgtgtcgggcccgaggtagggcagcggccactccctggccgagactaaagggagaaggccgccccaggcgccacgtggctccccccccgaggggggatcgggcccgaggtcgggtggcggccgccccctcccgtgactaggggtcgggctttcccgaccccctctctaggtcaccacatatggtgggttaggtgtccgcctccaggtgcccacttacccacatttatggcgtcctgagcggtcgcgccacgccgcatttaatgcggtgtgcagtgcactcaaccggtctgtgaccggtcgaatgactgatgggacccaagatgtcaggcgcaccatcgcgtgtgtcaggcgatgtgcagcccgacatatcccatcaaataatgatggtgagaggttctcatcctcttatcccagccggagtcggtcctcccgctctggtcaaagcaaggctcccgtttcccggtgtaataagagcccagaagtcttcacccattaaatggtgactgacaggggcaccccccgtgtcaggcgacaagatttgacaggccccatcatcaagacgacgtgtgcttggcttcccaagtcaagagacaagacatgcatttaatgcaaagattataatacttctccaccggagctaggttaggttgttgggcccatgtggtaacccctttaggtataaaaggaggttcaggcctagtggtggaggggggacttccgagcgaactggcgcttgggtctcgcaagcccaagcaccggtgttctacattcaatcaatcatgcacaggagtaaggtattacgcttcatagtggcccgaacctgtataaacctcttttgtctcatcgtcttggaggggcctaaccccctcaagatcacacagctccgctcactaagccctcgaatctcacccgctgcccccagccgaactcacaaaggggggcctcatggttccctggtggaggagttcattctccgacaactgtcatcatccctcaacctaaagcatactaccttcctcaccggcgtagctcgacctctcccttcctctccttttccgacctagacatcgagcttggttaagggagagctatgtgacaaaggaggtgtcatcggctcgagctcacccaaggccaagatctccactgaaagccatgactgcaactcccattcgccacaatgccatgcttgactacgggtggtggagtcctctatgtcccttcattccccattaattcctgtgatccctcctcctatacagcacaaccactgccgagttcaagcccctcgcgcgagtggctacggcaagctcccccttcctcaatgctcagggaggcgatgcattgaggttgtcttgatggagaggtattagtcagggatgagatcgatgcgtgccgtttctcaccatggagatggtatctcttccctctctcgccactgccatcaccgaatagcagctcaagcttttgaactcaccacttgccacttcctcgcttttgtatataccgagttgacgaggtctcaatgaggaatagatgaagaggttaggttaatggttggtgaaactccgacaaggatgcagtggtggtgaagtgttgacggaaaaatcaaacacactggcctgggagatctgcttagctccagttcaggtccaaagattgatgagatgtgggcgtgccagttagtttgatcctgcaactgacaagatatgcaaatagcagataaaatagccgatcggctaaacaaccgatgtagtgattccagccgaaaaccgataatagccgatgccgataccagccaatagcgatagggtttaagcaatcggctatatgtccaatgtagataatgctataaaggcaattggctgatgatgatgtaataaaataataatataatccaatataaaccaatcggcaaataatgatatgataaataagcatcgatccgaatattaaagcacacatcggctggaggtccgatgtcatgaaatccacaagattagattaaacagtgaaacctttgttgtcatcggctaaatccaacttatatgtatatgcaatccttacgagccgatgcaacgtccagataactcaccagctgaaaccccgatgaaacccttattggcaatcaataagcaggctagagattatggttctaagcacgacttagtagatcaaacttaactgatgcaacactaagtatgaaaagaaacacaatatctagacaataaagccgttgactgattttcagggtgatagatgcctaggctaatctaatctagcaatgcgatttagccgatactggcagaaaccctaaagcgagagacagccgatagagctaaattgatatgctaagactagattaacagagacatgataaataggtaggcaaatatatcatccaaaccagagcaatccaagaggtcgaatgtactgatgtagccttgaacgacgccgacgtaaacgatacaattgcctgggccgacggaacattggacttaccccttcgccggagatcgaacaccgatgcagccccgcgtcaggtgccaagtcccgccggacgataaaataaagtaaaaaggtaaaaggtggcgatgcaccgaattgtattgatcgtgaggatagattacatagaccccgggtgtacatatttatacccatgggttgatacaagtccttgtcagacaagaaagaaactttcctaaagataaaagaaaaacatagagtccttatcggacactaaacacactttcctaaagataaaaggaaactaacaaactattcctaattaataggtaacttgccatgccgcattctctttgagctcggtctcttctcgatagcttcctttagtagatcaatttccttaaccgaatatagcaagaatctaacaactgacgacttgataactctcatcggctaatcttagtacttcgaagccgacactgactttaagccgatgatgactttgggcttaccaaatttcactgttaatatgaagataactcaattgtgggttgaaggtgaggacgagagagtggaggatagcctagagatggaggaggatggtcggacagtgttgtgagttacaccaaggcagatgatgccacgagcaccttcccctcggcaccgtgagcctcccgcctcccgcctccctctctaggcgcctattcccagccatcatcgcctaccttctccaccttctagtcccggtctccttgctctccttcgctaacaatggaggtgctaggcttgagtggaagagagaagagaggtggctagtgacatatatataggttccacctttgttttattattttctccttgactgtactgcacgtatacaccacctcgaatgaaaccaccgttaaatatctcggagaggcaaaattaacctttttttgatattttagggagaattcatatattgttttgttgagagagagagagagatatcggacttgggacaaaatatatttcttccaatgttggtgtgattgggaataagttggggcctattaaataagtaagcgcttaatgtcctgatgggctattctcaaccggcccaatcccatcatggctgatctttttaggaaaaagtccactatgactcccttaaaagtaagccgaatctaattcgtacccctcaaccacagaaccggatagaacgactccctaaactattgaaaccagtgcaatttgactccctcagcggttttggagggtggttttgctaatgtgacgctgatatggcgatgttgagctggtcagcgtcttacgtggcacttacatggcattagaattaaaaatatatatgtgggacctatttatcatttacaatatatatatatatatattgtgggacccacagacatttggggccacgtatcatcctctctctctctaacccttctacctcctccctctctcttccttatctctctcttttcttatccccttcggctgcggcggtgacgggcgggatgatgggtgctggagctgtggcggcggcgagcgggcgagggctggagcggtggcaacggcgggcaggttgcaaattcaaccgtgcggcatcttggatgacgatgatgatgctggcaagtagcaacaatctcacagtgaacaacgcaagctgattaatgcagttctccactccaatgatccaatccaaacaaactgtcaatttcacacatagaacacatgcacgtgcacctcgatcgatcgagcagctagctggccgccgccggccgccacgcagagatggcgcaaagcggcctcttgtgccagcagaagaaaaaggcatggccgtacgaccccaccggctccatgccgtccgctttcatccgcgccgcccactgccgcgcccgctcgtgccgctccaccagctccaccccctcgcacgccaccacaccacgaatctcctccccgagcatcacgcactcctctcttggtgcttgtgctcccctcgtttgcaggatgacccaggtgcggcgccggctccggcggattacccgctcccccgccctcgagtgcggccaaccccgagttcccgacatggtccatggctcgcgcaggcggtaatctatgatgagagtggacgccggcggccgacggcgtgcgatatggaggttgcacgcgggaagaggcgaaatgagatgcagggattagggattttggggagccaaggaagaggaggggaatcggccgacgccccgctctggccctcgccagctcgccgccgccgccactccagtacacgtcgctgccatagccaaggggataagaaaagagagataaggaaggagagggaggaggaagaagggttggagagaaagagaggatgatatggctgtgggtcccacaagtatttttcctatgtgaacgacaaatgggtcccacatatatatttttaattctaatgtcacgtaagcgccatgtaggacgaagaccaggtcaacatcaccacatcagcgccacgtcagcaaaaccattctccaaaaccgctgagggagtcaaattgcactggtttcaataggtgggggagtcgttttatccggttttctggttgaggggtatgaatcagattcggtctatttttaagggagtcaaagtggactttttccatctttttaagttgctttttccaagcgaaggctagggccgtgtttagttccccctattcccaacttttcatcacatcatatcacatctaaaatttttctacacacataaacttccgactttttttcaaactcccaactttcttcaaactttcaacttttttttcaggaattaaacacaccctaggaggggaacccctatggtctagaattttttttggtttatttcttcaagctccagtaccactatcttcttcacaattgtttcaagtgtgaagaattaattaaagcctgtttcctgtaagtgcaggtacaatagctggctataagccagctgcaaacaaattttaaggagataaatgaggagagagaatagcagcgggctataaattgatgcagtgtacggactccaagacacagtgtgtgt

SEQ ID NO: 20607 - DNA, 1851 bp, Oryza sativa
  unsure (1)..(1851): unsure at all n locations
atagccaatctaatagtcaattcatataatagttgtttaatatactattaatatatggtcccatctatcatacacaccgcgtcttatagtccgtgctgtagttggctacatatttgtagcccgctgctcttctctcttatcttttatctcactaaaatatgtttatagctggctaatagtctactattatacctgctctaagcgaagttacacgtaagcacatttcagttggtcctctgcatgcattcacaaataggagtatataatatatcgaatcttcagtcgagcttatgaattccggtcctttggtgcattctcggcagagcattgcaaacgagattgtgattaagaaactatgcattccggtcctttggtgcattctcggcagagcattgcaaacgagtaagaaaatatgctgacataaaatatgctgacataaaaatcttatagagagcctataaatctctacaagagatccatgtcaacatattttcttacttggaagatattaaatgaagagagagagcaaaactatctactaacctggagatagtctatagagaaaaacgaggcaatgcattagagagctatagataccgatgtagacatactattgaggtgatttactattaatctagtctattgctgagatgtacatgttttatagagagcaacttactttaccattgcgggtgctcttaggcagtaccagtttttattaacggatgcagatggaacggtccagatcagccaggcgcactgttcatcgtactgtagcagaaaacactgtagcacagaatactgttggtgtggtcactgtatcgctagatgactagatctgagccgttgatcacagaaatggatggctgaaattgcatgcagttcttaagttgcagtcatagctataactgcacctgatctgaatcggagttagcattggtcgctggactggacgaccaagggggttcggaatttgtttctctatccgaaccccgcgggtcagaaatttctttccctatttctcctagttattgcagcctgtattgtcaccttcttcgacgacgtttctatgtcccaggtcttttattgagggtttccttttctatttactattataaaaattaaagatgttttttccggtattttagtatgtcatatgtgtttgagtcagtttttaagtttgttcacctttggaaatacatattcgtgtttgagttggattttcagctcgtttacttttagaaatataaaaggagtcgtataataaatctcttttaaaaaactcatactaacttgagatgaaacacataatcctaattgcagctcatcattttctaaaagaaatattcaagcaaattcccacagttaattttaccaaacctaaaccatataacaataataaaattaaaatagaatttacccgttgcaatgcacgggcttttttttctagttcagaaaaaaggtaaaattgcataaaccactccaattaaataaaaaacatgaatattatgaaatggtctgatattaaataattagaaggggtgaggacctagacgggctagcccacctctgttttttcctgtcttctgcggtgctacattatcgccattgttgcaagcatcaacaattccaaactgtttacatttcatttgagactctgggattcagtgattttgcaaacctggacgagtgagggggtcggacttttattctccgaccgattttccttttcttttttttgttgtttttcctatcgagggtatggtttagagatttatcgctttcannnnnnnnnnnnnnnnnnnnnnnnnnnnnnnnnnnnnnnnnnnnnnnnnnnnnnnnnnnnnnnnn

SEQ ID NO: 20608 - DNA, 688 bp, Oryza sativa
  unsure (1)..(688): unsure at all n locations
nnnnnnnnnnnnnnnnnnnnnnnnnnnnnnnnnnnnnnnnnnnnnnnnnnnnnnnnnnnnnnnnnnnnnnnnnnttgatgagtgagttttactaatgtgaacccattgcacatgaacatataagcaaacatgcagatatatcctgattgcagtgtctataacaacatatcaaccacattttttgcgaggcttatataatttgaggcttatataatttgaggcttatataatttgatgagtcatccatgtcgaaatggtaatcaccttcatcaaaattttctgttgcctgtggtttccctttcctaacttgcacggaacgtagagctgttgaacacaattttgatggtgtggacgagtttactcgcaatttacctgacgagtgatctgttccattccctccaaattgaaagatatttgagtttgagtttattgttgtatctctagaaagtcttgcacttcttcgaggaactgaatcactactctgattaaacagccttccagaaacctgagaaaataatcttttaactgagaaaaataatcttttaagtctggtatcatcacaagtcaaatctaaagtggggtatgaacatggtgtgaggactatcaccagaaagaacataaaagagactatacagcccgacctccaagcaacagaacaatagaaacatagggtcaatattagacgaga

SEQ ID NO: 20609 - DNA, 532 bp, Oryza sativa
gggaatcggtaagtatctagtcttaaaattgatagacaagatgaacttgattatgagtaatggagctaaaatgtgcaatgctccttttggcagcctgattcagagacacagctattgactattcagtttgagtggcacggtgttctgaaatcggtatccagcactctgattggtgtcagccctgagtttgaggttgcactctacacgctctgcttctttatgggaggggaagataaccgcgttgagattggcccgtacggagtaaacatcaagtgctaccgaatgggaaacagcaaaattgggtcagcatttccaattgcagataactgaattcgttccatgcctgctcctgcgtgtatgtgattccttcagctttcagtttcacgaagttattagtgtgctgttcgatttggtcgtttacacaaaagaaccacattgttcaatttgttgtcacaatgtctctactgaaaattgtattatttggattaaccatgctgtacaagttgtagtcacaaagtcctgtaatttgttt

SEQ ID NO: 20610 - DNA, 729 bp, Oryza sativa
  unsure (1)..(729): unsure at all n locations
nnnnnnnnnnnnnnnnnnnnnnnnnnnnnnnnnnnataatagtctatatttaatatttataatcaatatccaaacattcaatgtgatagggacttaaaagttttagtacaatctaaacaggtcatataattgggtccatagccatgcatggtaaagtacggactttgcgacagttgagctcccatggtcgctcattttccctaataaaccaaaactacgtgttctttgcgacttaaaaccaaatgttgaagaagaaattacgttgaaaatagcttaaaatcttcttcaaaattgagtttaaaaatttaaattttagcgttggcttattatggcaaccaatagagctctttgatgtttatgttctctcttcaggcgatttagcagcagagaatgggaggttgcaagctgaaccaaattcttgcttctgccgttctgacttcagcggcacatatgtacgagtgaatagcactagtatcagcgagaagaattccaaaaaaaaaagaaaaaaagtggaggtagactatgtgtttatgtgtttagttccaaagttttttttccaaacttccaactttccatcacatcaaacctttcatacacacataacttttcagtcataattttttaatttcaactaaattttaaactttggccggactaaacacagcctagctagaggaacacgcttgcacagaaagtgccggtgctattgacatcacagtccagtttttt

SEQ ID NO: 20611 - DNA, 645 bp, Oryza sativa
tttaccatgttttcttagctaaacttaccaaaggtgaggccatcaaaatccaagccacactctagccaacaaaatgaaaccatgccacactttttagagtcacttacatgtgggacctagattacaaaagaggaatcttgccacatttgtgggagtcaaccaaacactaacctaacatgatcaaacttgcctaaccttaagtgtgacaaagtgtagcaacttatggctatcattcctataggaatttttcctataaagccttttgaatcaaaggaatgagctctatggaatcttatgaaattcctatggaatgcctcttcccatacaagttttggaggaattttaacaagaggtagaacctcatggaagaaatcctttgagtctttatctctcctcaaattcctgtattttttctgtggtccaattaaacggtcattcctatgtttttcctatgttttgcaatcctcttttttacacttacattcctgtcaaaatcctatatttttcatattcctccgtttttttattcctgtgattcaaaggggcccttagagtggttttgatcctacgtggcagactagtcaatattttttttaaaaaaatggtagtaccctgcgttcacgaaagttggtaggacccgtccat

SEQ ID NO: 20612 - DNA, 968 bp, Oryza sativa
tcagagtcaatctcttaattgattggagcgaccaagcccaaagtaagccttaatttgatcgtggagggatattgcaacaatacagtgatcaatgtacaacttgtcttatgggaatgtgatgactatatgtatgttgatgcatgttaatttattgaccagtgtgacgatctccatgcatgacacagatgattctcaataggtagtatactgccccgttagaatcagcttggctatttccttgattttcatgagcatatttttcaaaatgttaaatgacagacttcgtacaaaaaatttatgtataaaggttattttaaaaaagatagataaattttttatttttaaataattattactcaaattatatacaaatcacgtttctcgctttatgtgcagctaatgagttgtttttatccctggtttagaacacacccttagcttgttttcgcctagctaattaactagcacaactcgcgtaagagaaacatgcttgtaaatagttttactcttactctatataatatgtcggtattatctggtgctggttcgttaaaaaaaataattggccagtttaacgaagtgagcatagctcatttagttaggttcctttggtagaatcaatctacccgatttcaaaatcctagacttgacacggatgctcgcatttatggttatttattttttcagtgataggcgacgtacccgtcgatagcaagacattcatgataacttcatcaatctaaatatgtgtcggtccagtttttcggatatgcacgtagaaatatggtatacgggtgcttataagggtgagcaaacgtgtgcctgtaaaaaaaagcataataaacatgcaccatagatcacacgagcgaagctcatcatgaaactgcaggctccagaatggccatcccaggctcccagcacacccgctcaaaaagacagaagtttagagagagagagagaatatgcgg

SEQ ID NO: 20613 - DNA, 2543 bp, Oryza sativa
ttgcaaccacctgaagcgacttgaattgggagcccaacactatatccacatatgtgatccactccaactccccattcaaatctaccatgtacttgtgtgaaatgggtcctgctccaacatcatatctaccttgtatagctatagactgattgctccaccccatcacatcctttgtatgacaaactaactcctcaaaactaggtcctccaccaaatatacggtgtttaacactcatcccctcgaaattgttaccactgttactttgctctaccacccaaccaccatattgcaatcgacactaatctatccatctacaacattaaccgacatattagcatattcgcattctttaaaaacttgaatttgcaataaaaaaaaaactaacctacaactatgtcccccaaccaaattgcccataaatatctaaacatacgcaaacttccatttcgaaccacccatcctaaattcgaactctcgcattgtgacgaaaattaaacaaaaaagaagtgttctttactaatttgggggaaaaattagggttcttccctaagtgccgaaaatcttcactaaaaattagggttctatgagcatctaaccattacatcaccaacaacaactacaaccacagagtagagaaccaactaatttgggaaaataaccccaaatcacgattctagggttcatccatcaatgagcaaatccaagcaaaaaaatgcgaaatgacgagaggattctgaggagaataccttgccactatgtcctccaataatttcccctccaaaatgcgacgatttagtggagattttttcgattttttggaggggaggagagagatggttcggcgccgccgcgcctcagtcgagagccactgaggaagaaagaaggcccgggctgctgggcgcggctcggccaagggtgataggacctccgcgccagacccgatggcgctgaggtcccgaagctcagcgccaagtcggtcggcgctgacattgcgccgttccgtccatcctccccttagggccgtcaagtactcagcgccgatgcggttggcgctgagttgttcaacctcagcgccgtcggccttggcgctgaggtcggggttcagatctggtgatagtttttgccagggaccaaatttgcaaatagtttttaaaaggggccaaattgtcaaattttcggcagtgatcaatgtacaacttgccctatgggattgtgatgactatatgtatggtgatgcatgtttactgaccagcgtgacgatctccatgcatccccgaacttgaagcagagtactagctatatgtgaaatcactgtcatgattattatttgtgatgaataattggctgtgcgaatgatttattcaaagaattggtttgagagtttgtgtgaatgttggtgtgagtgcgtgtgactaatgtgggtcaggttgtgatatctgtgcccaggaacggttgttttgtctgattgtgtgcaggtgacttgaggtcggccttggtcaatggtgaggaccgggactatgctcagggaggagcagaggtctagtgtggtcgggataccatatgagaaggtgactagagtcaggattcttggaggtcaacttcggtcaacggtggagatcgggactagactcagggaggagttgaggtccagacggttaaggataccggatgacgaagttggatacgagatggcacacggtggatggatatcgtgtgggagagatcttcgcaacgggcttcacgaggtgtgcgtgcaagcgtcggtgttcgcgaaggaaattgtgtgataatatttggttactcgtggtactgtagcatggtgcatatgcatgctgttgcatatgcatgtgtgtgtttgcatgtacggtgctgtacatgtgcagcttgctgcttgctggttggctcggcctgggaggacaagccgcaggagcgagttagctgggacgagcgtaggagaccgagtcgggctcggttgacggcgctgagatttgctatatggctgggattctatgtggattgaattccggtttagatgagtttggaaattaaggtttgagtcctattgtgaataggagtcctacgtctactttgagtaggagggtttttcatgtataaatagaggaggagcgtgaggcttcccgcactacgccagatcctcacacctctgacgggatatctgtgacgggcaaacgatttggtcactggtgaccatcacctttgacgggtcatacgggatgccgtcatcggtgaggcatccggccgcggcccgtcataggtatcccctcacctgtgacgggccgaaaggaaaactcgtcacaggtgagtcagtgacgagttttgcttccaacccgtcactggtatcctctcacctgtgacgggccgaggcattataaaacgtcacaggtggtgggcggcttttttttctggcccgtcacaggtgaggggataccagtgacgggcaactggtcatacctttgacgggcttttttaatctaaccctgtttgaggtgtgtttggtctataaatacccccaacccgccaac

SEQ ID NO: 20614 - DNA, 621 bp, Oryza sativa
aaggaatacgctgacttgaatgtctgccctgtctgtggggcatcaagatacaaacgagcaaagagtgaaggtgaaggaagtaatgtcaaagaggggaggcccagcaaaggtggtgtggtatctcccaattgcggagcgcatgaagagaatgtttgcgaatatggaacaagctaagctagtgcgctggcatgccgaagaacggaaagtcgatagtatgctgaggcacccagcagattcagtacagtggaggacaatcgataggatttaccaggaattctcaaatgacccaagaaacatgcgtttcgcaatgtgtacggacggcattaatccatttggtgatttgagcagtcgtcacggtacatggccagttctgcttgttaactataaccttcctccctggttatgtttcaaaagaaagtatattattcttgccatgctcatgcaaggaccgagacaacctgccaacgatatcgatgtgttccttgaaccgataatcgatgacttcgaaaggctatggaatgagggcacacgaacatgggacgcatatgcacaagagtatttcaacctccatgtgatgctgttttgtaccatcaatgattatccggcccttggaaactttct

SEQ ID NO: 20615 - DNA, 1231 bp, Oryza sativa
agacgacagggtcatggcgaatttctttcccatgggcctgaagggacaggcgcggggttggctaatgaacctgccgcccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagaactttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcgcgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttctcccaccatctgcaatgtgaagttggggcgtgtcctcatagatggaggagcggctctcaacatctttcccccgcggcctttgatgctatcaagaaaaccggggatggtgctccagccgtctcacccgatcatcggtgtgacgccggggcacacatggccgttaggtcacatcgacggggtgcag

SEQ ID NO: 20616 - DNA, 913 bp, Oryza sativa
aaacgatttggcagaaaattccagcagcattcataacaccaacatgctccaatatataccagccattccaagcctaccaaaaaatatcatagatagtactctgaaactctggaagcaagtgtagtacttcagaaaaggaagatcaaggcgttaaaatgtaagcttgcaaggctgcaactaaatacagctaaaagcttgttacatacagtcagaaacccaaggcattttcaacataacaggtacttaagctactaaagtacatcttatctagtagattttaacaatacaatgatgcatcagtttatgttcccccagatagcttgccctgctgtcactttgttgctcggccttgcagtcagctcatatagaatccttgcaaatgtgtcggagtatttcccttccgacgtgagtatctcagcaaaagtattctcatggacaaggagatgcatcctgttttgaggctcagagactaggctctccactatcattgatgctttcctacaaacttcaggcacgggatgtggcgtcttcacgaccttaaggagtctatcgacagccctggttcaaataatacgaaatttaagagtttgaatttaagttctcatgtcagtgtgctatatctaatagaatgaaggagatattaccatcgctcgctagcaagcttcagctggaagtacatattcaattatgctacattgtacagagcactaatagcagctgcctgtgcatcgagtgttggcacactcaagaggtcaactagtatcttgtatatctgtatgaaatttagcaatgtaaagtacagaattttatcacccacaaccgaatagctttattcggcccatctccatagcatatcaacaaaattgaaacaatatgctagaagtcaaaaatgatttacctgtggaatggctgg

SEQ ID NO: 20617 - DNA, 534 bp, Oryza sativa
agcataggtgattgttttaagtccgttgagctgccagaaaccttgttttgttgatacatcatctcactatcaggtgataagtgataactgattgctcacaattagtagaactcatcagtgggacattttcttgattcagcactatcctaggtgatataataaagtggcgtcagtcgcatgtttggtggcatctttcttcacaaactgatcactatttagtttcattataatgtgttatttggttctaatcattatgtctcgtgaatgcagaaagcacttggggccaatatttcagaaatgcagaactagagaaaatgttgaaccaagatttgtctcggctctaccctgaattgggaaatttcttccaaacaaccatatgtcagtccatgcttggacgtatactgttagtttggagccttaggtacccagagctcggttacaaacaaggtaagccattgatgtgtacacttctcatgtgacctaacaatcacagattccatctaaagacacaatcttgcaatatgatgttcctaa

SEQ ID NO: 20618 - DNA, 891 bp, Oryza sativa
  unsure (1)..(891): unsure at all n locations
gcaggttcattagctaacaccgggcctgtccctacagggccatggtaaagaaattcgccatgaccctgttgtctcccccagcggcctcgatcccggtcgtatagacctgaagaaactcggtggggttgacgctcccatcatacttctcggtgatggtgggccggaaccttgggggccagcgcacattccgaagactcgccacaaaggctctacagccgacaccaccaaccgggggcacggagggctggtcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggaggtggcggcgccggaggtcctggtggtggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcgctccctggggcgtgctgccgtcaccgtagacgaggaggcgacgctccccgtctcgccgctctcctgcatcacctgcgactggtgatgctgtgggtttttcaaccctctcgagcgccttcccccgcttaggacttttgcgcggaggaggtggnggagtaccagctcgatggcgcgggtttggctccccgtcgtcgccgctcacacttcgagagaagtcgtgcgcctttgcttgctcggccattangctggacaagggaa

SEQ ID NO: 20619 - DNA, 15674 bp, Oryza sativa
tgcagatcgcttcttcgtgacagtagagtcagctgtctttgtttggtcatctgaaggactgagataccgtatttcagaaaaatacaagtattgctgcttaactcattaaaaatgaggtgaagatgttgatgagactaataacaacatacgtggtggtgtctgagtagactttttcaacattctcatgaccaaagccggagagtgttgtattgacacccaatgttcttactcttggcggttttgtatgatccttaggcattgcaatatctcgccagtcatctatctgtacaaaatggaaatgcatcaaacagaatgcagaaataaagtcctaataagcgtatccgtacatgatcaccatatcatttcttttctggatgaaaattgatcagtgcattgtttaaaaaatttagttatttagcaaatttagtcatatcaaagaagcacggtagtccaattaaataaagcgatgctttggccaccaaccaattaagtgtaagtgcaaatatcggaacctttatttacgtttctatggctacagtggacaacaatgccagtcctggatattgcatgagatcatcacattttcatcaatgtctggatattgtgggcaagattctggtggcaagggaataggagcgagaggcatgaagccaagatcctggagacctggaccatggcgcttgggcaccattgtgcaggaggaagacaggaggtacacggaagttcgcagagaagcagggggtagggtaactattctagtttgccttcaagtagcgatagtcccatccttaagtaggaggattgcctaacaacttctgcagattaaacgaaagaataatttgcgaacaaaaagtaaagataaatcagtctcacaatccatgtcctgatcctactggtctggaaccaggtggctgcggccactggaggcatcaacagtactggaggtccaccataaaaaatgaatagggtgatgattgactgactaattattttctaaaatgaactctgattcaaattgatcaattaatgcatgctagaggaattgggaaacatgatttttggcttcagaagatatgcatcattccataacatatagatcaaattggaaggggggaagttaacattaagaacctacaacttgaaggagagcgtccaagagcccaggaactttagcaagaggtgttgtatcccgccggagatcatccttctccttaaatgagagtactgtaagggcgttcaatgcccatagtatctcactcttcaacccactttgcaatgcaagaacaattcttttattgttctgatctgaaaagtccacaaagaaacataaactctccttcttagtaaccatgtcgacagtacatgttaagtgtgcagaaaaaaggagtgcctgtgcatttcaagctcatgacacatatgtgaggtagcatctctattgaatgagccaatatgaacagggaaaaaaatctaggtaaagaaaatatacaggccatcgcttttacatctgaaatgatgaagacaactacaccacgattgtttgtccccattgtttccaatgttcgtcatagactcatatgattactagtgtactacccataaatcacgccgttcttgacggccaatttgacgaccagtcccatctagctaagcaaagccttattcaatactaaaaacattggtcctctatttccctgttaggtcagcagtccaataagcaaatcctcgatgcaaggtatattcagcgtcccaatttcaatttcaacaccaggcacataatcatcagaccaaaaaccctaatcccccttcccgcaacaaagtcgtctccgaagacacgcaggaagaactaatccaaaagctgtgccctagacatcatcacaaggtcgttgcggacttgcaggcgaagaagaagctcactcaccggagagtgctgtgaggacttggagggacggcccaaccagcgcggccggcgccgccgcgtcgccgattgcagccgccgcggccgcggccgccgccccgctgccggtggtgcttccgaaggggcgcccgcgcttcgccggcgtggagccgccgcccccgccggacttgcccgccggggcggacctcacgtgggacatgatgagggttcagcagctgaaccccaaattattttgggaacaagaatggtgtcagcaaagagaaaaaggtttccagatctagaagagaaggtgtgggtaatgaaagatagagagagaggatgagcgtatggggttctcaccggcgaggctgcggcggaagcagcaggacggcggcgcgccgctgctcgccggatggagataggggcgctgctcggcgcaggcggcgggcgaactcgcgtcgcgaggagagcctcgaggccgccgagggaggagacggggagatcgactagggagtgagaaactcagcaggcataggccaattcttctgggccatgcgcatcatgggctttctaggcccaggtatcaggtccactacagcccagttgaaacaaatcagagtaaaggtcctctctgcacacggaaaagatcctccgacttaatttcctccaactttaaatcactgacatgcgatccgttgaatagagagtccacctatcaatgaaccatgtcagagggaagtaaatctgaagatctcaaatcccgattgactgaccacggctcagaacaacacaatttgaaatactacattatagtaaattatctacacgattacatctatatatatatatattaaaattttaatataaataaacttaacgtatgctagattaagggatctaatcaatacaatagaacaatattttttagaaaaaaatattattagaggcatgaagctaataatccagtataataatctaatgaagcaggggcttaactgttcttatgctttatttagcgctgctccaaattttacatctatgcaactctagatcattgatttctaagtttagtgatactttgactatttaaatcttgaatttagagttatgtcaagcaaaaccttaagtacgcttcgaattgaagcgtttaccaggatcaaccatgagaaaataaaagtagagaaggcgtggatggtcagaaacgagaggatcgatcatccacattatgcatatggatctagtggtggagacaactctcaagtaggttaggcaaccgccaaagcttcatagttgacgtctctactaccaactaccgttaatatatatataaattagtggcttcactgtcagtatctctccaccaccaactaccgttaatatgtataaaaattagttgattactagaaaacaatattaattgtctgtacttgacggtgtcactagctccaccactgtctaggcctagccattcactgtgtgcgaaagggataagatagggaagaagatcactcatactcccaaagcatatggaagtttcaagactaacatataaaatacttcctccgttagaaaatataagatgtgcatgtattttaagaatcaaattccggcatcactaaattcatatgtactatacaggaatctttgaaaaaaaatggtggttgaagtttgatgatagaaacagtgcccaatcaagccacacattatatttttgaatggagggagcagtatacatatagagaaaagagacaattaattgcagcaaaaatataaatgctccttgttgcaagtttttcgcacaaccgcgtgtataagtttttatttttctaaaaaattacccattaccatttatgagcattactaaaatttcacaatgtttagtacaaattcattattttgccacaaaactgtgttaaaatttataatttgactccatcttattttcttttttttctcttgttctggtctcttcactgttctccaccagttcaagctatctgttcactctatttcatacctttttagatttgtcctaaatcaaacttcttaaattttaactaagttgatagtaaaatgtaacaatgtgtacaacaccataacaccataggaaccaccaaattgaaacagttcacaacatatcacgagaaaagaataacaagctgttattgaagaagcaaacgctgacttctaaatgccatttcagcctagatcttttaatacttgatataattaaagataaatggattatttgtttcagataaagtctttggacgtatggaaacgacgatacagccaagacgccaagtattgtcacaataaatcctatcacaatatcatcacactagttgaaattcctcttgttgattttaggtggtcttgaacgacattgttttgtgagtagaagaaagtaacacatgggacgagcggcttaatacaatttaatttgcatcgacatcccttataatttttacatcacaactacaaacatacggcgaaacgacacacgcaccaaaaaaaaaaaaaactgtgtagtagtaaattaacctattaagcagcgcatctataatcgatacacagtgcgtcaccttgcttgcgtgttctacttagattttgtcaatcgcccggcggactatgggagcgattaccagcgatcccacggtcgccaacccgccggtcgttccgacatccaccgcggtcaaaccgacggcgacgccgatcttgagagcaaccttcgcggcgcgtacccccacgctccgtttctcctccccctcctgctgctgcggcggctgcggctgctggtgtgcgccgtccaacacaggcgtgcaccgagggtgcgcgctgaagttgcacggcgcgcaggcgtacatgcggcacccggcgtgggagatcacgtcgcagacgttgcaccaccggctgcccgtcaggcgggtgagcgtgagctcgtgctcgtggcgctcgtgcagggcgaaggacgccgggagggcgaggcagctccggtggacgtggaagtcgcactcgccgtgctcgcagcggtagccgtcgccggtgacgacgcgctcgcacgcggcgcaggggttgcccgaccccgaacccgacccctcgccgtagtggtgctcggttaccaagtgctctgggtggtagaagcagctaacacctgccatctcgtgatatatcgattttgctaggtgctgcgtacgtgtgggctggctggctcgtggttttgtttgatttgatcctagtacttttggctgtccaggtagtagtggtgcatgctctcggagacacgtatgagagtatatatataggacctctttatcactgctcgggatccagagtttgaatattttaagggcttgctcggatcacaggataggaaaaacataggaatagaaaaaacatagaaataatataggattgcatatgcaaaatgtgggattgaaaaacaaaagaatttgatagtacgaagcgttcggaacacaggaatatataaaccacaggaattttccaattaatattaatctcatatattatagtataattaagcaataaaatattagttcccatctagtcactccaacgtgattagcatctatcccatggtagctaatggaaaaaaaatcccatggtagctaatggaaaaaaatgaggtgtgagtggatgttcagaatcctatgaaattcctacgttttcacatgttgctatagtattcctatgaaaatcctgtgcatggttcctatgaaacgaatgcataaacagtgccaaatccaaaggaattgccaatcctacgaaaatcctgtgtaattcctccgttccgaacaagcccttagctccacaaaattatagacgtggatttatgattacgttgataacatttgagtaaattatcttattttctttttgatgaaatttaaaattctaaacaactactccgtagtatatttaacatacataccattaaatctagactttctatgcatcgtttttcagagtgttttttttattaaatcgcaaggcaaccttgaagaacttccctttttgagagaaaccctgtacgtgcagtagaacgtgtcaaaagaaccaacaaactgcagctgcatgcaagcctgcaacgcaagaggcaagcacacggatgctacagtctacacgtaacttaagaacacttgctatctgtcctcgtcaataaattgatgtcaacgaatcgaacagtttaattatcaacaatttgtgtttgcgttgtgcacttgaatttttcttcatattaatttatatgccaatgcgcttaactttttgtgtattcactaaagacttatacatcgaactgcaagcatatgcgtgcgagacttggttcacgtgatcaaccaccagagcaagtttaatagtacagtcaacttagctccaaatcatctatagctaatataatagctaattcatacaatagttgcttactatactattaatacctggtcccacctgtcatacacacattacgttttggagtccgtgttgtagctagctacagatctgtagcccgctgctcttctctcttcatttatttctttaaaatatgtttatagctggcttatagcctgctattgtatctgctctcatactctggagtaggggatgtactccctctgtactcgtaaagaaagtcattttggacagcggcacggtctccaaaacacaactttgactttttatttctataaaaatatttattgaaaagtgatatatgtatacttttgtgaaagtatttttcaatacaaatctattcatataatttttacattttcaaactcaacaacttgagagttattcatgatttatattcccaaggtttgacttaaacattatcccaaacgacttcctttacgaatacggagggagtagtaattaaaggtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcttgccccggccccgagggccgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcgggcggcaaccataccaacctccgtccataaagagaagaaaagtccagtttggaagggagagggtacatgtggtatccccttaagatataaaaggaggaccatgcccacaaagagaggggactggattttcccgggagaggagagggctggttgatattttgtaacttgctcttacacagatccacaaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgtgcggtctcccggtgaggagccacgagctccgtcatctggcgcgccaggtagggggctcagcgtgtgttttctgagctctcatactcttccgtgtgcgccaagtttcccttgttcagcctaatggccgagcaagcaaaggcgcacgacctctctccgagtgtgagcggcgacgacggggagccaaacccacgccgtcgagctcgtactcccccacctcctccacaccaaagtcctaagcagggggaggcgctcgagagggtcgaaaaatccacagcatcaccggtcgcgggtgatgcaagagaacggcgagatggggagcgtcgcctcctcgtctacggcgacggcagcacgcctcagggcgcgcttcaggctgttggcgcgctcctacgtcacccgcccgtcgtccctgacccggagtctccagcccagcgatggctagacgacgtggccaacttggtcatgacggcacagcagcgcctgggtgctggtggacggtccgccaccaccaagacctccggcgccgccactaccggctccgtgtcgtcaaggcggagggcgcggcgagcggcggctgttgcacgccattcggctaccactccctcgtcggcacctccgactcgggaggatcagcatgaagagccggatgcccgcctcgacatcgagcgtaggcgtaatagccggcgtactccccgcgcagcggagggcgcctcttcgtccagagtgtcacctcgacagggacgtgaggaccagccctccgtgcccccggttggtggtgtcggctgtagagcctttgtggcgagtcttcggaatgtccgttggcccccaaggttccggcccaccatcaccgagaagtatgatgggagcgtcaaccccaccgagtttctccaggtctatacgaccgggattgaggccgctgggggtgacgacagggtcatggcgaatttctttcccatggccctgaagggacaggcgcggggttggctaatgaacctgccacccgcatcggtccactcctgggaggatctgtgccaacagttcactatgaactttcaaggcacctatccacgcccaggtgaagaagcggacttgcacgcagtacagcgaggggatgatgagtcacttcgctcgtacattcagcggttctgccaagtccgtaatactataccatgcatccctgcacacgcggtgatctacgcgttcagggggggtgtgcggcacaaccgcatgctcgaaaagatcgcctccaaagagccccagactaccgcggagctctttcagctcgcggaccgagtggctcgtaaggaggaagcgtggacttggaacccctccggttccggtgtggcagcttcggccgcccccgggtccgccgctcagacagggcggcgtgacaggaggagaaagaagaggtcggtccattccggcgacgagggtcatgtcctcgccgtcgagggcgctccgcgggccacccgaaaggggaggcctgcgagcgacaaaaagaaagaggcaggtgctcccagcagggagcgcccagccggcaagtggtgctccgtccacaacacctccctccacgatctcgcggattgccgcgcagtcaaaaatttggctgagcggacgaagaagtgggaggaggacaggaggcaggaacgccgtgagaacaagtccccggcggttctttccggtaatcggcgaagagaggccaagcagaaggcccccgccgaggacatcgatggtgacgatgatgacctaggattccaggagcctggggccaccattgccaccgtcgatgggggagcatgtgctcatgtttctcgccggagcttcaaggctatgaagcgagagcttctggccgcggtccctactcatgaggcaacgcgtcgggcgcggtggtcggaggttgccctcacctttgaccagaccgaccacccaccgtgtgttgcccggggaggacagattgcgatggtggtttcccccaccatctgcaacgtgaagttggggcgtgtcctcatagatggaggaacggccctcaacattctttcccccgcggcctttgatgctatcaaggccccggggatggtgctccagccgtcccaaccgatcatcggtgtgacgccggggcacacatggccattaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccatggcgaccttaaagtcgcgctcgcttgcatggagcagtgcgcggaccacctcgctgctgcgtccaagcccgagggtggtgacgagaggcttggcacctctgcccccaccgccccgaggcagcggattgacacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttttacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgcacggggccgtttacttggacggaggaagctgaacatgccctcactcagttaaaggcatatctcagctctcccccggttctagtcgccccggagccaaatgagcccctgctactttacttagcggcgaccccccaagtagttagtgcagcattggttgtggagcgcgatgaagacaatcctcatttcgtgcacccccattctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccgcacttaacgccctttgaccccgaggctaaccctgtgctgactcgacccgggaaagagcagggagaagaggccccccgagccgaacggaggccagaggcccctgacgaccggagttggccctttgcccgcttgtccgacgatgccaggagcccccgacccccaggacggccccgaggccactgagggaaggccgcccctttcatcctccgaccccaaggtcatcggcacagaagacaagtgcgccccgaaaggccacttgaacgaagaacgccccggggatacggcccctagcagagaggatcggccccaccgaagggtgcagcggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcatgatcgagagggtacagggcgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtaatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccggactggggatccgccgtctcctagtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacataccttacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcaggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtctgtatcgagtgatcggcgtcccccggccaggctccgtacggctggccacgggcgacggcactgagctgccaaacccgtggaacatcgaacaccttcgtcgcttctacccctgaggggggggggggtcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgagccgtgccccggggcgtggtgaactccgggggggaatcggcaaaaacccacaatcgggtcacccataaccctcggtccccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagaaaaataaagttaacatagaaatttttcatcatttttgattgcagattaagttgatctatacaaaaagaagaaagaaaaagaaaaaattggagattggcgggggcctgggggctcattccaatgcgcccgggtcgccggcctcgtcgccaccgtcgtccttaccgctggcgtcgccctcctcgtcggagctgggggcgaacgcgagccgaggggccgacccctcgaagctttggacgatgtggttggcggcatcccggacccgcgcacgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcaaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacggtgtgttcggcagctgcgaggcgggcgactaagtcgctttcgcccgtagccgccccgccgctgcgctccctcgcgtccagctccttttctcgcgcctcgaggttagcagcccgctgctccagcgcggctctctcggcgcggacgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggtctcgtgcgccgccagcgtcgcctcacggatagcggaggcggcctcgcggtccgccaagctggtcttcacggcgccggcatgatctttcagcgccatggcacgggcttcaaggg

SEQ ID NO: 20620 - DNA, 3208 bp, Oryza sativa
ccacctgggcgctgaatccatctagcaccgcggtgttggcggcggccaaggcttgcagaaggggctcggcactcagcggggcggcagaagacgaggagaagagccgccttggagaaaatgcgacgcggctcggcccgccagaagacgcactgagcttggggatgtcccccggacccgtttggtcctgggcgtcgcccgagggagcgggcccaggcgatccgcccgcggcctcgtcgcgagccgtcccggaggctgtcgcctgagcgtcgcccgagggagtaggcccaagcgacgcgccagcagctttgtcgtgggctgcctcgaaagacgccatcgcctcagtttggcgggctcgggcggcctcctcccgagcggtttcctcggcttggcggactcgggcggcctcctcccgagcggcttcctcggcttggcgggcccgggcggcctcctcccgagcggcttcctcggcttggtgggcccgggcggcctcttcccgagcggtatcctcagcctggcgagcccgggcggtttcccgggcggcctcttcagcttcccgaaggcgatctgcggcctctcgccggtcagattctcgcctccgttcctctgcggccgccggatcttcggcttcggattggccggacttgggatggcgggaggaacgcgacgggacatcactgaagcagaaagaaaaaccagaaggcaaacaggatgggtaagaagaaacttgcttttggaatagaagaaaagacggtcgcaatgagcatgggacgaacctgcgagggggtcggttaaatgaccaccttggaggggaaattaggtttccccgggatggttctgtctcccccatcttgcgcagccgcttcttcttgcgctccccctcgggctgcgaggttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacggccccctcctggggttgattcttcctggtggctcccgccggcgccgtcgtggcccttaggagccacctcctctgaggccccgacccccatcatgatggtcagaatggaggcgcggtctggatcgcagcagagggggaggagtccttgaggaataagagacgcctccacggagctgagattcagcaccctttggaccacgatcttgaagtcatcgggagcccaatcccatctgactccccggtgggtcctcatgtagtcctcggacccggtgtactcccatgcgctccgggcgcgccgctgaagcggcgcaatccggcgacggaggtagtcgccgtacaccatggcccctgtgagcccctgagatcgcaggcccgccaggcggtcgaggacggcgtcatagtcatcccccagatctactggcgcccgccagctggagaccggagccgggggctggcttgggagtcggaggcgcgcttcgttggcaaggggggtgtagaaccagtcgctcttccaatcgtcccacttcttgcggagggcgcaggggatgtagcggttcaacaccggcccccgcggctggaagtagcaaccaccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggaggaagaagatggaccgccccgggtaatctggtgctgggcgcgcctcgcccagcatcactatctcccggccggtggcagattccggcatgaagcggcgcggcagcccagcctgcctctcgctcacaatgcgggaaggtggtagtacgctaccgtcgagcagagcggagccccgtgccatgtcgtcggagaaagagagggttgagaacgagcgtgtgtggcgaaggtgaggcgcagcaaagagagagtttagggcgcaaacggcgaaggaaaggggaatagtggcgaaaggaagggagcaagtcctttcctcgatggctttatacccttgccatcgctgagtccggctcctcgtttctcgtgcccactatctcgccccctcgttactcgctatctcgctccctcgtttctcgcgcccacgcttccactaattccattcgcccgcttgcggcgcatgaggtggatatgcggttgtggcagtcgagatagatcgtatcgtgtgcgcgttaattacgctcgccgaccgaagcgacgttaccatgtctccagacgaaacgaatctgcacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagatggaatcgcccacgtggcctggcaccttcggggacgtcgggcccgagggtgaggtgtccgccctcctcctgatttccccaagggggggtcgggttgctcctgccccggccccgagggacgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctaccaaaagaaaggtgatcatgcagatcggtgaactgacgcatagaggacaagaatgaccg

SEQ ID NO: 20621 - DNA, 7031 bp, Oryza sativa
aggtaggtgtggcctgtcccatcgaagtgtcattcggggggcaaccataccaacctccgtccataaagagaagaaaagtccagtttggaagggagagggtacatgtggtatccccttaagatataaaaggaggaccatgcccacaaagagaggggactggattttcccgggagaggagagggctggttgatattttgtaacttgctcttacacagatccacaaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcataatgcctcatagagtcaaagcatgaactaatttctccatattttcatatatggaagcatattgcttgtgcgttaatatacagtacatgttgtacaaacgttaaattgtaaatgttgtgtatacttaaatgtacataaaaatattttaaaaaaaatgtgagatgtgcaacatgcatgtacaacacgtaaaaatgtaactcaaaattatcatatgcggcttgttttgacttagtttctacttatttttaagtctagctattatcttactcccccttagtctcaaaataactttacttttagcctctacctcgtctcaaaataagtttacctttatcaacttacctatcatgctctaatccacaatttgatgaattttttttactccatcaatatcttttacctatccttacctacctatctacctatccacgcatatatactagtttcctattagtgagcgacactttggtgtttttttcttctacattgttttgaacgtccaagtctaaacttaaagttaaagttattttgaaatggaaggaccgaaagactattatcttattaaagtgtaattgcaaagaaataagcttttatgtttgctctcaaattacatattaatatgagaaaaaaaatctaaaccgttaattatagggtggatctaaaatatagctgtgtggatttattggatgagctcttcatggaaaacaaactccatatctccaatctatattcaattcaaataaaaaactcaaacgatgccatacacattacataaacattttcacaccacccacaattatatatgcatattactaattattatttatctaattacattacttagtttgttctactgaaggttaattatataattactcaataaattaacaagcaaaacaagggctaaaccatcatttctgtgaccatagagccaaagcaacacaactctatagcagaccttatctttcgtggataataaactactacgcaggatccgctcacctctaacggatcatcagtgactgttatgaagttatctatgataaatagtctatgaagttattgttcggttttgtgcatatatatagtttttatatctaataaggcttgttcaggctaaaaaaattcatacacacgtcactgtttgaatgctttccatctcgagagcaaatagatgtttcttgctttatatatattgacattatttttaaagatacttcctctcaccctaaatatttgacgcaattgattttttaaaatatgtttaaccgtttgtcttattcaaaaaatttaactaattattaatttttttcctatcattcaattcattgttaaatatacttttatgtatacatatagttttacatattttacacaagtttttgaataagacgaacggtcaaacatgttttaaaaaagtcaacggcgttaaatatttagagacggagggagtaaaaaaaaactagcacaaaatttctaacatcttttgcatctctccaagctaggatagcgagcatcatcacccactcctcgcacccagaacaccaattacgaaagatgaagctcaaatatctatttacttgcgggaaactattctaatccctcgaggggatgttttctcgtttgctcaaaaaccatctaaacagttatgaaaaattctagaaaaatttgacaacattcatacaacacatatatataactccacaaaatcttaagtccaaactcaactcacacgtcgagatataaaaaagacaaattcagcgtatgaatagtagcgaactgtttatatataaatttgtcttttttgtttctcgatgtgtagatcgaatttgaacatgaattttggtggactagtaggtatcattatactctacatttttaatttttttcagaatttttcacaactatttgcatcgaatttagaagaaaaagatgtcccctcaatccactcccacttacttgcaacttatgcaaccatcccggtgctatcagttgctcacaataatcacctatataaacacacacacacatcttactatagcgcatttaggatgtccgtaatatcattgacaattaaattcaccgccagttgccgggcgaacatgatcagaaacctcacgatgggactgctaccgccggcccagccgccgccgccaccggtggcaggccaacccctcgcaccagctggagcaccgccggcgccggccggcgaaacgcagccgatgtggagcatgaacagacataggccgcaccggtaatgccagatggagcagtcccggtggcacgccgcgcactccccgcgcgccgggaccaagttgaggacgtgcccgtggcacccggcggccgggtggatggtcatcggcagcagcgtgcacagcgggtgcacgtcgaacgcgcactccgcgcagcggtacacgaggcggccgggctggatccgcccctggcacaggtcgcaccacccggggttcgccgaggccacaaccgcggttagcgggtgccgcgggtgcgcgaagaagccgtggatcgtgtcccgggcgaagcggtcggcgcaagcctcgtggatggtgaagtcgctacagtggtggtggttgcagcggtagccgacgccggtgatgggtagctcgcagatgttgcaggcacggtggctgatctgatcccgctggttgtatgtgcacctctgaagctggtgctgtggatgtgcaacgtgccagcggttttccatggccagcaatcactatagcttgatcgctctcgctcgtatagctcgtgcggtgtactgtttttacgtacgtgtgcactgctcttaatttgtgttgcgctttgagttccgggtgccaatatatatacacagagagaagagcacgcttacatacatagacataagttaattaacttgttcttttttttatgttgcatttgaccttatgtttcatataattaatctatcttgttaattatttttcatatatttttaataactatttaaatatcatgtaagaaataaataaaggatatccccagatgaaaatacttttcttagggcctgtttagtagagctccaactcctaaatttagctacaggagttgggtctggagtggagttgtggagctgtgtttattttgtgagagagctccgtccaactctgctcccattttaggtggagctgaaactgtttagctgagctccaactctagaagagatggagcgagagctggatctgtactaaacagacccttacatacacgcatgatgcatccttggagggggccagacagtggatttgcaagagcttttacaaggtcagtcaactatgggttcacgcggttaattcgggtaataagtacagagaggaagatgaagatggagattaagagattaagtgtttcacagaaaaacgaggtggtaataacatgtgattaattaggttttaattattacaaacttgaaaaatggattaatctaatattttagaacaacttttatatagaaagttttcgcacgaaatgtaccgtttaaccgtttgaaaagcgtgtcatgagtatccaaattttcatccacttttacagaagaaacgaacgggagactcggttgtttcgctccggtctgattcagtttcgatcgggtatgtacaagagatgttgaaatgttaggaaatgtagtatatatacattgatttgaacctgtagtaaatagtactaaatacgtaccgaacacgacatggaatgcaacagcagcaaactgtgacatgtggaattttctcatcgaaaattcagaaaatttacaacatgctggtactctagtcgaatttgagaacttaaggtatcgtccttatagctgaactctggctagtcaaaaattctgaaaatttacttaactacatgcgtcgtgcgaaaaagttctacatattttccctatcccaaaatataataacttatagcatttaaaattgttgtaaaatataacaactttcccaccatattcaaacatccatatcgtttcgtttatgattatacttgtacatatggcttattagcaaaacaaataataatttgtgcttacaattttcatatactttcccttagcaatcaaaattaaatgttataatataaactaagataaaagaaaccacaaaattaattaagttttagtatttaaattttgcttataagtataagtatatataagcgaaacgatggggctgaatgtcttcctctacttattattctctatcaatcacaatattgtctcatttaattccacattgttttcttgatactcgtatctaaccttgcaaatttttacatttttggacgtagtcggtataatttttttttaaaaaaatcaaataaatctatttataagtttgtaatcgattatattcaactaatcactcgctaagtcactaatgacgtactatctcgttttgagtgtagcacaaataactcaggctagctggtacccgctgcttcgggcctgtttggcatagctccagctccagctccacctctccaggagctggagctcagctaaacagtttcagctctaccaataatgggaatggagctgggtggagctctctcacaaaataaactagagttgtggaactgggtttagacagctccacaactccgctctagactcaactcctggagctaaattaggagttggagctgtaccaaacaggcccttctaaccggccggctatgttcgatcctccataatctattttcatgattttcgtaagtatatatttctcaaactgtaaaacagtgtgtttttaaaaatgaattctacataaaaattacttttaaaaattatattaaattatttttaaagtttttttctatagctaaaacgtagttaatgggtcatcacatcatctttcgtgccgaagaggaaagatactaccacgattcaatcgcagtctaagacttacttcctccatcccataaaaccaatcctaatatgggatatgacatattctagttctataaataagagtacgggatgtaacggagagagtacaagtcaggtcatatctcatatctcatattaggtttgttttttatgggacggaagaaataaaagtcaggtcaagttaactctgattttaatgccaatcggctactccaagagataatgaattaattagaagtaatcttgcagtccgtgttgcaccgctacttttctctcttctcttttatcttcttaattaattaaaatatgttggtttatagtctgctattgtatatgctcttagcgggtgctgcgggtgcgcgaagaacccgtggatcgtgtcccgggcgaagcggtcggcgcaagcctcgtggatggcgaagtcgctgcagtggtggtggactggtggttgcagcggtagccgacgccggtgacgggcgcaataattcgcagatgtggcaggcacggtggctttcctactggttgtacgcaggtgtcctccgaagctagctagctggtgacgtgaggatgtgcatggtgccatcggttttacatggtcacttggtcagcaagcaatcacacgttgcactgtttttacgtacgtgcctctgctagctctccgtgttgcacttgtacgcgtacacggccgcatcgttggagggggcagggcgcggtggactggctaggtcaagtcgactctgggatagctggtgggagttcgatcacacggttctggtaaagtaatacagcgatggaacgacgaagacttgcattatggctgtttcgctccgacctgacagtttcaatcgggtttgtacaagtggatgttgaaatgttggcacatatacattgatttgaacgtgacctagcaagtccatggaacggttccattcgcggtggacttgctagggtctaaacacgacatggaacggtagctgcagcagcaacgacgtctgtgacatgcatgtgttgtagattactcctacatgcattgatgcttatgcattgtctgtcctcttccaagtggccggacttaaaaaggctagcttacaagtcaggtcaagtcaactcggagcaagtgtagtactccctccatcctaaaatataaatatttctggacttcgacacgatcttcaagatattttttttaccaacaatatctatagaaataaaatgttttaaataaaaagagttgcatattatgatagtttgtttaatggtaaatctagtaacgtcaattttacatggttgacctttttattttttatattgatagtcaaagttaaaaaatctttgacttaacactatgctaaaaatgcttatattctgggacggagggaatgaaaactggagcagtactacggtctggcatgattttaatggcaaccgcccaatcggctactgcaagacaacaataatatggtatatggaaaggtactcgcttcgtcttaaaatatgatttggttagatgtgacataatcctattactacgatattaagatttatagtaccaacatgtgtccaatctaaccaaatcccttatattttgaaaagcaattttgtcatccaacattgttaattaccttgagatgccacaaattattggtacctcgaggtactttctagtgtaaaatttggtacctagtaacttcatgttaggg

SEQ ID NO: 20622 - DNA, 1445 bp, Oryza sativa
gtacaatggtgtttaataacgggctctgttcgttgtcatgcaagtaaatttggtgacgtggaagaaagagaagtaaggaatgagaagcatggttgctacgcataacaccggctcagagtcgactcttagcatttattaacagaaagtttgttgcatgagggtatagaaaaggaaagaagcataataaaaaaatatttagtgcattaatggtttagaaatcttattgtctctactattgtagaaggatagtctctagtgatattaattaatatagagagctcatattaggccctgtttagatgggactaaaacttttaagtccctatcacatcggatgtttgaatattaattataaatattaaacgtagactattaataaaacccattcataatcttggactaattcgcgagacgaatctattgagcctaactaatccatgattagcctatgtgatgccacagtaaacattctctaattatggattaattaggcttaaaaaaattgtctcgtgaattagctttcatttatgtaattagttttgtaagtaatctatatttaatactctaaattagtgtctaaagacagggactaaagttaagtccctggatccaaacaccaccttagtctctacctttgtacatgcccttatgaacgcggtagtacatcccatttggttgaattaagatttttctgcgaagaagttgaactgccataaaaggtaagatttgtggaaacatttggaaggttcaaagttgttggaacaactgaaaaatacagttatgtttgttggtaacaatatttgagtacatattttatcccaacaaatattcgattacaattacttagttattactttctccgtttcacaatgtaagactttctagcgttatccatattcatatagatgttaatgaatctagacacatatatgcatatatatgaatgtgggcaatgatagaaagtcttacaatatgaaacggagggagtattgtttaacggtcaccggggaggaaaactccccacctgaatcttattgaaaagaaactatacaaaaccttcccttggccatctgctttcagatctggccgtggtctctttcggtgcttgaggagtttgttcgtccacggtgttggtcttgcctgtctgtagttaggtctcttaggcctcgccggtgcttcacgtgtcctgtggcttattgaactcgttgtggtgctgagattggagcggtgtgcttatctctccatggtgcgagagttttgctttggcttcttagaagttctgcaccttttgagggagtccggggcgaaagccttgcttgcccgtcttctgcggttcgcagttgttttgtctcagactttctgtgtcttctgcgtaatgttttcgtcggtttcactttagtatgcttttttttttcgattttccttacaaacaggttcaacactat

SEQ ID NO: 20623 - DNA, 1942 bp, Oryza sativa
atttagttgataatattttcatttgaagtcatttagggtgttaaatatatgttaaatgattcagacaagcatagacaaaataataacattgggttagtagtcaatatgtgttaagtaggtgagttggtaagggagctctatatggaggttgaggtcttaagttcgaatctcacttgtagcatacaagttatattgtgtgaaaaattgtgaatttgtaggtagtgatgtgtaaccatgtataggatggctagtaaaattcaaaatatttttttgaggttttttgttgcgtttaaaattcaaaaattgtatttcttgctttgtcatcagtgacgggtcgtaagttacaacccgtcagagatgagtcatcagtgacggtcaggtagttacgacacgtcactgatgactcatctgtaacgggtgacaagttttaacccgtcagagatgacttatataccggtcagagatgggttatctgtgacgggtgtttcatccatcacaggtgattttgtcatcagtgaccactaatcactgaccaagaccaaacccgtcaaaggtgagggtttgggtccgtcagagatgacctggtccggcgtagtgcgattcgatgggcatatacggttgacttgacttagcctataccgcttgtggatcgaacaatgggttactacacattattggagaagaagaaagttcaacggaattgaaacgacaggtgatcttacacacatacatagatgagccaaacaggcctggtgatcatcgacgtggcaattaatcgaggacagcttcaaggacgtcgagcaccggcgatgccagcccgcctgttgctaggttaatcgcgaccatgaagcttttcttgacgagaaacttggtgataccagagctgcagctccgccgaacgatggcaatgctctgagcatcactggtagttcggatggcagcgttgctggtgcaaggctctttttagttcccaaaacaaaaaattccatgctgtcacatcgaatgtttagacacatgcatggagtattaaatgtagaaaaaaaatcaattacgcaaattgtatataaattatgaggcggatcttttaagtctaattgtgtcataatttgacaatgtgatgttaaagtaaacatttgctaatgatggattaattaggcttaataaattcgtctcgcagtttttttacgaaatctgtaatttattttgttattacactatgtttaatactttaaatattcaaatgtgtgtccgtatatccactaaatctaaaaaaatttcctgaactaaacaaggccttactccgctaggcccgctaccctgaccgacaccacttggcgcgccagagacgcaacggatatgtagcttaaacagacaaaagccacactggtagtaccaaaggtccaaatcttcacggcaggcggagcagcggccccatgaagggaccatgtggatatcatgctgctggtgaagcgggctacggatcgtttgcgggagcaaaatgcagagagggtgcacgtcgaaggcgcactggatgcagcggtacacgaagtttccccgggggcaattctccctgcaaaggtcgcacgaccacgtggtgcttccatcgggtatggagctcagagtgagggtatgccacggatgggcgaagaaggagatggtcttcttgaagtaatcggcgcaggcctgatggatgtcgaagtcgcaggcgttgcagcggtagccgacgaggccggagagcttggctcggcagatgtcgcagacatggcgcgaggtgctgtcataccgggtcttgagaagcaggtgctgtggatgagcgaagtgtgttatgtggccatcagttgccatgtcttcggctacgctcagaacaccccaatctctctcttggcctagtttttggctacagtatttctatagatcgatcagactactccacggttagtgt

SEQ ID NO: 20624 - DNA, 841 bp, Oryza sativa
  unsure (1)..(841): unsure at all n locations
atatgacataaatggatacacctttcacacggtaaaacaagacagcaaatgcaccatgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgctaaacaagttgttcaagtgttctacatagttgacccgtgtaacaagaaactacatgttgttcgccaagagaaaaggagaattgttggattgcacaatattgcagacaaggatgattaccacccagaccgtccacggataagggaatgaaatacctctagacaggaggaagaagagatgacgtcaatatgcacgcgcgacctgaggaggattatttntgtatttatgacgtagttatgctacatgcctgtatctatatgactctgatatgttcgcaatgatcaatagtatattccttatgaaatagtcaaataaaataattaagtgaagcacccactagaagtgaaataaaataattaagcaagtataaccattggaaataaaataataaaattagtaaaataatgtagtgcaattactactgttagtgaaataaaataattaagtataacaaaatatgtagtgtatgtggaaatatgttaaagaaaataaaagaactaagtgaaataaaataaaataaaattgttgtaggcaaactcatctgtgacgggctctaactgtggg

SEQ ID NO: 20625 - DNA, 5002 bp, Oryza sativa
tgtcatttgtcagaccaacccaacctttacctcctgaagtaagaggagtttcgctttgataccttatgctaaagctccatacacttatctgttgagatccctctccagaagcattcacgtactacatctgcaattatgcattgtctgtctgtctctacgataaaccttgacactccggacttccttggcaagttcaattgctctcgtcaagggacacgatgattttgctgacatgatctgtaaaagaagcaaagtcgtatcagtttgatgatcattaaggaatgaaaacaaaagtacaaattcaaatgcctgtcagcatcacctctttctttccgactaactggtgtttgtctgcaactcggtctgacgctttgctttgtcatgcattgcgagtagttcccttttcttctgttctcatccaaagaatgatcaaaattacacgatgctccaaaaataaatatggtgcagcttgttggaaagatataagtatgctttaagctaagccatcattcacagtaaaagtagatcatttgcatttggagctgcagtttaggattttagactatggtactacaaagactgaggcaaaatccaaacagcacaagtgttattcacatctactaattactgtacagtttctacttcgctatgagcctatgattgctgtgcaatgatgacttacaactagccagaatatcagatcaaactagttggtatctgcttctcgaatataacgaccaatagccagaacaattttcaccaattggatatcgaaaggctaattcgctaattctaaagcagcatttatcacgggaacacatagattaaaatataattgctggcttccaaaacaaaagatctgatcctctttatagtagccatataccgagcaatcgcagtgtggatgtgatcaaggtactcatcccagtctgaatcatcagccatagtgataccaagtcgctcaacctcttcatcggtgtagtccgctaattcggtaggggcagctaaagggcttcgcattccgcgcttgatgtttaactcgttgatgcccttcatagccttcttgaaattctcataccgatgagccttctctttcttggttatgtatatccggccatgctccttcatccagtcttcgaattttgccttcatggctggctcatccaccgcgttgttgccatcctcgtctgtgtcggcggcatcagcatcgacgatggcctcctccaccttgtcggaacatttctggtcatagtttggtttccccccgttcatctgaacgcggaggtaaccgtagtactcaggataggcgaaggcgccatctttccttgtgaaccttgccatgacggatggctcgatcacgtccctccactttacggtctcctcctccttcctggtatactcccaagctgccacaggtacaaacaggtagggaacgaaacaaatcagtgtattgaatagtaggctaagacatttaacggtaacctctctcaaacagtttgttggcggatggcatgagtcccttcgaccgaatctgccgaaacccatggcgaagaccacgagccaaggatgatgcgaggcgaagggtcgcacgagtgcacgccgaagaaggacgacttcgccatgccgaagaaggacgacttcgccaggaccggttcgcgccggcatccagcccagagaaggacggcttcgccaggtccagttcgcccccgcgagggccgaagtagccttctcggcccaccaagcttagagaccatagggacggcgatcgcccgatggcccatcaagagcccatgagcccccctttacgttatgtaaccctgtaaaagtcccctttcataagggcaactatgtaaattcctcagtacaacctagaccctagaagtaaaaatctgtaacggggctatcaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtggatgaagtggcgaaggcggctgcagcggcaagggcgcttcagaccagggcggagatcctttcggcaggacagctgctggtgccccctgccgctccgtcgcagccaacagtggcccaagccgcactccctgccgtgcaagttcaagtcaactccgaccctgaaacacaagccgaagccgatatggaaactattaggcagaacatggcacgactccaagacatgcttcgccaaatgcaagaacagcaacaagcgtacgaggcggcgaggcggtccagggtcccttcggcaccaatcctccaatattcggcagggtatgtcccgcctcaagtctgtccacaagtgcagtcccagcccgttccgccgcaagtctcacaggcatcggtgcacttcgccgggcagccggcagccgcagcagtgcaccaggccccctatggacaagctcagcagatcgcggcccaagtgtagcctcaaccacttggccaggtgtcgcaaaccgtagcggaaggggcttcggctctgcaggcgcaattccaagctttccttcagcaactcaatcagccccacaacatttcgagtacagctccctcgactcgtccagaggggagtacaggtcaaggtgcacctagttggttgccgccgaaccagccgaatctgggggcttcgccatggagtcagacacctcagtacgacttcgtcaatgccgcccaggcgcaaactgttcggccgcaaggaccgacaccaggctttggaacaagccaagcaccagcccaagtcgccatgacatggtcgcagccagttttcgacccatccatggcgacccagcaagtattaccaatcgcaaccgggcagccgagcaccatggctcaaactcacgcgcaagccgtaatttcacctttcgccacgccgtacccgcagcaaggtgcagcaaacagagcggggggcgagaaggggctgccgctgagtgggggaattaagaaccgcccaattccaccccagttcaaattcccacccgtcccacgctactcgggcgaaactgacccgaaggagttcctatccatctatgagtccgcgatcgaggcggctcatggcgacgaaaataccaaggcaaaggtaattcacctcgctctggacggcatcgcccgttcttggtatttcaatctgccagccaatagcatttactcatgggagcaattgcgcgatgtttttgttcttaactttcgaggcacttatgaggagccgaagacgcagcagcatctgctcggcattcgccaaaggccgggagaatcgataagagaatacatgcgtcgcttctcgcaagcccggtgtcaagttcaagacataactgaggcgttagtcataaatgctgcttcggccggtttgctcgaaggcgaactcacaaggaaaatcgccaataaggaaccacaaacacttgagcatttgcttcgcatcattgacggttttgcaaggggtgaagaggattccaagcgacggcaagccatacaagctgagtacgataaagcttctattgccgccgcccaagctcaagcacaagttcaagttgccgaaccacctcccctcgcggttagtcagcctcaaacggcgatccaagggcagccgccaagacaaggtcaagctcccataacctggaaaaagttcaggaccgaccgcgcgggcaaggctgtgatggccgtcgaagaagtgcaagccctccgcaaggagttcgacgcccagcaagcaagcaaccatcagccggtccgtaagaaggtccgaaaagacctttactgcgctttccatggacgctcttcgcataccacagagcaatgccgaaacatcaggcaacgtggcaacacgcaagatactagaccacagcaaggagcaaccgtcgaagcacctcgtgaagcagcccaagaacaacccccggtcgaacaacgtcaagatgcacagcgaagagtaatccaagtgattacgagggccgacccgctcggccatttgtccaaaaggcagaaaaagatgcagatccgagcggtccacagcatcacttcgacgggggagggggcgccgcagtatatgaaccagccaatttctttcgggccagaagacgccgaaggagtcatgttcccacatcaagatccactggtaatatcagctgagatagccggctttgaagtccgacgaatcctgttcgacggagggagttcggctgatgtcatcttcgccgaggcgtatgctaagatggggttgcccacccaggctcttacaccagcaccaacgtcactccgggggttcggcggagaggcagttcaagttctcggccaggcacttctgctgatagctttcggctcgggagaaaacagacgcgaagagcaagtactgttcgatgtcgtcgacatcccgtacaactacaatgccatcctcggccgtgcgaccctgaacaagttcgaagccatttcccaccacaactatctcaaactcaagatgcccggcccagcgggagtgatagtggtcaaggggcttcagccttcgcctgcgtcgaaaggcgatcaagccgtagtcaacagggccatgcacaatgtgaagccgaactccacagccggccaaaacacgcgccaaaacccacacctcacgcccagatagtaaaagtgcaggttgacgataaagaccccacaaagctcgtctcgctgggagacggcatgggcaaacacgaagctgaga

SEQ ID NO: 20626 - DNA, 497 bp, Oryza sativa
tgcctgtaatggttgggatgaagcctggtattcatctaaacagggctaacgtgccatctctaagaggtaacacgctagctccggctggagacgtgtgcctagaggctctcggcttgacgggacggggcgaggcgtgcgtcagaccgcagtcgccacctaaccgttgatccgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacagggggtcggggcacctcgtccctcggggccggggcaggagcaacccgacccccccttggggaaatcaggaggagggcggacacctcaccctcgggcccgacgtccccgaaggtgccaggccacgtgggcgattccatctgcctcaagcctccgggcgcaatactcccggtcccatatc

SEQ ID NO: 20627 - DNA, 1446 bp, Oryza sativa
agagaatccaatgtcgcctgcgcagtggttatgtaacgttagtactaagaaccttaacttcaaaaataatatacacgaaggatattggcctcttactcttggttgtgtgcgcacatgatgtactccttgtcttgatgggcccataaacaccggttgacatagtcaaccacctcagtgaagctctgtcgtaaattaacctcgttcaccatggatggatcaaagaacccaacctgattaccaaggcgacgactctcgatccaacacaaccttaaaacatttacgtattagaactaatttaattaggagatatagtccaatcatatcacaagtatagaaggtatgcacttacaaggagtagcattttagaagaccagtgtccaacttccggatcctgaaaaggtcgaagaggtcatcaaatcctatagttatataggcaggcgacgataggaatggctggtggtcatgatgtccaactatggatgactccctcattttccgcttggcattgcttagctccatgtattgcttatgtagctctcggcaagcaatacccatcacggctaacacattgtcctccaccaatggcatgctagctcaaattgggccggcgccctcacgaccttccccgctttgctcaccggcatcgacgtcacagccttgcccctttttggctccggcgccaactccccgaccttccccttgccgcgttcacgcttctggcccttgacaagtggtggggagctattggtctttcttgtggtctttattggagccaagctttgagctatatctgccaagtccatatcagctccaccaggagaatgaggtactgacaatgccggtccacggggagcctcaattgatagcttagacttgggaggtgtaagctccgtcggtcgacttggactcacaactatgtcttctttgggccattgtatgaacgtcttgcgcgcatcgcccaaagtcatgatttcatcattggggggcacgggcagcggatagcctaaccaggtgtcctttactgaatcgatggacaccttggcatacccagctagcaggtctgtgccgtggaccttgtctgtaaccaagggcttgaaagccatgccctcagcgacttcaggagcgaaagttgggtggactctcgccagtaggacacactgtgctgcgccctgcatatgtgaaagtttgaatttaatattggaacgtgtaaaggttttttattagatatggatcggataacatcaattacctcgatgtggtccactgcagctagtggtgcgaccgggagaccaggggctggcacctctgggatgcacaactactcctatgctgtgacggactcgcgtcgtgttgtgcacaagaagttgaatgcccaccaggtgttgtccctcagggtatattcatgtcggcgaggcccttgttaaccctttcttccaccctagcatt

SEQ ID NO: 20628 - DNA, 8308 bp, Oryza sativa
ggtaaaactgggagaagacccaaatgactggcgaaccccgtttgttaaatatatcgaaactggctggcttccggatgatgaagcagaagcaaagcgcttgcaaatcagagccacgaagtataagttaatctcaggccaactttaccgttctgggatgcttcaacctctactccgttgcgtttctttcgccgaaggtgagcaaatggcgaaggagatacaccaggggctatgtggcgctcaccaagctgcaagaacggtggcctccaaggtgtttagacaaggggtttactggccaactgtgttgaaagtctgtgcagagcagattaagaagtgcgagagctgccagcgtcatggctgaagtcaaaccgcgccccactatgacttgcagcccattgcgccaatttggcccttcgccagatggggactggacatcattggcccaatcccttcggcacgaaacgggtataagttcgccattgtggctgttgaatatttctctcggtggggccaagccgaactccttggtgcaattacttcggcagcagtacagaagttcgtgtggaaaaccattatctgccggttcggagtaccaaaggagttcatcaccgacaacggcaagcagttcgactctgaaaagttcagacaaatgtgcgaagggcttaacctggaaataaaattcgcatcggtcgcacacccgcagtccaacggagcggccgaacgaacaaatggcaagatcctggaagcactaaagaaaaggctcgagggggcagcgaaaggcaaatggccagaagagatgctatctgttctttgggccctgcgaacgacccccacaagaccaacgaggtttagcccgttcatgctcctctatggcgacgaggcaatgaccccagcagagctaggggctaactcaccaagggtggtgttctctgggggcgaagaaggacgcgaggtgtcgctcgaactattagaaggagtaagagtcgaagcactcgagcacatgcgcaaatatgccgtaaacacttcggcaacctacaacaaaaaggttcgaccgacagatctcttgcccggtcagctcgtcctaagaaaaaaggcgaacccagtggctgtcggcaagcttgaatcgaaatgggaaggcccgtacctcatcaagcacaaatcaaggacggggtcttttcggctggcaacattggaaggcgaggggctcgaccactcctggaatgctgcctccctcaagcgcttttatgtctagaataggtggcacccaaatcgccaacttgtaaaaatgtatatagtcatgtaagccattcggcactatgtacgcctcccggcaaaaaaaaaaggaaaaaaaaagaggaaaatgaaaaaagaaaaaaaaactggatgtagggttattatccgccatggaggcccgaaccagtataaaacctctgtgtcctctaccttcttttttttattgtgtgattgataacttgtggaaaaaccccaaggcaaacgcctgatcagcgaaaaagccaggggggcgaaacgaatcggccgaagcatcgctcgccgaacgttgaaaccacaacagcttgtttcggaaataactaaccgaacgccattacattcgatcagcatgaaagtaaaagcgtctatcgaaaacggaagacgaaagctggaaaagtcgaagcctattttgctaatgtatgcaaaggggccgacatgttccgacccaacgaaagcacgcgaagtgacaatgcgagaatagcgaaaaggaagtaaagcacacttttattgattcaaaaaaaaaagggaggtatcgaggattacaactcaaacagtgcaatatagatcacaaataaattacatcttcgccctcgtgtcccctttctcccctgtcggctaaagaatgatcgggcgaacaaggttcgtcgtcgctaatatcatacaccactctaaggggagaagggggcgaaacgcaaattatgccataacggcgccgaaagatcgcttcctgccgatcggtcttctgatgattccgccaaaagcgaagccatgtcgtccaaacgtcttgaatgaacaagatcataatcctccagggttcgctcagggtgactccgaagccacccagcaaccttgaaaaccttatagctgtgtccatttatcagcatttcacgatacacaggccgaaacgggcatcgcatcttcggcaaatcttttaaagccacaaatttctcgttttggtttcgccaacttccaaacgggggtcgaatacacagttttcggcgaataccctggcagataatgcagaaatggcaaaaaaccaatcgaatagtgagaagtaggcgaaagcataacaaggaccaacagtaaagggcgaaaggtaggtctgttatacatattttaaatgcccaacgacaacttagtctcggttacaataaaaaggttagcggcagcctgccgaatatacaacggttcgccacccctggcgaaccccaaaaaaaaactatgaaaatctaaagaaagggcggagggcctcacacctctgggtgatcctgggcatcacctccacccccttcggcctccacgtactcttcttcgcgaagctccgccgcctcagccttcgccagctgctccaaaaggcgcgccttagcggtcgagcggccgtccctctgctagaattgttttcgccacgcacgaagtgcgggcgaaatgtcttgtgaactgatttcccaatcccctttcgcgtagttggggaactcggcgacatgctcacagccgaactgctgtaggaggcccgtggtaaaggccgcggacacgcgcgcacagcagtcgccgtacgcggtggcacagtccgaaaccgaaccaccagcctgctaggtccattcggagaagtcaaaggcagaggcatcttcggaagggacacctcgcactttcgcgcccatatcggtaagagcaaggcgaagcgtttggcaagctgttcgcgcggactcggtagttttcaccatctcccgtgaaaaccgccgcgactccgcagcagcgcttgcctcggccttgcagacttcctgccgaagagcctccatcttcgactcggtaaggttgtagtaatccacaagcacggcggagtgggccttttctttttgcagttcggccttcaagcgttcgacttcggccctagcttcattccctttttccagttccaactggagccgcttgttttcggctttcgtctccttcagggtgttagccaggacctccatctcaagatttttgcggcctatttcgtcatccttcgcccgaagacggcttttgaacccgtcaaggcgggctcgcacggttcgctctgttgaacagtgagccgcaaggatctgggcgcaaaacaagagcggcgaagagagcaagtgtcagcaaaagcaaagataagaacagagaaaaaggaggggaaagacgtacccgaaccacaagactttttatagcggagcacccctcattgaactcattaagttcggtgaacaggctcggggtgccggcaggcatgattagattgctcaccccttccacaaaaggaaggaggtctgcccgtgtctcgaagtcgccgggggcgaagcggggcaccgcaagcgaatactctgacgcggacgtttcgccagccgctctctttcccttcgcctcagtcagcggcgatgcaattggctgacgaggaggactgccgaaaactttcgccgcggccgtcacgatcctttccgcggaggccgaagccccagcggcagtgctaccacccgctccagtgccgccaagtggaggagcgggagcggctgagagatccaggctgcggccagcgggcgaagtcagagtcccgtcagaggactcatcgtcgctaaaaactcgagcgatatcgacaagtcctttctttttagccgccttcttgacggggcctcccttcgccgccttgccagaggagaacgcaaccagagccttcgccacgtccaagtctttttggcgaaggggggagctattcgactccaccccagtctcgttatggccaggacttggagtgggggtataaccgggagtttcggcgcgtccctcggtcacctcgaccgcggcattttcgaccgcggtctccgtctcttcttcctccccctctccctcttcgccgtcaagttcttcgccatccttgtcgtcagcgtcagaatctgatgaaacaggagccctacgcttcctaggggcaagcttaacctgaccgcgcggccgcttccgcgaaggccctgcttcgtcaccagccttatggggattcgcccgaggaggcaattcgccgttaaaaacccggttcgcccgaccagttgcctgccgtgtaagcatttggctgtactcaacgaccgatacgtcgccgatcatcttacgggcttcggcttcggcttggtcaagggttagcactgcaaaggaaaggaaaggagtcaggttaaaaggtcaagcagagagagctaaagcgcgaaagtatatggcgaaaacagcagacttactgttcattccctcagggaggaccagcttaggcaagccatcaacctcttcgctcaggttaaccgcaacctgccatgactgggagaggggaaagatgcgaagcatgcagaactcctccaccaggtcgcggcagctgaggcgggaacagactttccttagcagggcgaaccgggcctccatagcgccatccacggcgatcctgggttttcgattcggcgcaataaccctgcgccgacaccgaagagctttcgctgaatcagagccggcctcgaaggggatggtgtggtaaaaccacctcgccatccaatggcggtcccacttcgacatggcagcattcgctggccaaaggtcggaccgttcggggcgaacattgaagttcacgctcccgatcaccgtcttcttcgtcccagccggagtaatcaccgtcttggagttcacggtggcgaagaatatggcgccgaagagagcagcgctaggttcgaacccagaagtccgacaagcccaatcgaaaattgagatccgaaccagcgtcgatgggctcaattgggggagctctacctggaagaggcgaaggatctccggcaatagcacgttgcacggaaaccgtagccctgcctcaaaaaagacggcgaaaaccaccgtccgattgtccacaggcttcggcaccacagctttccccggggcgaaagcctgccccgcaatcaacgccccagagctgactagtttcgccagctcgtcgtcatccacaagggaggcccccaaaaaggtggtgttatcgtcgtcgacccggccagggtccggtccgaccgcctgaacggggtttggtttgcgaggggccatggcgaaaggcgtgtgggccgtggcgaaccaatagggtaggcgaaacacctacggattcaagaaacgctgtggaaggagataacgaaggaggagagcgcacgcagtaaaagtggcaaagtgtgacggtgaaagggaaaggggtgagaatatatagcccaccgagtcgacgtttcgcataccctccaatcacaaagagccacgtggcgcgagggtaggcgtaacggtaaaatcccatcatccgaccagcacagtaaaaagcccattaagggaaagcccaatactgttcacttcggcccggaaaaagtaatgatattttatttgcaggaacagtacgggtttcggcaggagcatcgatcgaaagggggcgccacataccataccacatggtttgcacggtctcggccgaagctccgctctcacccttgcccgcgaggggcttgttggcggatggcatgagtcccttcgaccgaatctgccgaaacccatggcgaaaaccacgagccaaggatgatgcgaggcgaagggtcgcacgagtgcacgccgaagaaggacgacttcgccatgccgaagaaggacaacttcgccaggaccggttcgccccggcatccagcccagagaaggacagcttcgccaggtccagttcgcccccgcgagggccaaagtagccttctcggcccaccaagcatagaggccatagggccggcgatcgcccgatggcccatcaagggcccatgagcccccctttacgttatgtaaccctgtaaacgtccctttcataagggcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgacaacacagttaatagcggctaaattgtaaatgagagtaaatagctagactcttctcaaacaactatgggcatcatcttttcacttatgcttatcaggcaaaatttgaattttcaatattaaatttggagctgattttgagatttttttcatcgaagtttatttttcagcctttgcttttagatcgctaagaatacgtatataaaagttttattgataaattatttttcgtttacaaataagccgtttcgcttataccgccaataagagaaacaatggcttcgtatgtctctatatacatatataatatatatagcggcagctatagccggaaatttaaaacggcgaggaatctaatctaacggcactttcaagaataacgccatactatacatacctgagtcatctctatcttgcttgaaatagaggaatccgagcagcaatccagccaacgaactcgtcaaggcaagagcaccttttacggcgccatggccgacgccgagatccctctgcgcggagagggacgggagcgtgagccgctgcgcgcgagtgatgaaattttcgatctgagatcagggggggaaacggagagagactcacgagggtgcggagagcgcgtggcttcgctggcctagtccccgccgccgccgccgatcgccgcgcctgcgcgccgcgtgccgagagcctccggtcgaggagagatgcgagtgcgcggaggaacatgggcctcgaaatctcgatcgatcggaggagacgcctcgatttctagggttttgacggacttcgctgtgggaggagtgggaagtgcggatgcgcaacgggtcgaacggatttccgacaaaatccgatcaaattttgtcaaatcagatatttaaaatccagtttgattttcccgtcggtttttttgtaaacacctgaggagggtcgcatgggccgtgcgcacgcgcaaaattgggccagtatgggcttctacctttccttatagcgcgcgccggtgcaacttggacatccacgtcttgtgctctgccgtgccggcgacggcggcggcggcgctgccaccgtgaaccgcgatggcgggcacggcgatgaagaactccttcgcgccaacatggccgcatggctaacgaccttgtcatgagaaacaccggtctagacctgatgatcctgttttattgtgaatatatacgccactagactattagtaaaaatgcataatttttacaggcaaaacttgacatttattagtacacatacatcaactatattatctcatattagttcttagcgtacacatgttactttggattttggagaaagatgccaagtagctttcgaatttctgtttaacaatgtccggaatgtttaaacgcgtacagttttgaaggcaaatactatgtgggaataataatatcgaacgaagcacatcccagaacatataaatcaattcttgccagtcttcagtacaataggaacagtagcagcagcctactccatatttcagaattcagacagatcctagtttctgataccgcatattgacaggaaaacatttacctctaatcacctagcaagtactatagagaaaaatgaacagaaacaaaacttgatattggacaacttttgtagacagtggctctaatcatagtagtcttcatctgtcagaagaaaaagagaatgctttcattagtaatcttaacaaaaccaccagtagtccattttaggaagagagaaggatagatctgatatgaatagaagttcaaatttaaacttacgtgcttcctcctcttggttccagtcatcatcgtcgtcatcaaactcgatattctacaggaagttaaggtattagagtgctaaagagatgataaattacaattccaaaaaaaaaaaaaaatgattcatatgtgttccaacatgtgaagaaacatacacaccacatcattttgccaaaaaatgagccatctaatagccgtttttccacataaatgaaaacctcaaggtgtaccgggc

SEQ ID NO: 20629 - DNA, 3420 bp, Oryza sativa
caaaaaaaaaaatcaagattaccttggactagttccacagggaaatttgcaggagttagtataagatatgacgcaagagcttcacgtttggaatgtgtcttacgtttcctatcagaatacctttcaatctctttatcatcattctctgatgggatatcaacacacaaaaaaaacttatcagaaatagctctacaaaagcaagcacaaatctctacaaatgcaaggaatgaagcaaaaccagaggatgcttgattgcttggaaggaaaaaaaagaggctgaaatgttcattaatttgtaaaaatgtttcaatggagatatagatagggctaatacaaaagaagagtaggtactaaaatgatgaatttctggttaaattgagctcgcagggaagcaaggcccaaaagaatattatgatttatggattctaggccccatatcaacaccaagctgaatgcaagagaaagttctctgtgcatgtcgaagtcaaaattatgtagtccatcaaagttcaacaatatataggaaaccataacaggttccactcagtaaaacagacagtcagtccaaataagccagagctccagtaaaacacttcagtacccaattctttgacccaacaactcaaaataaacatgaattacttcttgtaacatgtgttaactatctgacctatgctacatatatagtcgatttgtattaatcgagaagcaagatatcctaatgggcaggaagaagaactaagcattgtcacgataagttgagccatagtagtacttttcttggggacatcctcctccaggtggtagcaagaagtcttccagaaatcctcaaatttcaaggtggactgtatcagagccttctcctccatggtcgccctggcgcacgtcatctccggcagggtgatgtcctgaatataccgacgcccaaatccggtgaatcgccccaaaaaaaaatcacaccacgagcatggcgaaaatcgcattcagcagcaacaacgagaggagagggaaagaatgggtgcagggaagtgtggggatggcggagcggggaatggagtggagaggagaggaggttcaccgggaaatcctcgtggggggtgtgcttggccgggtggtcgaagccgtaccctcctccccgcctcccccggcctctcccgcggccccgggacgccatctggaggggggacggatgtcgatcgaggcggcgaacctctccgcgcggcagaagcgcggccggagaagagaacagcggcgcggcgcgaggggaagtgcggcgtcggcggcggtaccgcgcggcgtggtggtcccgggctggctgtgttagggtaggcggttgggctttttatgggcctcatggtgactattgggctttgcgagctaccaggttgcacgtcagttcggctgtagatggaataagttcgagcatgtttattttgagggactgtctgaaaatcattcgacagatttttagtagaaaatcagtcggattttcaagccaccacgacgtgcggttcaaatgaaaacatatccacgtacgtcagtcaccggacggtaatcacgtcaatgatgcttaaagaaaaggaaaaacaagcaacttacatctatttacatcaacttacatatataattttaaaacttacagtgtaaatacaccgaaattacatatgtaattttgaaacttacagtgtaaatacactaaaattacatatgtaactttgggtacttgcaatgtaaatttattttatgaaaaatataacggtatatatagtcccaaaaatatcaaatcacacctcaaacaattaagttaactatagtgcaacaaaacaacgatgagtaaaaaattccgtacatgtaaaacaaaaattacacccgcatatacttaaaattacattgtaattgtagtgcacttacgttttaatcgtggtataactatgttgtgagtgggtgtagtgtaactgcagtgaaagttttaaaaaaagttacgcatagaaagaaagtagtcgtttgctgcttgctcagttggtacgatgcatgtcgtagcatcccgacatcatgggttcgattccctgttctagcgacattttttttttcactcaatggcacatacacgtatctcaaagtaaatcatacggtcaacaaatcgactgatttttaacagaaaatctgtcgccagatatgtagcaattccgttattttgatgccaaaaaaaccttaccaaattttggctatggcatagttactaaaattttggcagggtttcttatatagttaccaaaatttgatagcaaactaaatatagccactttttgtaactttaccaaaatttagtaaggttaaaaatagcatcaaagtgaacacgcccttcattttaggtccctcaacttgccagcgaaattgatttttatatccttagaccgaaatatcagatacaacgggtcattaactgttaaaaccgtgtaatgtaggtccgacagaagtatgacatgtggttttgtccgacgtaaaaatttgacccgaattaataatgttgagtcagtgtgagcctcacatgtcaatgcctcttcacctatatctctttgttcagttgtgactgagaagcatggcggccggcgacgggtggtgaagaggacagtcgctcacgggaaaagatagctcgatggaggaaggacaccgacggtggccatcgatgacggcgatggcaaggcagactagaagagaggcaagatccgggagcatgacatcgtcctcccctcacccctcgctcccctcgcccgttcttcccccacagccgcacgggacgggagccggcctcgccgcccaccggaggcagcgtcctgtctcgagttcgctcagaagccgcttgtcctcctcctctctccacgaccccatccgcgaacgccgcctctaccgcccacatcaactcctccacccacatcgccgcagaggtgggtggtgatggtggctgttgcagagaggcgcaaagaaggctctgtagtggtgagcccttgccggaaccaggatagccacgcagacttggaatagggagacctctagtaatgttgaacccgagagcctatcggcggtggcgcgcggcgcaaattggtagcggggaagagccagtggaggaagaaatcggggcgacgaataccgaagtcaacgggtggaggtcccctccgcttgccggccatcggccatggcttgagccccacccttcctcatccccttactcctcgtctcctccttgctcacgccttttgccgcagtggctgcattcgtcggcctcgagtccttcctggcggcggtgactacccgcgacccctctgctggcaataacaccttcggcgccctccccaccccggtcctccgtcagttctcggcctcttcaccttcttcagatgatgagctttgcagccccacgag

SEQ ID NO: 20630 - DNA, 2365 bp, Oryza sativa
caataagaaatgggatgagaaatttgattagttcgcagcaaaaaaagaatcatgagctaagtttaaaatcaaatactagcagtacgagatctaaattggaacatatagttatatcctgtttaaattcagaactagtttactaatttacatgatttcttatatgtggatacaaggttacaagtcaaattacaatacatttctgataaaaattacagaaaaaaactattgtaatttttggttgaaagcattttacctgaaattacaaattttagcagtgtacattttgtgaaaattagcaatacaatcaaaataaacttgtaatttcaaacaatgtttacagaaagaaaattataagggttgccaccaatcatagttgatagattatttagttgataaatttttggttgaaagcattttaaacacataaggtttagtatatttgaaatttgcaagttgataggtgctaattggcacactctaattagtacactagaatatagcagatcttggtgctaaaaagaaatcaaacagtttttttttttaaaaaaagtacgtttagttgaaatgccacaaaaggtaagatttgtggaaacatttggaagatttaaagttgttggaacaactaaaaaatacagttaagttgttggtaacaatatttgagtacatcttttagttttatcccaacaaatattcgattacaatcgcttaattatttgaacattacatccataaggcgtacagaaaacacaggacacgaacaagggatttggatccggtgcagttggtagtgtgactgcaacttatgcagtccactatcagctgttagatccggatccaagggctaacatgcgtccgggtactgtagataactgtagcaacattgtttagtactgcttttacattcactgtagctaaggatctagtccgttcatcaacaaaatagatggctccttttgcttgcagtagcttaacttgcagtccatatacaaactgcatgcgatcccaattcacgaagaagatatactaacagacttgccgatcgattcgatgagcatatacggttgacttgacttagcctataaccccggtggatcgaacaacgggttactacacattattggaggaaaagaaagttcaaaacggaattgaaacgacaggtgatcgcacacacatacatatatgacccaaacaggcctggtgatcatcgacgtggcaattaatcgaggaccgcttgaaggacgtcgagcaccggcgatgccagcccgccggttgctaggtcaatcgctatcatgaagcttttcttgaggagaaacttgctgacgctagtgctgcggctccgctcaacaacagcagtagtgttccgagcatcactggtagtttggttggcaccgctgctggtgttgccggtgccctggccacggctgctactgttgttctggttggtggtgctgccgctaccctgaccgacaccgcttggcgcgccagagacgcacccgatatgtagccgataagacggagacgtacaagggccacagatgtagtgccacacgggcaaacgttcagggcaagcattgcagtgccctgaagaaggtaccatgttgaggtcgtggtgtgggtgaagcgggctccggatcgtctgagggagcaacgtgcacagggggtgcacgtcgaacttgcactgtatgcagcggtacacgaaatttcctgggggacaatgctccatgcagaggtcacatacccatcctttattctcaggaggcatgcggcagagcgtaagggtgtgccacgggtgggcgaagaagaagatggtctccttgaagtagtcggcgcacgcctcatggatgtcgaagtcgcaggcgttgcagcggtagccgacgaggccggagagcttggcttcgcagatgtcgcagacatggcgcgaggcgctgctgtacggggtcttgagaaggcggtgttgtggatgggcgaagtgtgttatgtgggcatcagttgccatgtctttggctacgctcagaacgcccaatctctctcttggcctagtttttggctacagtactgtgttctactacttagtatttctatagatcgatcagactactccacggttagtgtctgcctgtctggcttcggcgtgcctctaggcgctcagcatacatttataccatcttcacaggctcacagtctactgcagtaattaatgatgtggtgttgtttgactcagtgcccatttctgtatggaaaaaagtccaaattacacccgctaaattattagacgagtgcaaattaacctcctagacacaaaaatcatacatttttcactctcaactattacaccctctaaattattggatgagtgcaaattaac

SEQ ID NO: 20631 - DNA, 941 bp, Oryza sativa
  unsure (1)..(941): unsure at all n locations
tataaatattttcatgaacgccatattaatattaatattgaattttttattgaattaaaatccccttaacacaatccaaagtagttttggtcctatattatgacagctcaatcaataattttcataataaatcagtggaacccacctgtaagaagagatggacgggtcctaccaattttttttttaaaaaatattgactagtctatcacataagagcaaaaccaatctaaagtctaggtggtaattcttactcactcactagtttggaggtctaattcaaactttttttcctttccctaatccctagtaccaattgtttcagcgtattatatagtaatatgaccattgacaggtcgttcgtctttatgataaagagcattgcaatagaaaaaatagtcttatatataaacttcttccttataatgatttcaacattttatttaattagtcgcgagttataaaaaaaaaatcaagattcgttcataacgtggcacaatcaacatttttataagaaatttgtatgtaaccaactccactaaaaaaaattaccgcatattctctctctctctctaaacttctgtctttttgagcgggtgtgctgggagcctgggatggccaaactggagcctgcagtttcaagataagcttcgctcgtgtgatctatggtgcatgtttattatgcttttttttacaaacacacgtttactcacccttataaacacacgtataccatatttctacgtgcatatccgaaaaactggaccgacacatatttagattgatgaagttatcatgaatgtccgnnnnnnnnnnnnnacgtcgcctatcactgaaaaaataaataaccataaatgcgagcatccgtgtcaagtctaggattttgaaatcgggtagattgattctcccaaaggaacctaactaaatgagctatgctcacttcg

SEQ ID NO: 20632 - DNA, 7081 bp, Oryza sativa
cgaggatgtcgacaattctgagctagcagttgttgatggaggagtaacatacaatggcatcatcgatgcaatgggagaggatatcattgtgcatatcattttcaaactttctcttcggcattgcttactcaagttctaaccaaattatttgttttgttgaatgattgtaggttggaccgtaggaagagcaagaagattacggactggcatgctcatcatctccatcttattgagcggggggacaacatagcagctaacgtagtgcctcacggagtggagcacaacaagacatacttcgacgagtacctagcttggctcctgaggaactaccgccttttccttcggccggcatggactctagctgacatagctacagatcccgaggatgttgaggagatgaacgagtatgacacccacactcgagcaggggcgacggtcgagtacgggcctgtacgtgaccgagtggtaagtattaaggctcagagttgttcatttcacatacacctacatgttctcacaatattaaatccacttgcaggcacgtgagctgatgaggtccgtgaacgacgcgggtgttgcccttggcacacctgctgggtcagagaatgaagttgggatacttcggagcgcacttcaggtaattaaccaattagttcaatccatgaatcatttcacttgcctctaacttatttgttttgttcttgcagaggctaaaacaacgaagtcggatgttagcggcaagacttggttgtaggtccacaaacgcagtcgacccacaaccaagactaacgcggacacaggccggagaaacaagtcaacaaagagctgaagaggaagggtaggaagaacatgatgaaggggaggaagaacatgaggaaggggaagaaggagatggacagagtgacgaagaggaagaggaacaacccgaagaaatcgggtcatctcagcttgcaggtgccccgcagccatcgcaaccttcccaaggtcgcccgcatagaaagagagcaccggtggaccggtacacaccttccactagtggccggaggggtcggcactagtggattactttgtacttaacactctaagcagcgttagacttatatcaaactttagatgatggttgatggatgtgttgaactctatattttgtgatggttgatggatgtgttgaactctaaatgctgtgatggttgatggatgttcagttgctgtgatgtcttaaatactatgtggctgtcaattttatgatgctgtcaatttctgtgtggctggctgtgctatgccagccactgcttgacctcagcgccaaatagaatggcgctgagattgtgcaggtcagcgccagagcagttggcgctgaggtgcacaagatcagcgccaaggtctttggcgctgagatgcagcccactcagcgacccagccatccctcgggtggcaacctcagcgccaaatcggctggcgctgagattcagcccccccaaacgtcagcagacggccatacaccgaaggaaacggccgtcaagtactcagcgccgatgcggttggcgctgagttgttcaacctcagcaccgtcggccttggcgctgaggtcggggtccagatctggtgatagtttttgccagggaccaaatttgcaaatagttttcaaaaagggccaaattgtcaaattttcggttgatcactgtattgttgcaatatccctccacgatcaaaggcttactttgggctcggtcgctccaatcaattaagagattgactctgaggttgatgatatacaatgttcaattgcgagattagctatcgagactaacgtatatagatggtgatacttggaaaaagtctatcggtccctatctttttcaagataactagcctaaagccgcacgttcacgcgactataaccaccctcttttattccatgtgtttacatgtttacatcaattagcttaattttataataactactccgtattaacattgtgaataagtatgggtagaatataattgcatgaaggaacattaacaaatttatcataatttgtaactaagaatataatcataacaataaataatttagcatacattaccgtgacatttaccacaatctgctgaatttctaaatgtgtcatttgaggtcatattgtaaatatgttgtaatatgaaaagcccaacccatcttttggttgaacgaaacattgagtgcaatggctacagttatggtttttattcaccttctgtgccgctgttttgtcctgagcaatgctacacgtacaaaatttttcttactaaacatttactaacaatcatctcaaccgtttgatttaagtagatggaagttataaaaaatctagatgcactcatagcatgacatatcagtgttagtaagaatttagtaagaaaaagttagtacgtatagcattttccttttgtcctatctgtggaggcgcagccataactgcccacttcgctgctgcttgagctccgaccttgacaccttgttgccatctccccggctgttgcatgaccggatgaaccccttatcccctcttatattcaacagtaaacgatatactactaacacatagttaattaaagaggaatatgcaaatggtatcgcacatccagccataattttaatcactaactacgatttactttaaaaacgactaaagtaccactctagtaagaaaatgggaaatttagttgtgtggtaattgcaatgtgctcaaaatagagctaacatgttaaaagagcagaataaagtcagttcgggaggattattatttctatttctcacttcttctagctactttcttcctgtaagcagaatgaaacgattagtatttgctcctcattttttatagtcaaactaaaaattgaaatatatcgttgtgttaaaaaacaatgaaaatggctggtccaacatgatagaatatattgtgttcctataagctgcaaaagcattaacatatcttaaaaatgcagaacaatgcttctaatttgtaaactctaaatactacggtcattaattattatctgctatgattcaagagtctcacttcggtgccttctacctagagtagaaaaaatctgaaccgctgatctcatttgatccaatggttcagatctatttttactaccaccacacttaatggtagtagaatcgtggagggtacttttgcccaggaaaaattatctacggagggatattttcgtcctttccccccgaatcgcgcatctggagccgacacggagagaaccccgcggctcccatcaccgccttgacgacctcgcctgctccactgccctcgatgcctcctactccctcgcccccgccgcactcgccgcctcagccgccctcgacgagttcgcatctctgtccgggatcgccagagctgcgccctctcctaccgctcccccgcgtcggcccaccttccgacgagttcgcctctcggatctccgcctccgatcccagcaccgcgccaccggccgccgccgagacctcgtcctcctcgctatccccccttcctcgtcgtcggcctcctcccccatgcttggctccagccctgtccatctccgcccgccgttgatcccacagccgcgagggcaagcccccaatccatatcctcccaagcggaacccgcagcctccggagccaatgaccaccaatctctcgacctccgaatcatcatccaagactcctctcattggctgtagcgctgctctccaacggattagctgacatgagagactctttttctgctttgcaggtcagatttgatttgtttttcttgctgcttgcaggtttgcagatcgaacatctgcactgaatcttcttttttcgttggcctctaattctcgaacagtttttctgcttgtctgcagttcttggtcataatttttcctcctaaaagaagggattcaagttgaatgccagtaaactgaatccggagcaagtgagcttgttcaaatgactgagcatgacaaggtggacaagctaatgatcactacgtcaatcaacgcttgagagattcctggtgtgctatgtcctgtaattcctgtgaattcattatctcaagatggctttgggtggctttggcttgttacttatggccatgttttttttcagaactatagcttattaacagcttgtggttttgaaagtacccatctgtgtatatcatcgtttttgtggttcaatgtatattacttgttgtaattgcaattgtaaagtctatgtaaaaaacataccggattattcttccgttgccttgtatctgtcattgctggattggagtgtttcgatttgtccatcgtgtgtaatattcagatatataactaatatatttaaatttcatatgaaacaatcaagctgaatggaaaccaaatacctacagcaagaaacatctatggaacgcgatgcacaagcgccggcggtggccggacctcacgatctacttttctttttctttccctgcgctctcctttttgattaatgaggaaacggcgactctgctgttcgatgaagagggatcggcgacgcttgaccataggacgcacaaatgagaaaaaaaaattaagtgccagatttacccctattcggttttagcactttactaatctaccctttaaaataaacggttgagattaattctacttggagtagaatactgcaagtagagggcaacggagcgtctctcatgattcaaacatttataatttgatcttccaatttttcagaaggtaatttgtcatgtctaacacttcagcaactccttaatttccgaatacctattattagcaaggagaaagaagaacagggttacctaacaaggattaaatataatttgaaggacagatctttgcccatctctatatagtaaacagcatgtgtgcattcatgacaacctaaactttagtactgctatataaattggcgtaaagagattccacactgaggattaaaaataattttaaggacagaggtttgtccatctctaaatacttttaaggtaagtttatgacaattcaaagatcaattaattaatttagaccagttccaatgtcgatctatataattggcaagagatatatatgaatatagtaacacctattgctccaaacaaaaatgtgaaactctgaattaaggatattatatatctcttgcccttgactaaatcataggccacgatcagtgagctagctagtgagccagtgagcgtacacgtcgaatcattttttttttataatgaaacaaattttgacctttattttgaagaagctataaccattatgtcggatcgattagtagtgcacgtatatatgctcacctgtcaaatcttgatttggtaagtaacaaaaacacataaacataaattaatatgtcaattagcaactattcgcaataattaacctattggcttagctaggggacagaaagtggtggagctagaaaatttataaatcctggacaagcctaactaaaacggtaaaatcactaccacttatttaatgtttatatgctcatttcactatcaattgagagacacaacaatattctaacaaaaaaaacaattcaatatcatgctaacaatttcactataggctagaaacagcacccattattcctattataaacatacaccaattcatatccatgctaattcattcggtcacgtcctccattactatacacgcaaatcaacaacgctgtttaagccctaattgtatgactactgaaaattcacccttctcaacttgtcctgaagtacacgaatcgatcagattctaaaatacataaataactctcatctctatagctcagcatgcgcagcccgggcaactgcccatgttggccaggtagttaattaatctgttgctggacagacaatcatcatgggcaatctggcagttgacaattaacaatgcccactagcattctactcctaattatatagcctacttgtctctcccattgcggattttgctcaaaagtactccctccgtctaaaaaaaggcaaaccctgagtttccgtgccaacgtttgactgcccgtcttatttgaaatttttttataattagtattttcattgttgttagatgataaaacatgattaatactttatgcgtgacttatctttttaattttttcttaattttttcaaataagacgaacgatcaaatgttgtacacggaaaccatggtttgtctttttttggatggagggagtatgcatctatgagcaagttcaatagtatagtccaccactagctccaatttatctatagccgatctaatagccaattcatacaatagttgcttactatactattaacatatggtcccacctgtcatacacacattacatcttggagtccgtgctgtagctggctacagatctgtagcccgctgctcttctctctcatcttttatctcattaaaatatgtttataactggctagtagcccgctattgtacgtgctctaaaaagactcttcacagtagcaagctagcatagacatcttgtgtcgttcttctccaatcctaggttatacatacctttggttcgtcttcaaggctcttaattggtcgttggttccgcgcgtctttgagacaaagttaggtaaaatttttcacactttgcatccaaattagtttgtttatatagtaatgtgtcggtgatatgggaccgggagtattgcgcccggaggcttgaggcagatggaatcgcccacgtggcctggcaccttcggggacgtcgggcccgagggtgaggtgtccgccctcctcctgatttccccaagggggggtcgggttgctcctgccccggccccgagggacgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcggctggcagtctgacgcacgcctcgccccgtcctgtcaagacgagagccactaggc

SEQ ID NO: 20633 - DNA, 6445 bp, Oryza sativa
gaatttcggacatccatttctcaatctaacgatagttttcaagtttccactacatatatagtttgcactacatattttccttattgaaaagactcttcacagtagcaagctagcatagacatcgtgcgtcgttcttctccaatcctaaggttatacatacctttgggttcgtcttcaaggctcttaattggtcgttggttccgcgagtctttgagacaaagttaggtaaaaattttcacactttgcatgcaaattagtttgtttagtaatgcctcatagagtcaaagcatgaactattttctccatattttcatatatacaagcatattgcttgtgcgttaaatatacagtacatgttgtacaaacgttaaattgtaaatgttgtgtatacttaaatgtacataaaaatattttaaaaaattgtgagatgtgcaacatgcatgtacaacacgtaaaaatgttactcaaaattatcatatgcggcatgttttgacttagtttctacttatttttaagtctagctaactctcccttagtctcaaaataactttactttagcctctacctcgtgtcaaaataagtttacctttatcaacttacctatatcatgctctaattcacaattcgatgattttttttattccatcaatatcttttacctatccttacctacctatctacctatccacacatactagtttcctattagtgagtgacactttggtgttttttcttctatattgttttgaacatccaagtctaaacttaaagttattttgaaatggaaggaccgaagggttattatcttattaaagtgtaatagcaaagaaataagcttttatgtttgctctcaaattacatattaatatgagaaaaaaaatctaaaccattaattatagggtggatctaaaatatagctgtgtggatttattggatgcgctcttcatgaaaaacaaactccatatctccaatctatattcaattcaaataaaaatctcaaacgatgccatacacattacataaacattttcacaccacccacaattatatatgcatattactaattattatttatctaattacattacttagtttgttctacggaaggttaattatataattactcaacaaattaacaagcaaaacaagggctaaaccatcacttctgtgaccatagagccaaagcaacacaactctatagcagaccttatctttcgtggataataaactactaagccaatccgctcacctctaacggatcatcaatgacggtttatgaagttatctatgataaatagtctatgaagttattgttcggttttgtgcatatagtttttatatctaataaggcttgttcaggctaaaaaaattcatacgcacgtcactgtttgaatgcttttcatctcgagagcaaatagatgtttcttgctttatatatattgacattatttttaaagatactccctccgtccctaaatatttgacgacattgacttttttttaaacatgtttgaccgtttgtcttatttaaaaaatttaagtaattattaattcttttcctatcatttaattcattgttaaatatacttttatgtatacatatagttttacatatttcataaaagtttttgaataaaacgaacggtcaaacatgtttaaaaaaagtcaacggcgttaaatatttagaaacggggggagtaaaaaaaaatactagcacaaaaattttaacatcttttgcatctccaagctaggatggcgagcatcatcacccactcctcgcacccagaacaccaattacgaaagatgaagctcaaatatccatttacttgcaacttatgcaactatcccggtgctatcagttgctcacaacaatcacctatataaacacacacatcttactgtagcgcatttaggatgtccgtaatatcattgacaatcaaattcaccgccagttgccgggcaaacatgatcagaaacctcacgatgggactgccaccgctgccgccccagccgccgccgccgccgccggtggcaggccaacccctcgtaccagctggagcaccgccggcgccggccggcgaaacgcagccgatgtggagcatgaacaagcataggccgcaccggtaatgccagatggagcagtccaggcagcacgccgcgcactccccgcgcgccgggaccaagttgaggacgtggcctccggggcacccggcgccggcgcgcggccgggtggatggtcatcggcagcagcgtgcacagcgggtgcacgtcgaacgcgcactccgcgcagcggtacacgaggcgcccgggctggatcggtccctggcacaggtcgcaccacccggggttcgccgccgaggcggtggccgcggttagcgggtgccgcgggtgcgcgaagaagccgtcgatcgtgtcccgggcgaagcggtcggcgcaagcctcgtggatggcgaagtcgctgcagtggtggttgcagcggtagccgacgccggtgacaggtagctcgcagatgttgcaggcacggtggctctgatccgctggttgtatgtgcacctctgaagctggtgctgtggatgagcaaagtgccagcggttttccatggcaagcaagtagtcacacgacacccggtgggaagaaaattatgtcgggccgaggtcctaccctcctcggaaagacttgctcctttatgtgacacctgtcccacacgaatctcagaacagcttactccctcgtctttccagttccccattctcttcctttgctcggtgaggcggcaagctggcgtccgaccagcgagctttagcccgaccgttcgcacgggcgcaccccgtggcgtcgagcagcatcaagtccaagctcgcgctgtcaacttgcgtgccggtagtctgctagaagaactctcatgatttggacgagactgcgctgtcgacttgaatttgttacatgattattcactcattcgatttttcttgcctcatagcgaaattattcaatgatttgatttttcttgccattgaatttgttctgtatggtagtactgcactgataatcattgcttgtgttgacttgaaggatttcttctttttgccgggtgagcattttaggattatagcgttaatgtattgatgtttcttctcgacgagcgcctcatgcgagcttggatgctttcacgttactgatatcgtttgattccggcgacagcgacagcctgccgagcttcatgccgctcacccgctggtcggacgcgagctcgccgcctcaccgagcagaggaagagaatggtgaactggagagacgagggagtaagctgctctgagattcgtgtgggacaggtgtcgcatagaggagcaagtctttcggaggagggtaggacctcagtcctacataattttcttcccgcacggtgcaggagcagcgtactgtttttacgtattactgtacgtgtttctgctcttcgtgttgcgcttgatattccggggtgcgattgcgaatatatacacagtaacacaaataacttgtttttttttctttccgtttttcttttcgttttttttcttgttttttttccctggtttggcgtttctcgttttttttttctttcggttttttcttttcggtttttttctgggtttttccccctggtttctttcagttttaaacttatacgtatataaattttgtattcgtgcatatacaaagtttgtatatgcactactttacatacgtacgcatacaaagtttgtatacgtggtgcttttttcttggtttttggttttttaaatatgtatgtatttacgtatacaaagtttgtatatgtgctgtttttatgttttttcttcgttttcgggtttttaaatatgtatgtatttacgtatacatagtttgtatacacgtacacaaagttttttatactccagtgtagcagtagtactagtagtatactagtatagtaatagcaactgtgtacgatcagtagctagctaccagttccccaatccacgtcgctctcgaatcctcgcctgctacagttttttccttctcgattccggcggcctcatctcccgcggagggagggaaaagggtcctcccccctcccctagtatagtttaatagccgggctagtctcgttaggtcgggttcttcctgttttttcttctcgttggtgtggtatggaggttggagacagcggcggcgttacggatgtagccaaactcggcgatggcgacacgaatacgaccgaagatgacggtggtggcgcggatccagttcgcagcgacggcggcggcttggaagcggtctgcagcggaggcggtggctcggaggtggtccgcggcagcggcggctgctcggatgcggtctgcggcggcggcagtggctagaatgcggtgatccgctgcggtggcggcggcgtggatgcggcccaaggcggcggcggctgctgacgttgcccgcggctgcgctgttgctgcctttggcagtgatgatcgcgccgtttggcctacgtcggcgtcggtggtgtgagtctggtgcttctgctccaccttgtgcaagtccgctcttccccaacgttgtgctatagagaacagttcattcgtcgatggttgtgctcttcactgcatcagggtggctggatctgggatccttcttcctctttgtctccgggcagtggcatccacgctgggtgtgccatttgggttgagctcaagctcctcagattcaatggcgaactcgatccatggtgaagtttggttgagtccggtgaaacctacaccaaaatctacggctcaacagcaaatctccaatttgtgcaatttctatgaaggcgaccgaaggggattactggttcgtcaagcggtctgcatgctaaaggagacccaaggttgcaatcgtcgcggcttcgccgctgctccctgtcgattcgcgccttctgcgctgcctagtttcaggaggttgtttatgttcttggtccagttttctattctgtgcatcttgctgtttctgttgacgatgttcgggggcttgccctcttgatctgttgctctaatataaatgtttaagtttcaaaaaacagtgtagtagtactactagtagtagtataggagtagtagtatactgtagcatatgcctgaccgcgtgagcgactgggcgcgcgcccagtcacccattagcagtcccctaactagtgatctataaatagaggctaggaggggaatgaaacgggacttgaattgtaggccttgtttagtcccaaaaacagataaattaaaaactaattgcacaatttacatgaaaatcgcgaaatgaatcttttgagcctaattagtccatgattaaccgtaagggctacagtatcctacatgtgctaatgatggaataattaggcttaataaattcgtctcgtggtttccaggcgagttatgaaattagttttttcattcatatccgaaaactccttccgacattcgatcaaacgtccgatatgacaaccaaaaattttcttttcacgaactaaacacacccgtaatctaaatctatcactatacttaaatctctcctcctcgccaacttgtctctttctcgttcaactcctctctaaattctatctcgactctttcttcctctgcaagttggtaacaggagtttacgcggttcattcttcctctgcaacttggctctttcgctccgacctgattcagtttcgatcgggtacgtacacgacatgttgaaatgtggagacgtatacattgatttgaacctgtaaatactaaatacggaacacgccatggaacgtaacagaagcaactgtgacatgtgttggaattttctcatcgaaaattcagaaaatttacaacttgcgtggtttagagtagaaagtcgaatctgaaaccttaggcaccgttcctatcagctactcggttgagcgctactactacgttttctgtcagagtttcctgaaccagaactatacctctccgttcccggccatccagcggcgtggactcgggagttttagtcgtctccttcggctccgatttccgcttctgcccccacgcggattcggttggcagcgcggactcggggaccgctgtgacgctgtcgtctcccctcggtgccggccggagaaacgcgcgcaggcgatatggagcacgaacatatacataggccacaccggtaatgtccaggcgatatggaacagtccaggatgggaatggttaggatatggattgaacttaaactgttttaaaccgttttaagtgagttcattcatccataatttaatagagtcaatccatcatgagtctattatatcaatatgctatccatagatatccaaatggatcatctattctagtagtaaaaaaaaattcttattatatgtatgtaaaactcgggtccaaaattttaaaactcgcgttcacattataaaaactatatctcatttagg

SEQ ID NO: 20634 - DNA, 4420 bp, Oryza sativa
  unsure (1)..(4420): unsure at all n locations
tactatgacaaatttacggtagattcagtgaataaatggatttaccctaatcattcccgctggtcactactgtaatcaccacttccaacacgcagttgagagcaaccttggcgacgcgcttcgccgctcgacgcttccaaccatgctgcggccagcggcggccgctggcgccgccggcctccatcagcagcggcgtgcaccgcgggtgcacgtcgacgtcgcactccacgcagcggtacatgcagcggccggcgtcggaggtctccctgcaggcgacgcaccgccggctggccgtgaggacggagagcgtgagctcgtggtcgcgatggcgccggccgagcttgactcgcttcggcagggtgaggcaggcctcgtggacgtcgaagccgccgcacggggcgccgccccggcatctgtaccggtagctccccccgaagatggtgcggtcgcacacgttgcagacaccgaaagcgccccgcttgccgccgtaaacgcgcctcgttagcgagtgctccgggtgtaaccaggtagtgtatctggcggaacccatattgatatatatatcgatgtatcgaatcgctagcttcgtgtggcctagctgtgggctgataatgcttggttttcgttgtgcaggaggtgaatgcttagttgtcctgagtggcatatgagtacatatacatacatacatacatacatacatacatacatacatacatacatacatacatacatacatacatacatacatacatacatacatatatatatatatatatatatatatatatatatatatatatatatatataggacactcatatggggcaccatggtgcccgggcaccatggtatgaaatacacaaattcgcccaaatttttcaaaattttcaaattgtgagtatatacttagttataagtattcgattcatacctatacctagcaacaaaacaactcaaatttaactttatttcacaatccattattacatacctaactaattatatgtttggatgctatatacctagaatcaaaatctaacaaaagcaagtttgaattcagttcaaacttgctttgaactagttagtaaagtagttaatgttaatacctaaatatttgaaaaagtttcatactcatttgaattgggtatatagtaaatttcaatcatggtgcccgggcaccatggagcaccaaacaaatttaatatatatatatatatatatatatatatatatatatatatatatatatatatatatatatatatatatatatagtagtttcgactttcgagtcatcggtcttagtggtgttttttttttccaatacagacaaaagatatgtcaaaattatgatttgtatacacggtaaatgtgataagtacgtgagttagccacattcacccggagcatgcacttgaaactcgaaagaatagtctagatgtgttgttgcgcttaacacgtgtgcaatttattttatataaatttcacaaaactacaagtatatttgagtaatttattgtaagctacagatttaaaataatatatcataaaactatatatttaacactaaaattaccacaaaagttgagtatcacaaaactaaatgtttaacatcaatttaatcacaaaacttggatgttgataattcaaacataacattagtactaagaatttaaactctaaaatctgtagtttaattaattttattattaaatttatagttttgccatacctagttttaaacttgtagttttatgataatattatataaaatatatagctttgtgatacaccaccttaaatctgcagttttgtgataatttagtaaaagtatctgtatttttgtaaattttactctattttttcattatatttattgataaattttcttctaaaagattaatagatgtaaatataacataatcatagtgtaattatattataatttgaatttaactataataaaatttgcatgtaacttttaaaaatcgcacggtaacacgttatttgtgggaagcagacgtttcgtacgtgatggagggacgcgcggtaataccttatttccgcaaaccggacatcatgcgacggaatcccatcacctttatgcttgccatggttttttaattcccgcttgcatgaatcttgaagcacatctaacaatttaaaattttaggaaaatacatgcaagttacaatgtaattacgcgataattataccgtatttacatttgataaagttttaggagaagaaaatatcaacnaatgtatagcaatatcttttttttcttcatattgacaaggatccatggtaaaggtgtataagtttcaattttaagttacagcattatttatttcatccagaaaaagtaaaaaatacacttgagagttgtttcatatcgatctagtgttgaaaaaggtaattgatgatagaatataggggagagatgaaacaattgatatggaattttaggggttttcttcacagcctttgttgtcgagctctcttttttttcgttgctaattaacatggaaagtgaacaaaataactctaattaaaatctgcttaagttaacaaccaaaattcctttgggttttaagaataactatatggtaaactagcctggcagagcaaattgttatgcatagttctatgttttccttggggctccccctctcaaagattcctgcggcgatggagatgaaaagagccagtggcgtgtcgtatggtccttgtgccatctagaagaaggttggctctgccattgctccgtcagtggttgtgtcctagtgctcattttcctcaacgacggggagcggcggtggtggtaggcggggagcccaggcattggtggcggtggtagctagttggcctacggtggtttaacgatggtaacatggaatgttggcatgactaaggtggtgtcgacgacatccagtgtggatccagtctaatggccagatcgcccttcaagtgagcgaggaggctacagcaagaaagatagacggcaggctcattcagcggcaacaagtgtatctagatcaagcctaatggtcagatcggtagtgagcaaggcggctacaatgaggagctgaagcgacaatttcctgatgatggctaggcgtgactctatatttagtatctaagtgccactagttatgatgtgtttgtgcccgaatccgtccgtacgtatagttgcaacttgatgttggaggatcttcttcttcttcactttatctggatgatgttagcgtgcgaaggcacaaggggctaggagctatcggatctggatcgattgaatcttgcctatggcaaaggcaacatggggattagaggtggatagattgaggatgtgggtactacattagtttaggcggcgtttcaactttcaagatcgacttagtgtcgtttttggttcggcaggactcgtcaagtaagagaacatctgggtttagggttacagtctttttccattttattttgtttattttgtagtttccaagttatgagacctggaatatatctatttttctgtgtcccttgtgtatatccacttgatatagagaccatcattttatttattattaaaaaaaagttgtattatttgtagtgattatgaatgcatcggtgagatagtctttttagtttcacttctgtgaaactcgataggagattcattctatttggtttgacccaaacagtataagtgactaatgagtgagcgtgttgaatcggtggagcatatgtacatgtatacttaatgccaatgcaagttcatgataagcataaattgagaagtcagcgatcctcgattccttgcaaccccctagaccttggtggcagaggaaaacaacaaagctttctaacttgacacgcattgacattcgaaagtacgtgtgcatgacttggtcaaatagtacttactactccagtagttactcgtaccaacatccatcgtactcaggtcgtgctttttatgggctggccgcacgagggctactgggctttagcggttgcacgcacgcaagaccgcaagtccgctcgaggagaggacaaagagggtgtacacgaatgttcgctactattagacagtcacgcgaacagttccgacaaccttcctcttactcgtacgtctaaccacgcctgcatgcaaatacgtgttcacatgagagttgctctaagcctgccttttcaaagaccaagtccacccatacctatgttattttattctcctagaatcgtacacgtgttcacgtacgtcaacaatgttggttcgtcgcaacggacgtttttttaaaaaaaatatatatccttgattaactccttatgtttctgttaaaatttatatatacattattaaacattctaattacatatataaatttttatacataatatttatacatatacgtatatgtataaa

SEQ ID NO: 20635 - DNA, 17817 bp, Oryza sativa
ccgtttatatatattaagtttgtgcgtaaagagtttctatacgtaaagtttccattcgaaatgtactatcgaatatttaagtactactaaatttctgaattaaattttaaaatatattaaaaaactctaatcaaaatgaccagatagaatggcgcattagccaatcttacagtacgcaacatagtaaaacaagaaaaattgtaaaatcatgctggtctattatagctaggagctaataacgtgcggtgcagcagcagcgcgcacatcgtgcgaaagaatcgtgcttttggagttctagagtttcacgataggctaaccaaatcaggaaagtttggatctgtttctccatgcacgcggtagacaaaactggaaattttgaatccgttcgcgtcttgtatatctcgcgtgcgtccgtgcagtagacctcccccgatgacgacgacaacaatacatcctgttgttgttgtttttaataagatgaacggacaaacatattataaaaagccaacggtgtcaaatattcagtaatgttaggagactgagggagtacattgttcagaaatcagagttgacacatgaaccctttttaagtgcacgaggcctgtgaacgaagggcatacagtatatcaaagctagcataaacaaatcatagcttaccatggcagcagcatccggcaatcacttgaccgagagccggacgcactttgcccatccacagcacccgcttatcaagacacagtacggcggcggcggcgagcggcagccgatcagcagccacgtctgccgcatctgcgggactcgatcgcgtcgtcaccggcgccggctaccgctgcgaccactgcgacttcgacatccacgaggccaaggcctgcgccaacttcttcccggagaaaatgattacacccccgcccaacttcttcgggcatccgtggtcgcacattaatctcacgctcagacagatcacggcggatcatggcgaacgaccctgtgccggggtcccttccagcacggccacctcgcctaccgctgcgcgccgcagcgttgcgggtgaattcgccgcgcaccccgttgcgcacgatgctgccgggagagatccgcagcccgctccaccgggagcacgcactcacccactccgggctcatctcgtcgtcgtcccagagcggcccgtgcacacccgccgagatggcccgggtctgctccgtctgccgccaagattgctccatatgcgcacgcggcactaccgctgcggcggcggctgcatgttcgtgcttcacatcggcggctgtgtttccggcgtcccgccgacgacgacgccggagcagagtagcagtggtcgtgaggacgacgtcggagctgctgctgctccagcccccgccatcgtcgcgaggtttctcgatcgtcgtggtcgcggactcgcggagcagcagctggcggcggatttccagctgccaatggcatggtggacgtctttaacgccctgtaagcttcgctgggctcgggtgattaattactagtagctatataaacgtacatccgagcgatttgtccagttacgtataagtatatacgcgtgtgcttgttgtctgtaataatcgcacaaaacattcttggcgtttgtcgtaacgagttcgatcatgcgaacgtgccagtttgaacacgtgacatatatagctataggcctatagcagccgagctagctagttaaagtatatatgtggaccgtttggtctttagtttcagaagattagtggtgaaaacgagcggtagatatacacggtcggattatgacattatcatatactagctcatatttttctttaaactcgaagccagatacaactagtgtgtcggataagatatcactcatcttatatcttatcttatactagttccttctaatcgaatttgagaacgtatatatatttgtaactctaatttatatgtattaaatataaggaaataattaattgttgaaagagatacatcagagaaaaaaatgtacaatattacattgtaactcgtaacatagtgattaaacaatcttttatcatgtttgtaagtggatttataatatattttcatatatgttttataatatggaacatacgggcgtatacaagtcttttttgtcgtaacacaattttttttacggattcggatttgtactcagatagtactaggtgtcacatttgtttttctcgtatattcttcctgcgagcctcggatcgggtgggtgatcgggaattacccatcccattttcatccctacgaaagatatgcaactatttgtatgtgtggtgaaatgattactccaaaaattctacaagtggtttccttttggtattatctaaaaatatttcacaagtattccaaaaataaagaaaaaaagatataactataggtgtaattacattatatatagttccatcgcaaaatgttgcaacctaggatagacttttgtttatgttcatggtcctaatttacaatattttgtgacggaaaaagtaacttttgtataacttatatgtaacttgtattttacttaagaaaaatgttggggcaggagctcatcgcggcgaggcggccgtggggggaggcgttccgggcgccggccttctccaagtcgcccagcgtcggggaggccatcgccaaggcaaggtggaacacggcctacttccgggcgaactacgcgctcgtcgtcgccgcgtcgtcgctgctctggcacccggggacgctcttcgcgctccacgccctctgcaccgcctagttcttcctctacttcgcgcggcccatgtcggcagcgggacaaccgctgcagctcttcgggatggagttcgaggacggcaccatcctcgccacgctcacaggggtcaccgtcgtcgcgctgctcttcaccaacgtcggctagaacagctgctccggccttgttgctccggcagtcgcggccaccgccaccgttcgccgccgtggcgcaaaaccctaccgccctccccggggcgttttccaacctctagatctcccgcggccccacggcgccgccgggcgagccgcgaggccttcacggatggcgatgccgccgccagccgcacggccctcctttcccggtagcccgcccttccaccagcccgccgttcaagcgtgcgccagttgcttcctcttcgcacacctcgacgccgtttggtgggactcccacggccgcgacggcacagccatgtgggttcggtgaccgagcgaggagccggaggaggaggaggaggaggccccggcgggcacccccgacaccgaggctaccgccgacatctccctggccatagccaccatcagcgagggccccgcggccatcgacgacgaggaggagagtggcgctagtgcccccagcatgtcagcctccccatcaccgtgctcctcgtcgttggccacctctcacccgttgctaacttcattgtcgggcgccgtcgccactgactccttgttgggagcgaagggaggaggagacagagagaagagaagggggaagtgggacccactatattttttaagttttatttgactgatatgtgggtccatatattttgttttaattttttaatctcaagtctaatgccacgtgggacgaggacaagtcacactatccacgtaggcgccacgtcaacccaaaccgtcatgggaccttatttgtacttggttttgggagttgagcgatacgtcatatctggtattatggttcggagatgaatttcgaactcgggacgaattgagagatctcgagtgaacttattcctctcattttgggtatcttgccaacgctggcctttgtagtttagtgggccgatcgagagtatgttagcaactcgggacgacaccgttcacaaaaaacaatccataaattaaactgctgtatattacaggagatcgaaccacacgttacgacgtgtgttgtggttttatcaagcacgcacggggaaactaactggagaagaagaaacttcagaggaaatgaaacgagaacacgcatgtcaagagctgatagagcctgatacgtacacacatgacaacaagcatatatacgtgtgcatatatactgatcaaattatgtgaaaatcactcctgatcatccaaggccgtggcaaggacatcgagcaccgttgttgccagcgcgccggttgctgcgttgatcgcgatgttgagacttgtcctgaggaggaacttggcgatacgagtggcgcggctcgagcccggcgtagcagcagcagcaccagcaccagcgttgtgagaacggctggtgtcaccttggccagcgtttgccgcgccagaggggcacacgacgtgcagcttatagaggcaaaattcacagcggtagtgccacatgttcaggccttgatgacacgctgagcatgtcccccatgaaggggccatgttgagatcatgctgcgggtgaagcgggctacggatcgtctgcagcagcagcgtgcacagtgggtgagcgtcgaaaccgcactgtgcgcagcggtagacgaagcttccccggggacagctttccgtgcagaggttgcacgaccacctgttggtatcgtcgtcggggatggtgctgagcgtgagggtgtgccacgggtgggcgaagaaggagactgtctcctcgaagtaatcggcgcaggcgtcgtggatgtcgatgtcgcaggtgttgcagcggtagccgaccatgccggcgacgttggttcggcagatgtcgcagaaatggctcgaggtggtgctgtagtgcgtccggagaagcaggtgttgcggatgggcgaagtgccttcgctgcctagtcgccatgtttcagttgaaatttttcgctttgtgcttttatatgcttcgtgtatagaaacgctccagacggagagtttcacagtttagggggtgtttgggacaccccgttagtctggctttggcatgcctctgaggagttcattacacatttatactacacgcagaatctacaagcacgatggaccagttcactacccatcatatattcctagtaccagcttgagtgtgacaggccggcctgtcactggctgttcgtctttaagatatatattccctcatttcctaaatgtttgacgccgttaacttttttaaacatatttgaccgttcgttttattcaaaaacttttctgaaatgtgtaaaactatatgtatacgtaaaagtatatttaacaataaatcaaatgataataaaagaattaataattacttaaattttttgaataaaacgaacggtcaataatttaaaaaaaaatcaacggcgtcaaacattttaggatggagggagtatatgcatttgttgttcaagatatatagagacttcacgcctcggaccaagcttggaaagttggaatatggactcggtccatccaatcacagccgaattcaccatctgctactacgtttaattcagtggattctgagattctcattcctcaaacatgttaatttaattacttaaggaagataaaagtacattatctccggccgcgccctggtcgacatgcaaattaacgtattatagcactaatattgtgcaggtctctcgatatactacttaatttaccgactaatttccgaaagggcagataatcaaggcatgttcagggttcaatataactgatgcaaaagctatcacggaatttataaaaagagaaacactgttgctcgtatcgttaggaaacaccagtgttagctgctttgatcagatttgtccacggttttgcaaggcagcattaattttacatgttacattttgtttgaccataattttctaataagtattgaaccaccacaggaagatcatattatacattttatagacattgttaaaatagttgccaagttcagttggacaatgagaaaaaaaaaatactaaatccgtcccaaattagatgttttgactttttttttttgcctgcaacgtttcaccattcgtcttatttaaaaatttgtccaaatataaaaaagataagtcatacttaaaatacatttgataataaaataagtcacaaacaaaataaataataattttataatttttgaataaaacgaatggtcaaatgttaaaaaaaaatcaaaacgacaagtattatgagacacatatctagctagcatattgatttcaacactattgatgacccaattcaaattgctcaattacaataacctcgcaaagtcataactagcagcacgacaaaaaagagttggcctcaagcaaataatttagagagatggagtacattgtttcacaaggaatataaacgatgtgactatcagcaaggtctgagtacataaggcgagcacatacaatttgacatcaaaattaaacaacgagagaatgattcatgcttatataattatcaccaagtaggcagcaaaaactatatcatacatgagctgtaaaacaaaattgtacttcatccgtttcacaacgtaagtcattctagtatttcccatattcatattatattaataaatctagatagatatatatgtctagattcattaatattaatataaatgtggaaaatgatagaataatttatattgtgaaacggagggagtataggctagctcaccatatatatcgatcagttaacaaaggcacactactagaaagtcagcgcgccctttggcgcgccagctagctaacccttacgtgcatgtcaaaaattagatactccattatatattgtaaaaataaaatatccttttttttcttcaaaattagtagtatctctttatttaacttgtgttttctctcatttctacagtctacataaaccaggaacataattatcagtaccctcaaataagcaacatttttttcagccactagttgacgttaccctttgttatattttttttgaatatattaacattaaaagataaaataaagagtaaattttataaaactacagatactttaatcaatctatcctacagatttaataacgtatcacaaaattacagatttaacatcatatttttcgtaaaattatagatttaaggtatggtatcagacaatgatagatttaacatcacttttatcacaaaactacaactttcgtaacaccaatagtgctatgatataaactctaaaatctgtagttctttaataacttcaccactaaatctgtagttttgtgatatgatgtttcaaatctgtagttttgtgatatgtttggtgctaaatttatagttttgtgatacatatgtttaaatatgttgacagtttgatcaaagtatatgtaggtttgtgaaatttactctaaaataaaatatatgattttagttatgcatagacgcctgcatgccggtctataaacttagtgagtatgcttgtttgtcaagtgctgtgaaatactaatattagtagcatttgtctttgttatagtcacatctaccatctgttaaatctgttacgatcacaagtctactcaaggcctctttagatcccctggcaaaattttataccctatcatatcgaatgttaatttggacacatgtatggagtattaaatataaacgaacaaataactaattacacagattgcgtgtaaattgcgagacaaatattttaagcctgattgcatcatgatttgacaatgtggtgctacaataaacatttgctaatgacggattaattaggcctaatgaattcgtctcgcggtttacaggcggattctgtaatttgttttgttattagactacgtgtaatacttcaaatgtgtgtccgtatatccgatgtgacacgccaaaactttacacccctgaatctaaacacaacctcagtatctaatcttttggtccgtagactgatgtgactttcattcatggtctctctcagctgcacccaatgctatcagtatcagaatactaggtagtatcattttgctcaaagtaatatcgtatcatagtatcaggatactataagattttccttttttaagttcaattaatatttgtattaattacatatagccattatacataaaaaaatagtaatgatatatgtcatacaaataaagatatttatcaagagaaaccacattagttttgatatatttaactgattttttataaacttgagtatatttatttacattattttcaaaccatcttattttaaataatattttgttggatcgtaaaggatcgtagaatcggaatactacctaagattttataggatcgtgtagtaataaatagatcgagatagcacgaaaattagaatactagataggatcggtatcgtttgtgcttgacaaccttgactgcacctacttctgatcttaacgcgctcacgtatctcttataccgaatcatgggtcaattctcaatcggttaaccctgacacgtggcacttccagatacacgtatttggggcctgttcactttgatgccaaaaaaagccttaccaaattttagcattgcaatgccaaaattttagcatagttgccaaaattttgatatagttaccaaaatttggtagcaaactaaatgtagccacttttttggtaactttaccaaaatttggtaaggttgaaaatggcatcaaagtgaacagacccttagtttccaccggccaacacgcagaacgtgcgactcacctccacgcgctcatgcttgtgcccgtaaggcagctgggccgctctacatgttgactagggggaaaaagtacaccgaacgtccctcaacttgtcatcaagttacaaaatcgtcctccaacagcaaaaccagatacacaacatccctcaatttacagaaaccgttcactttagatcctctggtggttttgaccccgattttgtcctacgtggcgttgagtcaacgtgaaacccatgtgggccccacatatcagtgtggccacgtcatcaccctctctttccccttctctatctctcacacttttctcctctctccccaccgcgccgcgcctccctcccggtgctcgctctcctcctcctcctccacttccgcgtcctcgccgctaccgcggggtcccacttctcccctggcggtctcccgccttgtaggccgctctcctcctcgttaacatctgacgacgttggcagtggtggagaaggctggcgcggagggcgatgtgacggcctgcgacgtgaagtgttatgtgttattaatgtgttcttagatgtgtcatgtgttctgtgctgtgttcatgacgttcttgacatgttcttgaagttcttgatttgtgttcttgatgtgcttggcttgattcgtgcttgggtcagcttgattcgagccgagccggtatttttttttgggcttgttcatctttctaggtgccggttctaaaccgtcgacacctatttggtttcatatctgtgctgcctgcgaggtgtcggttgccaaatccggcacatatgtggggttggcaaccggcaccaaaagatctttatgtagtagtagaactcgttacgacaaaccccaagaatgttttgtgtgattatattattacagataacacgttgaaacagcactcgcgtgttatacgtacgtactccctctgtacttgtagaggaagtcgttttggacagtgacacggtctctaaaacacaactttgacttcttgtttctacaaaagtatctattgaaaagtgatatatgtatacttctagtaaagtatttttcaaggtaaacctatttatataatttttaaatttttaaactcaataactcaataacttgatttaaacattgtcataaacgaattgtagtatacgtaactgacaaatcgctcggacgaaagttcagctggctagctgtaccagtaattaatcgttcgagctcaacgaagcttgcagggcgttaatgaccgccaccatgccattggcagccgggaaatccgccgccagctgctgctccgcgaccacgacgagaaacctcgcgacggcgggggctggagcagcagcagctccgccgcacgaacccctcgcgccgtcaggaccactgctaccctggtcctcgccggccggcgccggcggcggcgggacgccggaaacgcagccgccgatgtggagcacgaacatgcagctaggcggcgcagcggtagtgccgcgtgcgcacggtggagcagtctcggcggcagacggagcagacccgggccatctcggcgggtgtgcacgggccggacgggatgagcatgagctcggtgtgggtgagcgcgtgcttccggtggagcgggctgcggatctctcccggcagcatcgtgcacagcgggtgcgcggcgaacccgcacctccgcgcgccgcagcggtaggcgaggtggccgtgctggaagggcccccggcacagggtgcacggccacgatccatccgccgccgtgacctgtctgagcgcgaggttgtgcgaccacggatgcccgaagaagttgggaggtggagttatcattttctccgggaagaagtcggcgcaggcctcgtggatgtcgaagtcgcagtggtcgcagcggtagccggcgccggcgacgacgcgagtcccgcagatgcggcagacgtggcggctgctcggctgccgctcgccgccaccgtactgtgtcttgagaagcgggtgctgtggatgggcgaagtgcgtccggctctcggtcagctgattgccggacgctgctgccatgataagctattgatgatttgacgtttgtgctagctttgatatatgtgcttcattcacagggttcctcgtgcacttaaaaagggttcatatgtcaactctgatttctgaacaatgtactattagtagcttacggtttttcgttctgatcgaaattggttttaacttttaagatgtgttgaactatgtatgaaacagctggcgctaatagtgtaatttacaagtaaagtcaattttgagatcgagcctgatatgtaggcagttttaattccctctacgcactgatcgaattgaagcggcccatagtatataggtgcactcactgtattgctacttgctccttgtgctagcttacatgcatacagaaacattcagcgacgactcgaggttactcaatgagttctaaacataaaaaaagaggggtcagcggcaatcgccgtctcgcacacgtacgtacgatcaataccttcttcccgaccgcatatgcacaggcgagccaggaccgcgtgtacactgtgcagcgctactgtgtagaccgacaggagagggccggaacagggtccaatattgtttgaaatttcagaaattttcacattgttgtgtgctactgtattagtgtttttgtgcgaggatcgacttcatcgtctctcatacgtcgccggtgtcatggaggcgcgcagaggataacagagggagagatagggtaaaaagaaatactccggtagcttaggttcaatcgacctaacgaagcatcataaggacgtagctggggtagtccttgtggactcgggactaccccaattttgaccaagaaatcccctacacctcataaaaaattaggcccaaataatcaaatccaatagaccaaactaaaattagcaacccaaacccaagaaaaacgttgagctgtgaactctgcaagagctgcccggaagacactgatcaccttttcctcaactgtcccctggcctcagctttctgggatatgattcaagtagcacccttataacatctatgaatttgcttcactccaacaccctgatggacaacatttcggctcttcagagtaataccttcttcattctctgttgctgacgcctgtggaatcatcgaaacaaagttgtctttcagaaccagccccccttcatttctcggctcaatagaagttgtattcaggatgctcagctctgggcacatcgctttaaaccttcgcttaaagcactcctcccgctctggctatcgctgtttaatgcttctcttgctcttctctagttgctgttctttagctcttttgtagcttttagttttcccccttttattttggcctcgtctttgtatagttcctctgtaattctcttacttcttttaatccaatttaggtggggcctccccccaccccccccctcccttaaaaaaaagaaaaacgttgagggcctattcggaacacaggaaaaggaaaaacacaggataggaaaaacgtaggaatatgaaaggaaatcacgttgaaaacataggattgaaaaacgcaggaatataaaagttgagagcattcggtttacaggaaaggaaataaaaagtaatcgaggagtaatctgtatactgtatttattatctaccgctatcttgcttatcccgtctgtcttgcttattatctagtggctgttttattgcttgattggcttgattctctcaaagggaatgaaacaagagattggagtggatggaattttcctccgtttttcctgtggaatcagcagcaaaggattttttcctacagttttcccataaccactttttacgatccgaacgataggataggaaaaaatcccatgtgaacagtattcctatgaaattcccgggaaaagcctccaatccgaatgagccctgagagtggaggatgaggggatggctaatgcgcgcatacgcgccagctaaatcgctggcgcgcacgccagctatccccttccgccggtccttttctttttttgcgtattcgcacttttttctctgatcttaggcgtgttttcttcgtttcttttttatttttttaatcattcacacacctctttacaaataaatatagaattgaaagaaaccaaaaaggcggaaaaacgaaaaaaaaagagtgtgagaagctacgaactaggaaacgctcgcgatttactaatctggcgcgtttgcgcggattagcaatcctgggtggacgagccgttacaacgctactccctactccctgtcttcctcccttcaacttcgcccgatgcccgtaccacgcgcggttgccgagtcgccgacgaggcgacacccgtgtgtcaagtcgcaccaccgccacccgtgcgccgtgccgccgtggatacaccacccaccgtcctcgtggcgccttctgcaggacgttccacagccatctccgctctggtgctcttggccagccaagcgaccacagcctcccgctcccgctgcagcgctcggcgcctcggccgcttgcccgcagccatgcagcctttgcttcaattccggcggaacggaacggcgccttcccctgcaggtagtgaacaactgcctctactccccttcctttggctgactagctcagtagttatgtctctgtaggtaatggcttcaaaaatagatttctgatttgtgagtctgtgaataagtgaataactgaatatacaatttgtaagttgtgattattgtttagtgaatgtgtcattgtagtttgtaggattggtaaagcatgaagaggagcagggattttagcttgttaagtaagccacttatcgatgttataagacattattattatatttctaacatattttcactaattttgttcttgtatatgatatcttaggtgtagaaaattttagtatatgatgtgaatttgtaaactatgactacccaaggaaaatctcctggctacgccactgtattgatatattatggcggcgaggggcgccctgtccgagtgcatcatcagcagtgccggctaccgatgcgtcgagtgcgcgtgcggcggcttcgacgtccaagatcagcgcagagcagtttgttaagtaaatgtgtcattgcagtttgcaggattggtaaaacatgaagaggagcagggatattgattagtgaatgtgtcattttagcttgttaagtaagccacttatgatgttttaagacattataataatatcatattttcactagttttgtacttgtatatcatattttcggtgtagaaaattgtagtatgtgatgtgcatttgtgaactagtactgcccaaggaaaatctcctggttacaccattgacatatgttacggcggcgaggggcgccctatgcaagcgcatcatccgtagcattggctaccgatgtgtcgagggagtgtgcggcggctcctgttaggaagcgataggcaaataaacgataaaaaataatagatcaatcatagaagacccgagatttaacgtggaaaatcttttcaaagcaggagagaaaaaactatgagcatcagttagcaaaatatcttcactttatcggggtaaggttacaacaccgaacgacggcttacaagaagtatatatgaaggtgaaatcctaaaaggataacgacgggcctccgcttcgctctggcagaagctggtcacaactcaacagtttcaatgtccaagatcagggtagagggctgcctctccctgccgatggcgcgctcattctctctctctctctctctctccccctcatggctagccggccggtggactcgaaaacttcaaatgtggcctcaaatccattaaaaaaagtgaatgttagaaaatgaactaatattataaataaaaggggtgagacttcaaatccagaccagccagcccacactactataaaaatcattttcgccgacgttgggtattcatttttggaggcggacatgaccctcagagccaaatagccgcctacaaaaatgcaaaccgagatgaagctcgctgtccgcctacgaaatccattttcgcaggcggacctcttatgtggtccgcctacgaaagtagacttggaatataaatagagctaacctagggccgattttttctaagtcctcattctccctcactcctctcctgcgtccctcctcactcccctcccctccccttccctcctctcaccggccgccggccggaggcagcggcggctccctcgcgacatggcggccgcggcggcctccggcccctccctccctccctgatctagccggaggggggcggggggagggcggcagcggcacccggcgtggctcccctcccagatccggccggagggaggccgggggagggcggctgcggcgaggcgcggggatgaccatggcgcggggcggcggcggcacccggtgcggctcccctcccagatccgaccggatggagaccgggggagggcggcagcggcggttccctctatcctagatccagccgaaggaagggagagggcggtggcggcggcggcgccccccaccaccagcgtcggcggcccttcagcagcggttatgcttcccctcacctccccttcctctccctcgacctcccaaaaccctaaccctagatcgaccgaaggtgagtagcagcacgggtggggggtggtagtgattttttttgttcatcaagaggattttcggccgcctgcgaaaatcgatgtttttcgcaggcatttatatacaggcggacctttccctgcctggaaaaatgatttttggccgcatgcaaaaaaaaaagatttttctagtagtgccaccactttgttgagctagccgaaaaacactctggacgtttttcgcttcaagttcattcaaatatgacctaaattaaataacagacgaattatggaatagcctgaattccctggcatcgggacgccgttcggagaagaaggaaaatacgtcgaggtggtaaaactccccgccgcaggcaacgttgccggaaggggtcgcgggtcgcggctggagaaaggaccagcggcgcgcgaggaaaaggacggcatcagccggcgatgggggaggcgacgcggcgtccgactggctatgtttaggcctttagggtacgaggtggttgggcctttttttgggccgcacggggctaccgggcttagaaaggctaacacgaaagaccgtaacaatcacctcgacaacgcgactgctagctgctggagtgagagtgtgacacacagcaccgaagacctgtcggatgaagggagtacagcatagttgcatgcacaaatcttccagcggctacatttttttttaaaaaaaaaagaaaatcgacttgtgatcgaatcgtgagcacattgtgataggtggaagtttgcagtgcagatggtgcagttaacgcaaagaagaggaaaaaaaaaatccagttgcacacatgcgtgcactgtttcgatcgtctagagattaagcgccgtctcaatgacttcgatcaccggcgacccgaacccgccggtgaccgcgtccgccacgcgcagcccgaacaaccccatcctgagagccgccatgccgacgcgcctcgccaccccacgcttcctaccatgctgctgctcgccgtcaagcagcgacgtgcaccgcgcgtgcacgtcgaagtcgcacgccacgcagcggtacacgcagcgcccggcgtgggaggccaccctgcaggcgtcgcaccaccggctggccgtgaggagggagagcgtgagctcgtgcgcggggtgcccgacgaacgcgacgcgcatcggcagcgagaggcaggcctcgtgggcgtcgaagccgccgcactcgccgcacctgtagccggagccggcgatgatgcgctcgcacagtgcacagacacaggcatggccctcctcgccgccgtagtggtgcctctttaacgagtgccctgggtgtagcttgcaggtgacagaagctgccatctcttgaccgataattcgatcgatatggcttggtttaatttgtttggttgtagtagttgtgcatgcggtgttgacgatgcttgtactggatgtgtatatatagatgtttcgagtcgtcggtcttagttgattaatttttcttttctagcctgacaagacaataacccggcttggtacagtgtgtgccaaaagaaaaaaaaaatgtatgtaccggcagcaagcatgagcatgacttggtatacgtgggatcagtcacactccggagcacttgctaattattggatagtaaatttcacgttcaacaaaaccagcagtttaatttaggctcaacttgtgctgaggttggaacaagcgctgaggatttatttttatgattattcagactaccattttaatccaggctgtttcgtaatgtctcaagagcataggggctagtcggcgcgctatgggtatcctagtattgacaatgttgatggttgatcatgggagagctgcaacacagttgattttaaattttaagttttgattttatattaattttagggtgttttcttcaccacctactttgtccagatctcccttttacaggtgctaaaagatgagtaaaaaaactcagccaaaatcattcttgaaagttaaaattcaaaatcaccttgggttctaagaaaaagcaaggtaagccaaacagagcaaattatgggtctggtcggcaagctggctgcggttgctaaagctgaggctgcgtcgtgcgtgtgcaacactgttggtgctggctgtgccacagccgtagcacaggcagccgaacaggccctatacaaagctctggtgttacctatttttttcaattttatgtgattagttgtagtgattatgaatgcgtcgctgagatatagagttttttttttaccaggttgagatatctactgtttcacggatgtgaaattccgtagatgtatctgttagcttgacccaaacaatataagcggctaatgagtgagcgtgttgaattggttagtggagcgtgtatgcttatcttatcttaatcccagattcccaagttcatgagtaacatatttaaattaagatgtcaaccaacgatcccagattccttgcaagttgcgcccctttggccttggcggcagaaaagaaaaaatttcaacttggcactcgagagtaggagtacacatgacctcttcaaacacttcacagctagtagtactggtataaaata

SEQ ID NO: 20636 - DNA, 829 bp, Oryza sativa
gcccaattattcagcagcagcacaatgccacaccctaatcgatgatgcaagcatgcccattatggcttgaactgcacgtttctcactgtattattggggaaaaagcagagtaaagcatcaggcatcactatgaaaacaaaatgaaaagaacttgtgataagtttgatctcacgttattttaataaatgatggctttgatgagctgaagattctcaggtccaggacaggtgctagattaacaagggtctcaagcatgtttgttatgagctcatcatcttctgttacatgataaaaatgcataaaaagttagtttgttatgagctcataatcttctggtacatgataaaaatgaatagaaggttagtttacatgttatcataacttggtcctaggataaataacttatttgatttagcacacaattaacatcaacttgaaattgaattgccctagacaattggatagaataatttgcaacacacttcttgctatctataaagttttccttgttggtaatttttttatatcctttagatctatgtaaaattctcttttaacttattttaatacattacagctggattatcccctaccatctcctgtcaaaagcaaaaattatggcacaacacaaccaaaagaggtagtcggtcatttccatattaatttatggtttttaaaatagaatataattgaatttggaactttaccagtgttttggtcttctaagcactgaaatacagtctccaaccagtgtctatgttgaaccataacagtctcattttctggcatgaaagagaaattgcgaattatattggaggctgcaacagca

SEQ ID NO: 20637 - DNA, 1140 bp, Oryza sativa
tggtaattgaggcataatttctgagcaaaactgaggccatatctttcatagtataccccttattacattggatctaatgctatttggtataatggtaggaaatttataagctttttcgtaaaaattagaccatgacaacgcccggggcaaacccgccctccccaacacctgcgaggatccaggaagaagcaaacccagccacggagacagttgccgaaggtcatccctcgacaacagcggtcgaacaacccgaaattcatggtaatttataggacaaattttcaccacatgaccacataaattttagctagcaccctttaccaaatgttgccttctgtttgtgctgcagaattgccgtaggaacaacatacgtcgatgtcgggcgggacaagtgcaagtaggtcgagtagaaatccccggtcacaaaatatatggccgaccacagtgcaagttataagagaggttgacgctagtggtaggcccacggcgcccaggactgtcattggaagatggtctaactgctgcgggctggcggcacgtgagaacttcgggatcctctataaagatatcggtaaggtcacagaagccgagaaagaacgagcttggacggcaatggagaaatggttcacatttccggctgaagcaaaggttaggctcaagcggaaggcattccataagatgtgcaaagcttggaagaattggaagtcgaagctcttcaccaagtttgtcaacccgcccagcaatcatacgccgttcgatgaataccctcaaataaccgaagcggtgtgggaggaattctgctctctcaagaacacccaagagtttagggaatcaagcgaggcacatcgcctactgcaacagcggaatgagcacccgcatcggctgggcaccgcagggtacatcggcaaggaggcaatatgggcccaagaagatgcatccgcagcagcaacgaatgtccctcccccgttttcagacatccctgaacaaagagctcgcaactgggcgcgggcaaggggtaaggtcaacccggacggctctgtcacatttgagaacaaaattgatgccgtcgtctatcaggaactggtgagttcactacttaacctaactaatttctgttcgtataaagtacaagttcgtata

SEQ ID NO: 20638 - DNA, 4839 bp, Oryza sativa
ctctcagtttcaattttacttgtcgtttcaatttactggttctagtattcaaaattttgtcaaaatatttatcattttcatattccaagcactttaaagatgtttttccctactattcatcaatatatccatactaatactactcctcacattattttaggtaaaattggttaggatttaattaacttagcatacctcctgtttaatttgagatttatgtataacgataaataaattgaaatgaagggaatactaattaacggactagagagatatcttcatggatggatgtttttttctgaaacaaattcatggatggatgtggattattcgtgctacccacggttggttggtccctttcataattaaggagcttaactctctctatatatagtcgcagttcttactattacattaccacttctttatagggattttctaagatccatgttttactttagactatgtgtatatatgatgacaatatattggtgcgtgattgtgctctgacgatcgaatagctcaataagtcttctcgtaacattgtacaagtgcaagcgctggtcacatacatgcacgcacaacctacccctacctctgtcatgactcatgaggacatccaaggaaatagggtcgtcacatctcgagattaacaaagtcactacatatgccttattattaacgggtatgttgtctagctatcatcgaaaaaataattagccataagtacaagcacttacgttgaatctaggacttgaatatggatagataagttttatcacaagaaaatctaagtagttgagaactacgcttaatcccaatcaaaatagacgcatacgtacgtctaaacagattgaaggcctgaacttaattatatggcccagtctaagatcaattgaaaccaaatgatcgagcaaggcgcgcgcggttacaccacgtatagaacctaaccgtgcatgtgttttatagtaggacttgatggattaatttttctcttgtcggtgcgtggaattatcgggagattatatccacgtgcaaactaatacctaaccaccagccagtccccaacaatatactccgttcgtttcaaaatatttgacatcgttgactttttagcacgtatttgaccattcatcttatttaaaaaatttaagtaattatttattcttttcatatcatttgattcattgttaaatatactttcatgtacacatatagttttacatatttcacaaatttttttaaataagacgaacggtcaaacatgtactaaaatattaatggtgtcaaacattttgaaacggagagagtatatcagctggccaaatgacaacagatcatcgtcgactttataacagcagatctcgaggaaaattaaagcgttaacaaagtgtgtagcaagtttctttcacgtagaagtagaccacaatgcaaaaacatttggaatcattcgatgctttcatgtgcccgcgagatatcgatcgatcgatcgatcgacattgcagatcgacgtacgtacgagagaaaaggatgcatatataatgtcgtcgaaaccgacctgatgcaaacacgtctcgtcagagagagagagagaggaatcaacagagaggggatagaatcgattccttgttccaaagcaagcaacgtacgcagctagctagcagctgggtgcacgtacgtacacaccagcacaggtcagaggggacaacatggctgtatattgtagctttcggcggcgagccaaaagctagcttgattcgtatgtgtatccatccaatgcgaccgtgaatgaattaaccggtcatttgctgaatttgtacattcatattgcatgcgtgtgcacatgcagtacagatcgatcgatcgatcgagcatctgcaaatacgtgcagcgcgtgctttccttccttcaccgctgggagatgccagatgccccggccagcgacgccacactgtcgagaggcttcatgagcgtttgttccgaacagaattaaacatattcccgaatattaattagacgttcgacctgatgattctagctttcgtctacatgtacattgtcaaaactaaagcaagtccgaagaccattactcctcttactcctctcctctgtttcatattataaatcgtttaacctttttcctagttaaagttcgctatgtttgactaaatttataaaataaattagtaacatctataacaccaaattagttttattaaattcaacattgaatatattttgataatatgtttgttttgtattgaaagattattatatttttctacaaatttggtaaaacttaaagatgtttgattaagaacataaatcaaacgacttataatacgaaacggacgaagtagctagctagcaggctatatattgatctactagctacctctgtttttttagtaatcgacagtaaataatattgaataaacacacaaaatttaaccactaatttttttccttcagaatttataaaaacatgtgattctgcaccactgcattaaaataaaattcaaaatgattctaacagtatgtgctttagtgtacaaaatagaataaattagtgttcataaaagtttggataggagaatcctctgttttcaaatagtcagtgatttataattaatgcaagtgttaatatttgcattgtgaaaaatatcattttgtttgttgtagaaacaatacaatgatgcatgcaatattaaggacaatttaaatgcaggagtaaaatttttattaaagacaaagttatatgaaggaaaataaaatggtaggggatcaaaaaccatttttatgccattatatttttaataactttaaggaatacacagtattaaaaaataattatcaaatgttattgtttcccatgttagatatgtctagaacgactactaagatagtattaaatacagagatataaaggaagtctccaaactttttgtttgaattacaaacccaagggctaaagtttattacctgcatgttaattgaaggaaaaatatctgcctcgtactgcactgataacgtacagtggattgagaaaatattaattttggattcatctactagatttactagctcttacaagaggattttcagtaataagttagcactggtacttaactagcgaataacttcgcaaaattctgctagtttaatttattttcaaacaaggattctctctccaacttgtcaacaaaatagcactatatagctgacgaactcttacgttacaacattatagtcgcagggtcatcttcttcttttcccctttcgaaggcattgtcactttgtcagccttctgctagcctttggacttcaaatccagcaaccatctgaaaagttaaatggcaagtaattcagaaacagaaaagcatatctgctttgttaattagtttgttctggtgatcgtagtgcgcgtgtgcgtcgatgttatatatatatataaacacatggaggggtcgatctcaataacacacaccaacaccaagcaaccgaaacaacttgaagctatcgctagcttagctgcagctcatgcaataagctaattagaagctagcacaaagtatacgtagtaacagcaattctctgatctcgatggagaacaacaagaacagccagctgcagcctcctccaggtgaccattgatatctattaattgctcgctttctaattaatcttcaattaattaacctccgtgtatacatttgtatgacaaataccacaagctagttaacccatctctctctttatcgtttaaacttttaattgttcgtccatctctgaaatctaaactagctgtccgattaatttgtgcttaactcgcttgaactagagtactcgtaatcatgtgtgtttgtaggttacccgaggttggattcggagcagcaggcagggaagaagaagggacgctgctgtggatcatcttgccgccgttcaactaaacgtggggagacgagctttattgaaggatggtacgtatatatacagtatactccactactccagaacattatatatatattttttagataatcagaacattatatttgatgccatgcattaattctgagttaattaatctctgtttcttctcatcctggctatagggttttttttaaaaaaattttcccatcttcaagtgcgtatatatgtcacttggctagtggctatttaattactgatgtttcttattgattgattctgatttatatgcgtttgttcttaattttttcagcattgctgcgctctgttgctgctggctctgcgagctgtgctgcgactgaagaagggatatatatatatatatatatatatatatatatatatgtatcacatatttgctccagatcattggaaaatcgagggttgttaattatatacgcatggacgtctgtccttatacttgtttagatgagtttgttcccaatataatgttaatttggcgtaatatattatatatattgtacttctctcatgcagtacgtatatagagtatatagtacgtcttgaggcatctatatatactttcttcccttgttattattgataatatatatttatgtatcgactgtcgtacacaaaataagcattttctacattcatgtgaagatcgagtgccctctgtttttaatcatatgcatatatgctcctcttatagtgccctctgcacgcttgagagctctatcgatgattgtcggagatatgggcccgggggtatgcgaagtgaagggaagttaccttcccgtccagccacgtggctctgcaagctggccccactctcgcacctcgcgagtcacgaaagcggccgggggggggagggggggggggggg

SEQ ID NO: 20639 - DNA, 3060 bp, Oryza sativa
gttcggggcgagacatcgccccctagggctctcccgctggttcgccccaaggccctcgcccagttgccacgtggcggggggagagagcgagaaggggacccaagctagacagccataaatacgcggcgccccaactgtccctcactgcatttaatgcggtaagggcagacgtgcggtgtgcctaactgacccccgtcaatcggatgtgaccagtctgtgaccggcctgttgccggtcacgtccgattgaacgggcggccgtgcccccacgtcgcctctgtatccggtgaagtggaggtaggtatgacccgtcacatcggagcgtcactcgaaggagggctaccacaagtcttcgctcatttatgagggaatgacagggctgtcccccgtgtcaggcggggggggggggggggggcggcgctgggtcccactcaaggactggttgctgcttagcttccgggcgaaggcacggatcgaggcccggtcaaagtaaagtggggtccccctcccatggaggggtaggtagaggcggcgcatgtggtatccccttaagctataaaaggaggaccttgcccaccgagacaaggggacgactctcagaaaacctgaactctaggagaaggaaggcgagagcgctctccggagtaaaggaacccttgtaaaactcatccataatcccaaacacaagagtagggtgttaggctccatagcggcccgaacctgtataattcgattgtgtgcaagctagccggcagtcttaggggcgaacacgtgatttctaagaggcgagcctctgcccccggccgaactcacgaaaggggggtctcacgactccccgctatcgagggccttcccttgacaatgatatatatgttatgcgcgtctggctttaaatatacgacgctgttaattttttgtatgacggttgatcattcgttttattcaataaaactacaagtattgtcttttacttgtttttatatcattaaagatactttaaacactctgtttatatattttgcactaaacttttaatgagtcgaataatcaaacgttatacctaaaggttaataacatcatacatttgaaaacaaagagagtgcatttttagagatgcagcgggcacagaatgttatttcaaaatacgaaaagaaattctcaactatataaagcatgatgatacgagatgtcgctgaaagtgaaagggaagaaaactggtggacgcgggagatatctaagattatatttatttgaatggcagagaccacgcgaatctcaatcgtgctgtgctctgcttgtagaatataaatccacatggacaactgatggccgagaaaagcagcaagagagtgaaagaaaaaggctttttagggcggatatggtgtctgaattaacgtaatgggagaactttaacggtcgttggagtttaattcgctttacaaaccttgtcttttagcaaagtgttgttcttcctgttgtcttaattaatctattcatttgaacttatttaaatagcacatacataattacatactccctccgtccaaaaatataagcatttttagaatagtgtcgagttaaacatttttaactttgactattaatagcaaaaaaaaagttcaatcaagtaaaattgatattagtacgcagattttcattaaacaaactatcataatatgtaactttttttattttaaacatcttactttatatatattgttggtcaaaacagtgtcttgaataccgcatcaaagtccaaaatgcttatattttgggatagagggagtatatagtcttttagttttggtggctatcttggggctgtacttttccgtttttttttttgcgagaattgatgcccaccaaagcatatatgccagtacactatatatgatatgcgttggtacagaagggacattatgaaatggttcacaaatgatatagggtatgtctcagacgatttcctgaattcctgtacagtttgagatgagggggattatcacaaatataggtctagtaagggcatttacagggcattgacgtggtaattggctatggctctcgaagccgccactccgtcttagttagcccgcgccatgcccttgccgcagggcccccttgtgccttgcaaagggcgcattgcctcattagggctgaggcccactcagcggtaagcctcccccctgctttaaaaatccatcattcgataccactagaagaaatatgaccttatgtgatgaatttctcgtgacgtcggagctattcgtcattagcacattccattttatgacgattagtatgagatgggttggctcagtgacgaaaaaaaggtgttcgtcgttaataccaactagaaatcgtcataaagtatttcgatgggatatcgtgacgaatattaatttgtcataaggggcacaaagcaaatgtcacagatttatataatgcatttatagaaaaatatatttatagttaaagcaatttaatcaagtgaattaatgaagaaactaaaattttcctataaaaatcatggacgggaatatttttgtaatattctacgtggtctaaattattctctgaaattttccgtgaattttagaagctcaataactaattttaataacacaaaattcatttaacctattaaaataaatagaaaacaaattaaaatcactctctttgtccttgggcctttttcggcccaagtattactctccctccctcagcccgcttctctttccctccttgggacggcttccttttccccagttcccctcctccctcttgggccgctggcctaatcctttttctcctccctcgccaaaaagtctattatttctccctcctctcaattcaaataaatttttgggtagtaaatgatttcaaatgaaaaaattatcaacaacaaagttgtataacttatcaagatctacaacttttgttttggtcattttgctatatgactttgttttaataatttgaatttgaatttcaaattatgacaacttcaaacaatattttcaagtactaaatgatttcaactgaaaacttcatcaacaacaaa

SEQ ID NO: 20640 - DNA, 1803 bp, Oryza sativa
aaatgatttcaactgaaaaagtcatcaacaacaaagttgtataactcagcaatatctataacttttattttggtaatttcttcatccgacaaagtaataagagatacgtacattttgtgaacaatgttacaaatcattttaccgaatgaagaaatgacccaaataaaagttataaatcctgatgagttatgccactttgttattgatgattttttcagttgaaatcatttagtacctgtaaatgttgtttgaagttgtcataatttaaaattcaaattcaaaactgttcaaacaaagtcatataaaaaaatgaccataacaaaagttgtagatgttgataagttatacaactttgttgttgacagcttttccatttgaaatcatttactacccgaaaaattatttgaatttcttatattttaaaattcaaattttatatagttcaattaaacttggatggagaaatgaccaaaagaaaattggtagatctcaatgagttctacaactttacttttgacaactttttcacataagttcatttagctgtgatgtagcaggtaggacccgatttgcttcgttcttgatgtggacgtgatttcattgtcgacttactgttctatgctgctgcagcgagctgtctagaagtactattttcattatagggcaacatgtgctatatatacagatagttgtatttcgtgcttttgatacaatgttgttagtgtatataagtaacttcagattttctatctccattttgctgaaaaatgtttctttatttgtgtttatgcaatatctgtttctgcatttttgtgagagccatgtgagattgatcatacgcctcattgtggttacgtagttgcaggatgcaggttctcatgatcagagatgacaaaatgcatgggcaggttgtagttatcaggtaatgatgcagctactctttagatatctcaatcactcagtgtactgaattatgtttttaaatcatgtatagaggtaaatcatgtacaactgaatttgttatgtctacgtcttcttattgtgctatgcctaactcatgaattttactattcctcactcattccgtgtgtttgttaggtgtctgctcaatatgtaacaagtttcatttactattatttcttctacttatcatgcaatgcaggtttctctatcctcttcatgtcgatttgctgattcatgatggagatggctgtcttttgattggtgtcatttcgacacgtgacttggtttggttagcgaatgtaaatgactatttagccatgcgacttctgttttggcgagtgacttttatgttcattagtgacttgtggttgcttattttgctacataggatatggtcatgtactgagtaaacacgtcgctgaattgggctatcagatgtgtggatgttaattgggttttgtattgaattttaattgggctgaatccatttgatatatgggcttcttgtagcgcccgttccgtcgtggcgcctagcgggaaaattatctcttaaaaaccctaattgcgaaatttgtttctttgcttgttgtctagtgtccgtgccatctcaagatctcaatccctgatctatcgtcgagtccaatcccgaatccaatccttccaaatcaaattcctccgcaaaagtctattttgcctcccccgggggtcgatgggccgatttcctcccggcccatctacccctgggggcggctcctttgacttttgcggcggactttgatccggacggatcggattcgggatcggactcgacgatagatcagggattgagatcttgagatg

SEQ ID NO: 20641 - DNA, 4743 bp, Oryza sativa
ccctccccggcgcgctccgctccccccccccgctcagctccgctccgcctcgcccgcgcccgcgcgcgcgtgcgcgaagagccgcgccgagtgctcctcctcctccgcaccgcccgcgcgcgtgcgcgtgagccgccgcgccgagcgcccccttcccctctcctcgctctgccgcgcctgcgtaagccgcccgcgccgagcgaagtcctccctctccgctccctcgctaccacttcccgcgcgccgtgttcgcgtgcgcacgcccgcgcggacgccgcccgttgcaagccgcgcgcgcgtgccgagtggccgaccgcccggtcgccgccgccgtcagcctctgcacgcgtctgtcgcccgtgtcgtcgcgccgctccaaaccgcccgccgtcatcgctgtcgtcaccgcccggccccgccactccgcgcgcaagccgccaagggacggaggcagcgcccctcctccctctgccgcgtcgcccccgctcccctcctcctttttcccgaatcggcaaaagggcaagcccctttctccccctcctttttccccttttcccccgccggcatcatcctccctgtcgccgctctggccgtgaccgccgagcgccagctcgcgccttgaccgccctaagtcggttcccaaaccgacattgccgcccactttaaaccccagctccttcccctccaatctccctcgttttcgcctcctcgccatagctgccgcccccgtgctctgttcgccgtcgctgttcgttgttgcgcgtgtcgaaggagtcggcacgagcaaggacacggaaggggacttcggccgcgccctctccttcctcttccccggcccgaggccggagagattactcccgcgccgtcggcctctcgtcacagcgcccctcctcatctcggtgatgcctccctccgttcttcctcctcgctccatctcctccccctagctttcggtagtagctcgagtagactccccgtagttagccggcgccgccccgaccgttgtcgtcgctcgccgcgtgctcgccgccgtcgccgctcgagctccgtagcacccacacgtcgccagcctcgctcggcgtagctccgtccaatccgacgctagcatcgagttcccgaaaccgcgtagatgctctcaccgccgggaatcgacccctcgtggcctcgccaccgtttccctcttccctccccgccggttgtcgccgccacgattcgccgccgtcaagcttcctccggcaaatccgagccgttggctcgtctcccctcatcacgagcaaccgtccggtgtgctcgcttttgtccgtatcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgccgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagcccggtccaccggcgctctctctctcttccctcccgcgcgcgcgcacttgggccgccttgggccggccggcccatttaactcggccggtccgctccaattcccttgggccgcgccttagccgcccgaggaaaagtctataatccctccctcttttcttttcttttcttttccaaaaaaggatttaattaaatccttttcctttagaccaaaaaatccaataatcttagaaattcaatatcttcctaaccttagatccgtttgactccgttcaacttccaaaattcctcaaatctcgagatctatctaatggcacgcttagaggtcattattagggtttcattttcgccgtttgttgagttgtcccgtttcgcgtgtagtttcggagcccgaagacccgcagtgcgaggatttcgaggatcaagctctagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttgcatttgatccttccattgttaattgctataccatgtccccttgtaaccatccagttgcgcctcgatattcgtgcaccctgtgccagtatcgacggtcgccttcaaacttaaaatctgagtaataacttgggtaaaactggagttttacaaaagacttggaaaacccgacacctgggtcggtctttgcgaactaaataaatttccaaaaccgcggaccgggaaacgtactgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcgtatggtaaacctgtgtcggctttggaaatgccttgtcatgaaagcttggaggtctcccgacgtggctgatccccacgggctgggtgatccgggttagtaatgtcgtgcgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctgcagctgatgggatcagctaggcccgggtggccgtttgaaaagttgttggcccgggtggccgttgaaaaagctgttggccgggtgccaaccttgtttaaattctaaagactgatacattgcacatactccgaccggatgagacgcactgtctcatccgtgtcgtttgagaagcactcacttagttgtttcagaaaagagttcaaataaaaattaattacaaaaacatcagcctttccttgaagcctgcattaaacacttatttcccatggcttgctgagtactcccgtactcacccttgctctatataaataattccccccccagttgctgaagaagatgaagcggatcctgctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattctgtctccctgtaataccagcactgtttcctgggactggtatcgattaacaggttaatttggagcgtcacgggctagttccggtcgggactagttcggggcgtgacacttcttgagtaagcatggcccatatgctattttgttgcaatgcttgggcctactgggctttttgaatatgcatggcccactcaatatttaattcaatatacatgaattaggctgaatttattaaaatctaattggacttacaatatgcctaactcattaataggtttttcactatatgggctttaaaaaggcctagcccaaaaacagcttgctcactacatgggccgtatcatgccatatggaatctcatgacgttttttaggctagataatgacgaatatgagcgtcacaaagttatgacgatagaaggatcgtcactagattaatgacgaaaaaagaaggtttcgtcatagaacgcctttagagacgcatgataggtgacgaatgaattttcgtcacgcgagcgtcacagattacgaaatatgacgaaattttatgtgtttgtgacgtaaatgaaacgtcacctatcataagatctcttgtagtgtactaaaccgccactactacaacatttttgggccatttaggcttaaaccacacatcacttcaaataggttaaatgtttgttgaggtacagtggccggatcagtgggtggagagagaggatctaaagggaggaggacagtggctatgaggaacttgcctagaggatcccgccaccgtcgtgattgctggttgttgagctagtttgccgtcccacacaccaccttgatttgcgttgtttggattagaaaaggagggggggaggtgtatggtggtggctagaggcaaaggagatgcctacactaatgagtggatctggtatagtctgtgatgccagatatctgaggtgtggggcggatcatacattgccacaaggctgtgatgctcgttagagggccaggatgcgtgtgtggaagaactcatagtgaacaaagattgagccatcgagatggggattagagaacaatgaaaataagttcggggaacgaccgagggacctttgaactactaggcaattgtttaaattagtatctttctctagggttctattggtgaattgttaggatcaaaagttagttgagattaaagatgtcagttgagagttgagatcaccttgcaccgtggggcaagcgaat

SEQ ID NO: 20642 - DNA, 1301 bp, Oryza sativa
tatgctgctgctggttgtgtgacctttgctgcgattagaggaagggaaacagatgagattaaaagatgccttgatattatatgtggatagtatttctacatgggtgtgctgaaaagaggatctttggagcagagaattgaatacaacgaaatgttgttgcagaaagtatacatcccgtaatttctgcgtatattttcgatatatatatagcgcggaataatgaataatgatatgcgtgaagtatctatgtaattcattaattacatagtgtgctcgttttgatttgtatccatttttcagctcatttattttgacccatataaaaatgtatagataatctgattcctcaattgatgagttaatctttccttggctccagatgtgtgtagcgagttagggacgcacattgttttagatgatggaaatagtttacgtctccggtatctgtcgacatgcaccgttgcgcacacacacagtcaataagttttacagttgagaaagaaaaagacaatatcaagtaatgggacaatgccccaagtgctctaattaaaaagataaccattatatttaaattaaaatttaagacaaatcatacaaatttcagcaagtaattttataggtactataccattcaaagcgggaaaaaactttttactaccaattttaagagagtatagcaccactgcacatagatcccgttcctcctgtgatagcgtcaaagtgcaattgcgaagctatttagtagacatgaagatattatgaatttgaaccttgattttgataaaaaaaaactagcgattctgactagttaatgtttattcttagggtgtgttcttatccataaaaaatattatggatcgatgcaacagtacacttcccaagctggttttaacgattctacatgaatttcttaaaagaaaactatatcaaatctatttgttaactttgtaatagttaatttattcgtttgcaccatcgactcacagaatcatttaagtactattcagctattcgagaaattaaaacaagcctcgagggattaatttcaccatccttgataggtactaggaggtaccaattcttttttttttaaaaaaaatattgacaccttttagtacttatagtgtagaatttataaattctacacactagaaataaaatatagttactctcggtatcctctcaaaacaaatgtaaaatttctccattaatttgtaggatcgaatcacaagaactaagccaaccagatggggggggggggtgaatggttggtatacccaaaaaccgaaaacttttagcgg

SEQ ID NO: 20643 - DNA, 2676 bp, Oryza sativa
ggtagcctaaagccacgaaccaaactcatactaagagtcctaaacaccttagaaaaccctctagtacaagaaagaaactttacataaccaattgtaccaaatttggactccttccaaattcgactccgcatcccatacgcacacaatacctccatcgtatgccatatggaatcttcaccaaccacgtgcatcaactctagccttagtatcctgcgtgatatctgaccaccacggacatcgtctttccaccaagccgactcccggtccatcaccgcaaatactctcccgaggcatcgagtcacctacacatgaaacaaacaaagaaactatattccgagaccaagctatctccgacttgactcattgttagcaaacaacagtattacatacgtaaagtatccatctagaagccataaccatgaaacaatcacgaatatccaaagaaacaaaccgaaaccgaaaccgacacagcgtcggccggtcagactgcgggcctgccggtctaactgctcgattaccaccggtctgaccggcatacaccgcccggtcggaccggtcacatgaaataacagtgaatccgatcatcacctgaaaattgattatctccaaaaccacttcgacgataatctccaaatatcaaaaccaataatcacagatgccaattgttcatcacagaataagaatcaaaacacactttgatcttacataattaacatgatagactgcgcgtaggttgttaggcatatatatgttgatatgtaggtctcatcagccttccgagggatgcccaaataacagtacgtatattgcttgcaacaacgagatgacattcacacaggcggcgtatatatatggttcgtcaaaagggacctacaaaatactcactccgtttcatattataaaacattgtaatttttatcataatcaatctctttttaaatttaattaagtttatataaaaacatagttccgcattttcaacactacaaaaatattatcaaaacatatttaatgaaactaatttggtattttagatgatgttaaatttttctacaaacttggttaaacataaaaaagtgcgactagtaaaatagtataaatgactttttttttgagaattcatgcattttatttaaaagagaaaatatcgtttagaaacaaattgcatgagttatagttacatctccagtgggactactggtaagtgctagtttgacaggacaaacacccctttgacaaatgtgagaaatatttgagcagtcaaatagtataaatgacttatagtatgcaacgggaggtaatagatactaactctattttggttttcatcactcttgtactagcatgtactttcatcttataagttgttttgttttcttttctagtacatcaaactttctttaagtttgactaagtatatagaaaaacatagtatctatatcacaaaaaaactcttttttcaattttttttgtgaatttagtcaaaatgtattcaatttcagttaaaatttcaaataatttcatgtaaaacagttccaaaaatatttcagtgaccaccgaaatttcgaccaaaaccaaaagtgtaaccctgcttataaatgtacgacgatcaagaagacagggaatggtagccatagaggtggagcgagctagcagttgagatagaggggagagggagattagttgagagacgtgggaaaaaaatgcatgtgatatcatgcggcttcccaacccttgtatagctccccacctgtggagattatggatatcccatatctacacggcgatgatatttggactggatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaatgggttccgtctccggcatcgacgacctcgtcttcccacccggggagacgtttcggttcggcagcctcgacttcgtcaccaacaacttcggcaagatctctctccttgactcggtgtccgcccagtcgggagagaaccggctttcagtcccgtttggactcccaaacgcggctgaaagttacttcaagaccatctcaatcgagttggcttcaaaccactcgggcgagatcgcatcttccccgccggatcaagatgatggggcttacccaccgatcctaatgaagctccccgacgattcggcggccgcctccatcacgacagcgtcttcatcccgtaggcctaggcggaagtcggcttcaacaccgatttcgcctagcttcagggaagtcggcgtcatcctccaaccactcggcacggtttcgacggatcagttg

SEQ ID NO: 20644 - DNA, 1911 bp, Oryza sativa
gccctaacgagacgagagcaacgccaagcccgggagaccgaagcacgtcgcgaggctgagcgtctccgactggaggaggagcgtcaagcacaagaacaagaacggttacggcgtgagcagcaggagcgtgagcggaccgcgaaggaggctgaagatcgacgacagcgagctttggaagcagggcgccgagcgcgtgatctcatcggccaacaagatgttgaagggacaccggttttccgcacccctcagcagaatgcggttgccgcgatcaccctcctcgacaccctcctcaaggaaaacgagctcaatcaatctgatcacgtcgtcaacatcttgaaccagacgaagaccatgattgcggcttcggtcccagttaactccgaaagcgtccacacgccgactggcagccgagttccccacttccgatctcatgactaccgtcatccaagcctcagcatcaccggcgcaggatccaatcgtaggagcaggggtcacgacgggcggtccgttcactcacctcccgaccatcatggggagcgccgagtggaacggcctcgctcaccacctcgtcgccgccccgtcgatcttcgcgacacgatcatacagcgccgagcaactcgaggccatcatcattcgccggaccgccacgacgacgaccttgacggagtagcagccttcaccgacgatctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatctaccagtggctttagcagattccgcccgatcttggctccatggattgccccgtggtacaatcggatcttgggccgaattacgcgaccacttcatcgccaacttccaaggcaccttcgagcgtcccagcacacaatacgacctctacaacgttattcagaagtccggagaatcccttagagattacatccggcgattttctgaacaacgtaataagatctccgacatcaccgacgacgttatcatcgccgctttcaccaaagggattcgccacgaagaattggtcggcaagttcgggcgtaaacctcccaggacagtcaagcttatgtttgaaaaagccaacgagtacgccaaagctgaagacgccgtcaccgcatcaaagcagtcgggtcctagttggaagccaaataagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactacacggaagaactccgacgaagaacaaagcacgtcgatgaagaaggacgacggcgacaccccggcaggatttcaagaccaccgcaaggagctcaaccatatcttcggcggccccttggcttatgagtctaaacggaagcaaaagttgactgaacgggagatcaatgctgttcaacccgacacgccccagtatcttcgatggtcagaaattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgacatgcagatccctcgctccgagctaaaaccaagcaatgcgcctttccacggagtaattccaggattatccgcaactcca

SEQ ID NO: 20645 - DNA, 1722 bp, Oryza sativa
tgtgttgattatactgacctcaacaaatcctgccctaaagtccttttgggttgcctcgcattgaccaggtagtcgactcgaccgccggctgtgagcttctcagttttttggattgctactcggggtatcatcagatccgactaaaggaatccgactgcttgaagacttcatttatcacgccctttggagcatactgctatgtcaccatgccgttcggactaaaaaacgcaggagcaacttatcaacgtatgattcagagatgcttctcaacacagatcggtcgcaacgttgaggcctatgtggatgatgtagtcgttaagaccaagcaaaaggatgatttgattttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatccttaacatgaaaccgccaagtacccagaaagatgttcagaagctgactggatgcatggcggcgctcagccgatttgtttcaaggctcggcgagcgggggatgcccttctttaagctactaaagaaaacagacgacttccagtggggacccgaagcacagaaggccttagaagatttcaagaaactcctcaccgagccaccagtcctagcctcaccacacccgcaggagccgttgttgatgtatgtatcagccacctcccaggttgtgagcacagtcttggtcgtcgagcgcgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccactcgatgatatactgcacaaccgtgaagcaaacggacggattgctaagtgggctttggagttgatgtctttggacatatcattcaagccccgaatttcgatcaagtcccaagcgttagctgattttgtcgccgaatggaccgagtgccaggaggatacccccgcggagaagatggagcactggaccatgcattttgacgggtcaaaacgactttcgggcactggagcaggagtagttctaatttccccaactggagaaagattaagctatgtgctttggatacatttttcggcgtcccacaacgtcgccgagtatgaggcgctccttcatggactacggattgcaatctccctagggataaagcgtctaatagttcgaggcgattcacagctggtcgtcaaccaggttatgaaagagtggtcctgccttgacgacaacatgatggcatatcgacaagagatacgcaaattggaagataagttcgatggactcgagctcagtcacgttcttcgacacaacaatgaagctgccgatagactcgccaactttggatccaagcgtgaggcggcacccttcgatgttttcgtcgaacacctttatacgccgacagtacctcacaaagatgctactcaagttgcgggcactcatgacgtagctatggttgaagccgactggcgagagcccctcatacgatttttgatttctcaagaactcccccaagacaaagatgaagccgagcggatttcaaggcgga

SEQ ID NO: 20646 - DNA, 1357 bp, Oryza sativa
gtagtcggcggttacaccgcacctctttgtggccattgacaaattctccaagtgggttgaagctacaccggttgtcacaatcacagcggataacgctcgagatttcttcatcaacattgtgcatagatttggagtgcccaatcggatcatcactgataatggcagacaattcactggcggagtttttaaagacttttgtgaagactttggaattaagatttgctatgcctcagtggcgcatcccatgagcaatggacaggtggagcgagccaatggcatgatacttcaagggattaaagcgcgtgtttttgaccggctaaaaccctattccggcaaatgggtgcaacagctaccatcagtactttggtctttgcgaactacacccagtcgggccacaggctatggggcagaagcaatgttgccgagtgaagttgaattcgagtctttgcgctttcgaaatttccgtgaagaacgctacgaagaggaccgagtggatgacttgcaccgattggaagaagtccgcgaagcagctttgattcggtcggctcgatacttacaagggttgcggcgttatcataatcgcaatgttcgatcccgtgcctttctagtcggcgacctggttttgaggaaaattcaaactacacgggatcggcacaagttatctcctctatgggaggggccgtttatcatctctgaagtcacccggccaggttcctatcgactcaagcgcgaagacggtactctcgtcgacaactcttggaacattgaacatcttcgtcgtttctatgcttaagcttatcattgtacttccttatcttaactgtcaacatcaagttttcttcttgaagttgtcagtcgggggctatcatcataataatggagtgtgattttttaccaattcaatttgcttacttggtttatcattgccttgttcgatttttctacttagtctgcgaggactgaaagtttttaatagcttctttgggttttaggctcaacaaagcttgataaaagctttaagaaatcaaagatttcgctagaactatcaagcacagcatatatacaccagtattgtacaaattgagcctccatttgttacattcatactcaatcagaatcagtcctttcatcatcagagttattgttgctcggctgaaggtcgttgttgcggaattgctctacaacgtcacttgcaatcttgtcagccgcgttttgagcattgctgataagatcaagagcagcctcttcgcttgtcccgtctgcaaagccatcaatggcatcaatttcaattctcgggtacaaggacttggtcatcgccaatgccatctagctcccatacttccagctttcttgatgt

SEQ ID NO: 20647 - DNA, 10418 bp, Oryza sativa
  unsure (1)..(10418): unsure at all n locations
aatctcttcttcatcatcgcctggtggtcctgatgtatttccaatacgttagacgaataaaccgaggttatttaaatcagcatcacttgagaagacgggttacctgaggatgttcctagctgagcgtgaggtgatccttgttctttatttggagacccaatcatcgagtcgttaccagcctctggtccttgagaagttgtcgtctgcgcttcaacttcggggatttcttgatcgagacctacatctgactggtttccagtcgggggctcttgggttgttgcagtttcagctgctgccgactggtttccagtcggcggttggtcactcggatcggccttatcacccgaagcatgggcgccagtcggttggctttcggcagtcggctcaggatccttggataaatttggctctgtcacagccggatcaggatcttttccagttgggtctatgtcggatggtttcctgcaaagtgttctttcaatattcagtattattttcatgagagaagcgtgccgaagtgaaatggtaccaagaggctttatacctagaagatgttctaatctttggcgttgggcagttagccagttttttcctgggcatggtacgctttgggagtttattaggcgagcccttgtccccagatttgttgtcgtcgtcgccttcatcgttgtcaagcaccagttttctcttgcgagaacctgtctgtccagttggattggaggtttgaggttgcgaatctggtctgattgttggccctccacctccctgaacggtgtgctggcgaggagaccggcgctgagtgattgggggatcagattttatcaatacatattcctgaataagatgcctccatggttagttaactcaatatgaagacaagatactattttggtcataggttgaagatttcagatacacacctgcggaggcggattgaatgcattatatggcacgactggcagctgatgtgagtagctgacgacaatagcatttgagaagattttatacattctctccttcatgattttaaaatccagagagtctggttcttcgcgattaggatcatgcttgtcgtcaaactcaaaagctgtacgggatctttctttaactggcgccagtcggcatttgatgaagtgccgagtgatctgctctccttgtaagccttgttctttgagttttagcatgcggtccatcaactctaaggcttgggctgcttcgtccccaatcggaagagagttccaagtatcttggtacactggaggaagacaagagtactcgggaagagcaggctcaggattctgaacataaaaccagttcgcatgccaccctttgtttgaagtcttgaagggcattgagaagtacttctggctcagagttcccctcagctgaaatccggcccctccgactacacatggcttgctcttgtttggttggggtttgagaaagaagattcggcgaaacagagcgaagtggggtttaattcccaagaaggcttcacagacatggatgaaattggcgatgtggactatggaatttgggtttaggtgatgcaagctgattccatagaagcttaatatcccgcggaaaaatttcgaggtcggaagagcgaagccgccataaaagaaatgagagaagaccgcaacctcgtgtgtatcgggggacggaaaagcctcaccgcacgctggccgccacccgatgatctccttggcagggagaacgccgtgcgccaccatctccttcaggttctcctccgtcacgtcggatggcgcccattggccttcaaagctttctttctcttccaccattgattttacccgaatgcgctgatttgattcgggggatggctagggagaggtgagggattgaggcggtgaattacgggaaggattttgatgaacttttcgaaggtggatttgagtggattggtgaaccctagtttgccggcgcagctccgtactgtagcagggagtggggaaaatggcgagagttccggcggggaagacgaagtggcgcttggatcacgggattttttgttaagggtatcggaggtgcgaatgggcttaggcctgaacagtacctcagcccaatacttttaacagcgtggcccattgtgctccttagggacttaggcattttttgctttggcaacttatgcgcacaatagtgttgcccaatgctgataaaatctttttttacgcggtcatataattcttcggaattattgcaatgccaatttttcaggtgtggcctgtcacgttcttttagggactcaggcacttttcgcttacgccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctctttgccacgtaagtgtgcatttttattgaccaatagtatggcttaggctgattatatattgtagtcattttttttaggcggttggtaaatcctttatgagtttatttactcggattttacaccacatattcctgttttcattatggtggatagtcatagcttagactattagacttattcattaccataatttttataatatttggtgggtaatctttagagttttttattcggatgcctgtcaagtgtgttcattcgtgaaccttttagagtgttaaccactcggattctttttattatggctaanaagcagtcggctagagtgcctctttaggcgccgcatatgcttttgtcatatgatgcatgattgtgctattatttttgttctcaactatatgtttagtttgttaactaatcacatagttggaggctacacctaattaggtgcatctattcgatgcaccatattccttatttttttttgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactagatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagaggttgattttctccaaatcatacaatcaataatacactcggcggattcatccccggacaggagtagggtattacttcttgaataagaaggcctgaacctgtataaatcctttgtctccaaacccatacacttttccagcttgatagccacccccttttattattgccgaaatctagtttcgacaccacccgtgcacttccgatttattcacatgtctacttgaacaatattatgtgtgcaccatagtgatatgtttgtgcattgcaatatagatccatacgactaagaatgtggggcgatgcatgtatggggccctatgactgaagatgggctaggaatatggatttagcataaagcaccggatctaacaagttttttcgttaaccaacatatattgtacgctttgtgcaaggagggatgactccacaagtggaaaatcttatatctactacttgaaaagtacttgaaatataagatcttcccttttatgcatgtatgacaaattagtggcaatggtgattattaattgcaccgtcgcatttgaaagagggttcatgcgttttttcttctagtttaatcttttaaaattctgtaagtgatttgtgcatcctaatacaatttggaattcaaaaactatgtttagaaaagagagctcaaatcatcccaccacgcataatcttcgataaattgaagttcttgaagcctaaacaaaactagctaatcaactgtttttgagaatatatgtggtgctaaccctacatcagcttttatttgatttgtcccatcacatttcatctcatatgtgctataatttcaagagcataataacacgtagcaacttttaatattacttagaaagcagaaagtaacgatgtttagttattaatcatttttgtaatctctcaaaggacttgctttggtaaaggattattaattcagtcctttaatttggtttaaaaatcaaaaatcaactatgtataacttaattaccaatatgccattgccattgcaatttactaacctgaaattcactatatatccaaatctcatctattcatctcactgttaaatgaaaatacattattttgattccactaggcaatttcatcatatattttcctcagcaaagagaactgaatacttaataccagaaagtaataaaaaataaaaaaaatcaacaagaacgacattaatttaaaccacaaccgatgtattaataattttaaaagtagcacaacattgttctcttaaccgaaaaacaaagataacaatagtgttcagaacacaaacaaattaaacagcaacaagaaaaatcacacggataaataatacatgttcaacaatagaacatatatcaaggacaaagaaccatagcatgcatctctaggacacacacgatcaccaagctgtgtgtgtcctctccccttgatcatctgcatgcgataatcgccattgcttcactgcctcctccacgcagagacgcagaacattggcttctcctccctgttgaggatgagccacccgccgccctccgtcaccccatacctcctctcatcccctcctccgggaagccgcgccgccaccgccctcacccgccccgccgccgtcaccacggtgatcgccggcgcgagcgcgaacccggcggcgcccatccggacgacccacctccccagcgtctcgtgccgcgcccagcgcggcccgtcgtgatcacatgcaataacgtccttgatctcctccctgaggaggtacctctccgccgccttccgctccaccgtggcggcgcccgcctcctccatggcggcgaagagctgctcgtagtagggcagcgccgaggcgaagcggtccgtgaacgacggcacgaagtggttggcctcgttctcggtcaggatgatggccctcggcgacagcaggtggaagccgcggaggagcctgtccaccttcgacgacatgttcgccggcggcagcggggaggtgatcatgctggccgccgccgccgccgccggcgacggcggcgccgtggtgctgaggatgccggcgccgacgaggcggtggagctggagcgtggagacgatgaccacggcgtggtcgctcctcaccccgagggcgtccagcttgagcgcctcgacgctggactcgacgatgtggaggtcgagcggcacgccgtggcggtcggactcggcggcgaggacctgcgccgcctggccgaggaagtgcttgtgctcgtggacgatggtgaggcggaggcatgggcggaccgcggcgcggcgcgtggcgaggccctggaggagctccacccagtgggcgtggtggatgccgccgaggtcgacgatgtggatgaacttgtcgttcctcgtcgtctcgaggatgatctcgttcacggcgacggcggcgaggtggagcagcgggcacaggttgaggaagctctgccgcgcgaactcggcctcccacgcggtgagggcgtcgccggcggcgccggcgtcggaggggaagagcgcggcggacacgcccctccagggccggatcaccacccgggccatcgcctcggcgaacgccgcggccacgcgctgcacggcgtcgccgtccgaggacgccatgcgagcgatgctggcgagctcggcgtccgcgtccgccggccgcgacgcggccagcgcctcggcgcagcgccggaggtggccgtgcagcgcggcggagcggtgcgtggcctggttcctcctgtgcgccgccagcgcgctcgccaccgccgcgagcgaggcgttctgggcaacggccatcgtcgccaacggcggcgccggcgctggcgctgctgctgctggaccagccatcatcggcgccgcagccatgggtggcaccgagacagccacagccgccgtcggcgttgagccgagcggcctcagttgcaaggacaaggacatgctgccgccttgtccttcgcctgagccagaggcgttctgtgacgccgacgacgatccatggccaccattatcggctgctgccacagctgccggagcagtagccgtcgccatggacgccaccggaaccggcaccatggacccgaagagctggaaattcgtcatcggcacggcggcggtggtggcagcggcggtggtggtggcggcggcggtggcggcttgcgctaccatcagttcagaggtgttcgcggcggacggcgtcgaggacgaactcttctccgttacagctactgatctgataaaaaaaaagagaacttaaattaaaatagtgtcacgtacacaatcttgataagagctagctagtgagtgagataaataagtgtcacacaatcttgaggtgaaaagtgggaaacacatttatttaagcagacgggagaaaaagattattacaaacagtgaagaaacacaaaaaccctagctagttttatcctatgcatggagacactatacatgtatttcctgctcgtgtaatctactttgaagaagcacctaaaccctagttactttttttttgcgacgaaaaccctagttacttgtattaatctatggagacagtacaccacatgtttcctgctggggaaaaaatctacaatggagaattaaacgcataaaccctagctacttgtatatatcttacatggacataagactatacgtttcctcctgaaacttttctatctgagcagatctattgaagaaaaataaaaaataatagttgtatatgttgtttctcgcttaccttaacgcagacacagatctgcgacgaggagaaaccctgccaaaagacaaaagattatgcatccgttagagaactagcatacaacagatccagatttgttttttcaacaaaagaaaacagcacgaataaatcagcataaattaatctgacccaacgctttcaatcaaaacatacataaaatccctttccaaagaaaaaaaaaagaaacatacataaatcaatctgaatcaccccggcacatatcagatctattattaaacatcttgatatatggagttattgacaaatcagcatgaattaatctgactcaacgctttcaatcaaaacatacataaaatccctctccaaagaaaaaaaaaccatacagaaatcaatatgaatcaccccggcacatatcagatctatataaacatcttgatatatggagttattcacatggcagagaaagagcaaatcccatgtatatatgctctagctatctcaagtcctcaacacagatatatagtatatcagaggacgaacagagatgctagctccttatacatataaatcaatctgaaacactattagatctatacatccaagataaaacagatttgtttcacagataagcagagaaagagaaagaacacaaatctcgcatatgctcttgtgtctctctatctctatctacctcaacaaagacgacagaaaccagaggaagaacacacagatagatcgagagagatgctctctctgctgccttaccctagaactcgacctagcttttgctggctaggagaagatcgagacgagcagagagatcagaagagagctcttgcttagaaatggacggagcgagctagcagatgagtttgggagagaggacgtgaggtgtgggtgcctatttgtagcggagggaaatcaatgcatgccaaatttgcaaaaaagagtgtttgaaatttggacaaattttgtgggcgcgggctacagctcccctacctccggtactcgttcacacatgcgcctaaaatcgaacgttaggggtgcatatatggtcttcctttttaagcatccatccatgaatgacgtacagctttcaaagctagctaacactgccacgtttgagggaaggttcaagccagcattcctttttctacttgtgttaaatatttttatgttccagttttgtcgtcctaaaaagaaatatatgtaaaaaagtttgttcaattttaatttgttatcctaagagaaatttgaattaaaaaatgctttgctcacaaaatacaaattggaggtgtaaaatgtatatttcggttgcacatttttaccagggaagcttcaaatatactgcgtgaaaaggagatgtatgaaaaataaatcgatttatattagcggggcatgtcaaattgatttgttcctgtcacgtttcatctcatattatgctttaacttagagagaataacaagttcatttacaacatggtaaggaaaagatcgatctgctagtacccaaataggtatatgatctgaagtagtactctagcatagccagcagcttgcaccataaatatcttccttatttatcctttctcgactgcattggactagtgctcctcttttagcaatcgccataaaagctagagggctgacaaaagggtgatttggaatgttagtacatataaggattcctagagtattacttgtcatattaattacctctcattcaaatttattaccattttatcccccaaccacctttccatcctcgaatcacccctcgtctaattagtagggttgaaagtgatttggattttccgtccgaccggaccttttttcggattcggatagttttgattggatatatccggaaattttcgaattcggatattttttctggaaatgaaaacgaatatgatatatgtgatatctgtcggaatcggataacggtctaaaactatccgttattttccatcggatatccgcattacacgtaaggctgccataacccataagctagcccaacccaagaggcagcccatcccaacaacaacaacgagggttccccacactcactggcacacagcacagccgccgcctcctcctcacccgccacatcgtccccgcggggccaagccgccgccgccgccgcgtcccatcgcctccttgcccgccacatcgccatcgcacgctcccgccgtcgtcgctccctagggcgtgggaggcggatccggcgccgccgaccctccctattgccaccgccactcccgccgtcccaccaaaccaccgtctggccgccgcttgctggccatccgctgctgcctccaccggccgtcgtgggcgctgagcccgccgctgggcgccggctaccgagagagagagaaaaggaggtgagagagagagagagagaggactgagaagtggtgaggagaagaggagaaataatggtggagagagagaggactgagtgtctgagtgagagtgagaagagaagataaggttgctgaaattttgaagtggtggagagggagaggacgcaagacattttagcaaaaataaatttcgaattgaattttatgataataatgaactcatatgaaaaagttatcaaaaacaaagttgtagaactcattaagatctatcaattttattttggtcatttctccatccgagtttgattgaattttaaaatataaaaaattcaaataattttttgggtagtaaatgatttcaaatgaaaaaattgtcaacaacaaagttgtataacttatcaagatgtacaacttttattttagtcatttttctatatgactttgtttgaacaatttgaatttgaatttaaaaatatgacaacttcaaacaacattttcaagtactaaatgatttcaactgaaaaagtcatcaacaacaaagttgtataactcatcaagatctataacttttatttttgtcatttcttcatccgacaaagtgatagtaacattgttcacaaaatttacatatctctcatatttggttttataaactataagagagatatctaaattttgtaaataatgttactatcactttattggatgaagaaatgaccaaaataaaagttgtatgtcttgatgagttctacaacttttatgttcatgactttttcaatagaaattattaactacttcaaaatattatttgaagttttgaaattaaaatttttaattgataaaacaaagtcacaaggaaaaaatggctaaaataatagcagcaagaacaaaataacattatagagcataattttaaaaacatttaggaaaaagaatcatccagtttggagttcatatgagtgagataaactagtttcaaattttattttcgcatacggctccttaagacgcccgt

SEQ ID NO: 20648 - DNA, 8872 bp, Oryza sativa
  unsure (1)..(8872): unsure at all n locations
tccagacgcggcaagttgtgatctgtcggtgatatgggcccgagggtatcaagactagagggaggaggttgccccggtacccacgtggcactcccccaaagggggtcgggcctggggtaggttggcggccgccccctctgagcctctgcatgacgccacgtgtgcgggattaggtgggcacccccaacgctcacctaactacatttagggcggcgcgcgcgggagagggggagagggtggtgctcggctgaggggaaggggagggaaaacagaataggaggttaggataggactttcctaaaaaggaaaacaaatgcggtgccgttttaggtaaagaaacggaaatggtcccgcgaacgaaaacggacagttcgttatgcaaaacgaaatcgcggacagagaggggagtgaattgggcacaattcatgaccaaaggcaaaaggaagaattattgatgtgatcttgacatttttaaacttagaaacattgcctccggtgctttgtgaattgcactttaagtcctgttaatgagtttagagcaaagaaaattcaaaaaagaattctccctggcaattctgattattaagtatatttgttaattagggttttctcctggttaaccaaagtaatttatgtagatcatttattagtgaattggaaacaaaggaaagggaaaactccaggtgtgacaccgaaatagtgcgcctacatattgctcacatgtcaggcggcatgcagcttggcctgcctcatcacgtcatgataatgagaagcttttagcctctcatcccggccggagtcggtccatccgctctggtcaaagcagggctcccgtttctcggcgcaaacgggaactcggaagtcttcattcagtaaaagactaggcctacatgtcattggcatagaagagtggcgtcaaccctggccgcctgtggaaggtttcggtcagggctgacaccgtggctactatcggtgatatgggcacgagggtatcgtgtctagagggaggaggccaccccaaaccccacatggcactcccttgagaggggtcgggcctgtggtggagcggcggctgctccccccacacccaaataggggtcgggccgccccgaccccctccgcattcctgccagtgtgcgtgggtgttaacaaccaaatttggtaatgccatgggccggattcaaagctagagtcaaagccgatttggagaaatgctatttgagaaggcagagtacgcatcggctgccgcatgaatcggctacaggcagtatcggctgcaacatataggctagcgccaaatcaacggactcaagccgatgcaaccagtttcgaaaaagacagtcccacgtctgtcatcgggattagtcaaagctcttcatagccattgccacgcaaggattggagtcctaaaaatgggcaattgtatctattaattaggacatttttctgtttccttagagatatgtttggtaagagtccacctaagggatttattcatattttaaattgtattagagaaaagaatcgtgtccagcaaggacatattatgtacttcgggtataaatatgacccgacaccatgtaatcaaagcacgacagttcaataatacttcggcgcatcgccaccctattatattttcgttgtttcgacgagtttttgctttcgagttaggcttcatcgggttcgatctccgacgaagaggtaaagcttgctatggcggattgtgttctcgggattagtgcttacatctttatgacactctaatcctgtctatgtgaatcgccaagttatcatatatactgcataatctagattgatttcgtcatctaacctcatcggctagcctctatcatcgaaaacggccgatgggtttaagcttcgaagtccatctagactatgcgatatatcttccatcctatatatcttccatcctgaatgagtttttatcgatttgcttatggaccttttgtttcctttcacgcttaatgctgcatcggttaggttcgatctattaagtattgtcttgaaacgtcttgtctagctctttctttgaatgctaatagagatagcatcggggtttcagccgatcttacctgatttagctgtcttgtttccctacttggtcatgaatcgtctaaatctgccctttatatcaagatctcatccgcttaaagtatattaagcttcctatcagtctgctagtccatctttcttgttagattgatctttgttttgtatatttcattcgtgctgatatctttatctgtactacttaaaagaaatgtagtggtgatggtgaagccaacatagacgtatctgtgcctccccctctcacgcccacactcgcgcctcctcctctcatgcccgtgcctgacagacacatttcattctacccgtacgatcgggagatccaatggccagattgatccctcgcgctcctcccctacacatgcgcccacaccactagcgccctcctggcctccctcatccacccgccccactcccgtgcgacggctgcgccgccaccggctgggcgtccccagatcgattcttcgcgctcctcctctccgctcgcgccccaccccagcaccgccgccggttgtaggtcgtcttcgttgccgcgcgattccacctcccccgccgatggctgctccaccgtgccgcctccgtcatcggatcggcgggacctcacgtccctcacgctgcctcccctgcgaagccaccgccggatcgcgccacctggtcggccgaccctcgacgacgcgaccccgcgttgcctcccctgagtccacctccctcccgatttggggggggggaccacgccgccgccggctcctaatctccctcgcgtgccgtcaccggcgccctctccatcgttccaccgcaccgccagtcaggatggcgttgatccctcgcgcgctgtggccggattcctccccaccccgctgccagtcaagccgccggcgatccttgtggtcgactctaactcgcaggccaccgaaccagccctccaacaaggtaactatcgtggtatccatttttattacagtataaatgcaaacttgtgaaatcagtggatgtgaataataatgacagtgccatgtttatgatgtgtgcacacatatcccactactaaattatcaatgacgatgtcctgttttgaacaatttgattagcattttcatctttttatataatgcaaatggtttaacttctcttatgattgggatgttttatgtttatatctgtaaattcagataaagcgctttaattagtagcgtgcatatactacctttatgtattatatcattcgactgctgcaacaatggaattcatccaagttccagaacttcttttacaagaaattgagcttcatgtttcatggtttatatttatttgtgtatttgcaatggagaagagaacaacgttaaattattttacaaacaatttgaggatatatatggcggcggtggagggaggcactggcggcggcggtgtaggttgggatggttgaagacatcaaccgccctgtggtatgtagtcccacgcttgctctcccgtgcgacgatatatatgatttggccgttgcttaattcagagaagttctagcctctgaaagtgaataacgttggcatggtttgtgccatcttcttaatgagtaggttttcttcttggcattggtggccccaatttggatgtcataaggatcattgcttcaccagctgataaaatgtcacttttaatgatctattggctatgctatgcgatttgagatgattttataggtgattttatgctgatcagcaacagaagtggttgatattggaacttaattgaagattcacgaatatatatttaaacataccatatgtaccctctgtaagtttgttttcttttgaattctgataaggtttatcttttaatcctagatatctttgttactacagtgtattattactcatgatatattacattgtacactactttctcagcattaaggtggtggcatattcaagaagatacttgagggagagaaataggagaacccaaaggattctaattgccacaatttgagttttttgtttagaagagttcggttgatcttatggaagtttcatattaattcctatgaatcttcggctctcttatgttttccgtgtgagatttgtgctagattttagttgtacatgtatcagatgaccatgtgtgatccctgtgagatttatctcacgacctaggttatacatgtattcagtttgagcaccaattactaattaggacaaactgactgaatctatattttatagttatggtttgattttttaaatgaatgatttgtttggtggctgattcaatgtgtttttgccttttaggctggtctgctttggctattagagccatttgatccagatgaatatttcttccttcattatcagttggcttgtttgttatttactatgacatggctgagctggtacttatggtagttttgatggtgcaggttttttctaagacaggagacatgcatgctccatcagcacgatgcaatagtatcatagctaatttagttcttagcagcgaagtcgatgctcatgatagaattttagatttttgttttctttcttctgtggtgtttatcaccttttggttgttcgctttacattaccaaagagcaccgtagcgttagcatgggcatattactagtcttggtacaaagtggtatcggagtgctagccgatacacgttaggtttgccctatcggctatgctgtgagcatacataatctctgctttgaggcacatttagatattgagtgacttatattgtctcggcataacatccgatctatcccaatcacctgatctaagtgtgtttcactggatagactacgtatcattgacatctacagccgatcgagtagatctaataatccctacgtttcatctgaccccgccggtctgacgcaagtcgcatcgacgtggcccaggacgatatgtcatcagcaatccaaccgatcagctatcgttgatggatttaactttttcctttttccttccttgttggttgcaggatcaaaccaactagcacgctcagaacccgaaggcaatctctttggacctgcactagagttaagcagatctctcaggccagtgcgtgtttttcgcgtcaacagcgggttaagtgggcgcgcccaacgcccacctaaccgcatttaaggtggatcctgcgaccgcgccacgttgcatttaatgcggtgtgcaggcttggctgataggccacgcgatgcttgaatgaccggtatggcaaggcgggtgcgcctgtgagctgactgcctaccaggcggcgtgcgcctgtgccatccggtcacatcgccatgatgagaagccttttgcctcatatatagaccggggacagattccctactccggttcaaattagggtacccgttccctggttggattgggtgcccggaagtctttagtaattaatgcagaatgatgcaggcgtcccacatgtcgtccggcgtgatctgatgggggccatgccaaggcgctgtgcgcatggttttccaagtcagatggataagaaatgtaataaatgtaaagaatgttttccttatcccctaggtggttttttgggcccctgtggtaaccctttgaggtataaaaggaggtccaggtctagtggaaagggaggattttcggatttctaccgactcatacactagtgttcctcgcagaatcaaccacacacaggagtagggttttacactcctcagcggcccgaatatgtataaaccccttttgtctcatcattctcgaggggcccgaccccttccgcataactcttgctaccaaaccacgattctcacccgctgcccccgactaaactaaaagggggctctccagtcccctacttgaggagttcaccctccgacagctggcgcgctaggtacggggcgcgttcgtgagtttttgagggatttttcgatttcgtgtgcgccaagtttcgctcatgaggccgaatggctgaagaggcgatcgtgtacacacccacacccattggaggtgacgacggcgacgaggacaggcgggaccagagcccgcactttcgtcgtcgagctcgcaccccaccgtttccaccgcttcaccgaagccctaggcgaggggatggccgcggcaaggctgagggctccgttacttccccactagcaggcgagggagtggggcgttgcgggtggggcgcgtcgccgtcttaggtacagcaagggaagcacgactgagggcgcgctcctgcgtcactcgcccgtcgccctcgatctagaggccccgatccagcgctggctggacaatgtggccaacttggtcaccactgcgcaacggcaactaaccgctagcgggcgaacatcgatggtcggaacgtattgcactccggccaccgcctcttcatcgtcaagacgaagggcctgccgggcggcggctaccgcacgtgcctcatccttgcttccctcgtcgacgcccgcgggcagctgtggacgtcatgagagcatatatggtggagccgttgctaggctcgttatcgagcgccgacgtgatgaacgtcgtgccacccatgcagtggaaggcaccgcctcctccagagcgccacgccaccctaggcaaagggctaggccctccatttccccattgagtagggctagctaccacgcctctgtggcgagtcttcggaatgtccgatggaccccaaagtttcggcccagcctcaccgagaagtatgacggcaacgttaacccctccgagttcctccagatctacacagcaatcatagaggcggcagggggtgacgaccgggtcatggcgaacttctttcccatgaccctcaagggccaagcgcgggtttggctgatgaacctgcctcctgcctcggtccactcctgggaggatctctgctggcagttcaccacgaacttccagggcacgtatctgggctcgggagaagaagcggacttgcacgcggtgcagcggctagacgatgagtccctccagcagtacatccaattctgccaggtcagcaacaccattctgcatccctgctcatgtagtgatctacgtgctcaggggggcgtgcggcacaaccacatgcttgaaaaagtcgcctccaaggagccccagactaccgcgcagctcttcaagctcgcgggccatgtggcttgcaaggaggaggcctggacctggaactcttctcacttcggtgcggtggccgcggatgccctcgagcccgcggcccgctccgggcagcgggagaagaggaagaagaagagatcggcccgttccaacgacgagggccatgtcctcactgctgaaggtgccttgcgacccccgcgcaagggggaggccacgggcggcaagcaaggggacgccggtgcccccagcggggagcgctcggcggacaaatggtgctccgtgcttaacacctccaaccatagtctcgctgattgccgctcggtcaagaacatggccgagcttgtcaagaagtttgagcaggagaggaactagggtcgccgcgaggagaatgctccggcgatctcgaccgacaaccgatgaggtgaggccaaggagaaggccctgtcgaggagcccgatggcgaggatctaggcttctaggagccccaacatgctatcaccaccatcgacggaggggcatgcattcacgcctcccgtcgaagctttaaggccatgaagcacgagcttctggccgctgttcccattcatgaggtggctcgaaggtcgcattggtcggaggtgaagctcaccttggatcacactgaccatcagccatgcactgcccgagggggccagatagtgttggtggtctcccccaccatctacaatgtcaagatgggtcgtgtcttgatctatggcggcgcggcccttaacattctgtcccccgctcccttcgacatgatcaaggccccggggatgcatctcaagccgtcgctgccgatcatcggcgtgaccacgggccacacgcggccgttggggcatatcgaccgccaatttccgcaccgaacgggttgacttcgatgtggcggatctcaatctgccctacaatgtggtgctagcaccgcgttggtaaagttcatggtggctgcccgctacgcctacctccagctaaagatgccgggccctagcggctccatcaccgtccactgagatgtcaaggtcgcgctggcttgggtgaagcagcgcgcaaacagcctcacagcggccaccgaggctggggacgacagcgggaggaccgaggcttccaccctgcgtgccccgaagaagcggatgacctcgggcgacgaggtacccatcaagcagatctagcttggcgatgacacgtccaagaccgccaagattagtggtaacttggacaccaaataggaagacacgctcatctcatttcttatgggcaaacgccgacgtcttcgtgtggaagccgtcggatatgctcagggtccccagggaggtgatcgagcaccgcctggtcgtgcgcccggacatgagacctgttcggcagaaggtttggcggtaggccccggagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20649 - DNA, 8499 bp, Oryza sativa
  unsure (1)..(8499): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacgattttccccatgactcgtgccgatcgtatacatgatggtcaggttggttggaggctttagagcaagtttaatcgtatagcctactactagctccaaatcatctatagctaatgtaatagtcaattcatataatagatgcttactatactattaatacctggtcccacctgtcatacacacattacgtcttgaagtccgtgctgtagctggctacagatatgtagcccgctacttttctctctctttttttatctttttaaaaatatatttatagttggcttatagcccgctattatacctgctcttagagagttcctggccagcacgctaacgcagaagcaatgtttttatatcaatcacactagcaactatatttcacctacatctgtgatttcaatttcaatttcaatttatctttcagagatggttccgatcttctctgcatatttcaccctatcgcgccggatatgaccgtgtgtgcagaggattagacgtcgagatgtaactatacattaatagcgtcgcatacatttgttcgtgctgcccatcgctcgatctgtcgagcatgttcacgtagactgccaatgtaaacatccttctaccttttcgttgcaatttttttctcagcttaattgatctgggactggtttggtttgtgacctaaattggtcttaccaatttttgtcaatgttaaattttgataaattttagcatagctagttttggtaaggcaaagttatgtttagattgaagccaaaatagcctaagggcttagtttgttttagagccaatttttgccctaccaaaatattggtagtgccaaaatattgataagttttggcactaccaaatttggtggaaccagatcctctaacgtagcgctcgctacgtcagagggacgtccaacggctatcgtccgtccattcggcatcggacggagtcgagcgagcatagcgattagacttcgcccatgttgcagaaaaatcggcccacgcgacctacaaccaatcagccatcgacgccgcctccgagccacagccgccgacgccgctaggaagcaagtcgtcgccgtcggcgtcaccgccacagcctgcgcctccccagcgaggtcccttcattgccacccccctcttccccatccccgtcccgcgcccgcctccgtgtcctccctcgagcggaagcctccgctgcgtcccgtcgtggaggtcgcggaccgtgcgcgtcgacaaaaccatgactcctggttggaggtcaacatgtcatggaacatacagcaggaaagaagcaacttgtccaaagcaacaatgcattgttgtgagatttattgttaagagcatctgagtactgcaattttgacacagatttgatccaagtctgtattcatgtcagttctgctctcaaattgcaacaaacattaaagtatgggaccaaatctatagatgtgcaacaatcaaatgctcaatctagcaacaacagcacattgtaatgttcagtgtttactgtcgaagcagcatcaacacaagtgacattcttttgctatactgaagtttcaatccatttagacgtactgatttgaaaacgaaaaattgatgcaactacaatcttcacattcagtgttgagttacaatcccaattcacatcaatttacaacatccatttatatcaatttacggtctcgatctaggtgtacactgccggcagcaagcattcagtgatgcaattacaatcttcacattcagtgttgacgtacactgccggcagcgagccagcaacatgttcaaggagcagctcctcgactactcccgtcaccgccctcgtctccattgtcagcgctcgcgtgcaaggtgtagctaggggtgggcatatttagaccgaaccgaagaaccgaaccgaaaagaccgagaccgagaccaaaaagaccgagaccgagaaattcggttatctgttcggtccctgccctcaaaataccgaatttatttcggtcatttcggttgttaggctcggttaaccgaattaaccgaaatgaccgaaattttggcccaataggcttaggaagcccaataagcccactaaaacaaaccctagagtgatacaacccttaccctaccaccactgccgcactccacagcgtcgcctcctcatccagcctccatcgctccgcctcctccagcctccaccgcgccgcagacgccggctccgccctccacctcgcggcgtcggccgccgccgccgccctccaccgcgccgccctccaccgcaccgcggccgccgccctccaccgcgcggcggccaccgccgctgccctcccccgcgcgggcgccgccgccgtcctccaccgctgtcacgctcggaatttctatccaaaattccaaacgcttacatgtgtgtgaaccctcgtccaggaatcagccgaggcacacaataacaatttgataatagagtacaattattactctaattaataagcgaataaaatgtcattacagaggtagatagttcctctcaatcaataaagatctaagcagcggaaaaataagataaacggcgcagacgactccactccacatgcagcttgaccagggctacacctaatcctccacaccatcagcatcactgtagaactcctcctctgatgaatgattgcaaggtgagtatatgacatactcaacaagccacgcagcaaatatgcaagtgcacaggataacaaaggatggcatagtagggtttcatttgcataaacagcatttaataaacatttcagaatttaataaagtagttaagtagtaattaaacaatattaatccaatgctatacaacataccctgttgcataggcccaaccattcttaacaatcatcccggttgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggggctgtgacagtacccctcgcacaacacaatccaccacagtgcaccattcctggagcataatcaccccttataaacaaggtatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggttcttaattgtcatgagcacgaccatcaaaaccatgtgttcacaacccatcattatcagattttagttggcaaattaattaattaatcaatcacgattgaccatcatgagctatcattaagccatcattaaataatagtgagtcataagttatcccaatagtgtgctaatgtttctaagcatggctaagcaatcgtatctaatatctagctgaaccaatatataaagcccaactagtcaagttataataacctaaggtatcaaggaataaagtaatcaagaacaaaaggactataacaatcaataggttaattccacccaacgacattcgaaaataaatgcaatagttgaatagaaacaatagctttaaacgggatcaacatgctcaaagggatgtttgggatctgtgtgacttgccttgctggccttggaactcttcaaattcttctcctgcaaaaatggactctccggaaacgtcggaatctaaacagaaaggagcaaaatcaccaaacagcacataaacaagcatgaacagtacatgtggatatttttaacatgtagatcttaattttagaaaaaattagagacttgaaccaactaaatccgagctaagatgaattagttatgaattttcaaagattaaatcggattaaatcacttatatgggttttaattgaattatgacgcaataatgaattatttttgaaaaggaaaaaggggtttattgcgtcagcggctagggtttgcggtggaccgagtgcacggggcggctcacagaaacgaacggccgagatccatccatccaaaactgacggccaagatccatcggtccacgaccggaccacgggggacgacgacgatgacgtcagcggtgacgtcaccaccggcggcggctcgggcgtgcaagctcgccggcgaacgacggcgcgacggcacgaacggagggcaccagcacgtagaaagcgacgcggcgaactcaccggtgaccaaaacggcggcggaagatcaacggacggcgacggcgtcgaggaagaagcggcggcaaccttcggcttgacgacgatggcggtgctccggcggtctacagcaacgatggaggggcggacgaggacggcgacgcgacggcgaccacgacggcggccttcccgagcaacggcgacgactagagcgacgacgacgcacggctggagcgacggcgacgacggcggcgcgaggtcccacggggctagggctctacgggcgaagagagacgaaggcgagggtggcgacgggtagcggagacaccgggggtccttttataggggcaaggaggcggcggcgaaggcccacggcgaccggcgacgcgatagaaggtttagggttcggaggagagagatcgatccgaattgaactcgaatccacggatttccaaagcgatttagacgatgtttccaaaagggaaaagatagagtggatcacggggatcctttctcctcaattgatttcaccggaaacggaaaggggcggccggatttggaatggcggcggcggcgcggcgcgtctagggtttcgtcgggaggaagacgacgaccctgacaggcgggccccacctgtcagcggcgaacgcgcgcacgggcgggcgactgcgggccggcttgggccggggagagagagagagagaaggttttgggccgactttcggcccaaagccaaaagagacttttaaaaccttttccaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaaccagatcttctcttctaggcttttaaaataaattctaataattccaatttagacaacaatttatatatttgggatttttagggtgtgacaaccgcgacggtcgacgcctccgccctccacagcgccgcggccgacgcctccgctctccggcctccacagcgccgtggctgacgcctccgccctccaccgcgccggtgacgcctccgtcctccaccgcgccggcgacgcctccgtcatttttttttcattccaaattttctcctgaaaaatttcggttagaccgagaccgaaaccgaaaacaccgagaccgaatttgccggtcctaaattttttgggatgaaattcgatcctgagtttgcaaagaccgaactgaccgaaaaccgaagaccgagaccgaatttttcggtctgaccgaacgcccacccctaggtgtatgagagccccgaggtgggtggtggcaaaagactccgcgagggcaccaccgtggaagccgttgtcgtcgaggcagccgcgacctccacgctggatgaaacaggagaacgcagggcgagggatggggaggagggcagcgatgagaggaggggcttcttccgtggtcctctactactccactccacccgtgcatgcgccggaggagacgacgagctgcagtgagcggctgaagaccacgggaaaacaggagccatcccgattttgctgggtgggaagaggaaggtggcaacgaaggagccctcactcgggaggtgcaggctgcggcggtggcggcgacgccgatggcgcagaggcctcccctcccccatttgtttcctagcggcgccggcggctgtggctcggaggtggcgtcgataccgcgtgggctgttttttctgccatatgggccgagcccatctgctgtgctcgctcgactccgtccgatgccgaatggacggacgagagacgttggacgtccctctgacgtagcgagcgccagaggatctggttccaaatttggtagtgatgaatttgaactattgtaggcaaaatttggtagcaaaccaaatatacatttgctactattgaagttaccaaaattttgatagggcaataagttggtatcaaaccaaacaagccctaagttaactattaaaatgaccaactttcttagacatgccaaaatttaacttcaaaccaaatagatactaaacactattaaaattgccaaatattcgcaagggcaatttaggcctcaaaccagcccttgatctcctatcctttatcacgtgccaccttaaaattgttcacacatctcgcatataccagattaagtattcacctgttttatttagtgtagcacaagattattaattagttaccgaatctatttaccaggacattcgtgcagggtaagcacgtaacactaattaaaacactttttcaatgtagggcccctttaaatcgcaggaatgagaaaacataggaataggaaaaacgcaggattttgataggaatgtaagtgtaaaacagaggattgcaaaatcctctgtttccaagagatttgactcaaaggtcgtttgattggaccgcaggaaaaacgcaggaattagaggagagataaagactcaaaggaaagtttccaagagattttacctcatgttagaattcctcaaaaacttgcatggcattagacaatacataggaatttcataggattccataagatccatttctttgattcaaatggctatataggaaaaattcctataggaatgaaatcccctaaaattcttatgaatttcctttaaatcaaaggggccgtaaagtccagaaagatggttagtacaaaatatttgataaagtacaatttttataaagtatttgggttatttagttttgttttgtgcaggatttaataatttaaaaaattaaaagcaacttattcacatatttgattcaacttttatgtcgtcgtcgttatttaattacgagccattccccgttgtggctgttgcggaggattgtgagctctgttcggtccaaagacagcataagaggattgtgtccgcaacagcattgtggaaacaacaactaacaagggcgatcgccgctatacggtgcttcaagtgaatcaaacaatccatgctatgtggaagggtcaagggtacaagaactcaaaagaaaataaggagaatgtgatgttaatgtatcaatttaccaagtaaaccaaggttcagtgtttatcttccatatttttttatttaatatgcattttagcattcaatctccaataaaaaaaattcaagcattggcataagctctgctcatttcatttcctctcttttctaggtagaaatagatatatctctataatccattaattaagggccgtccctgttagtctaatgatattaagtaaaaaaatatgctaaatgtctaacacaactgtttttttttttttgcgggggtctaacacagctgttgatatttaaaaaatgcaaacaaagaacttgatatgcccaaattttaacggatcatgttagataaaaaagttcatatatatgaggtataactataggtaaaatattcattgttctgcatttattttgaactacagaattactaattctgtaactataaactttggaagttcatttgcatatgaatacacataaaactggcaattaatacataatttttcataaaatttatacaaactttagctttataagcatatgtaatgttaataacatgtgtgaaaaaacataaatagaaccatccagccaaaaactcatcatctgcaaaatttattagtctaccagaaattttcatcatataccaaatttatgcctaagcagatcaaaacagcaaaattgttcaattaaaaggagagaatcgtataggagggaaaatttgggtgataaataatgtttgattgttgactcttgataaaaggcacttctattttaaaactagatgacatccggcacatt

SEQ ID NO: 20650 - DNA, 963 bp, Oryza sativa
aaaatttaactcgtagattcactcatgagttaaaattttactgggagttaaattttaactcatggtgacgtggacgaatctcggacgtccatttctcgatccaacggtagtttccaagtttccactacatatgtggtttgcactacatattttcccctgctaatcatcacatccaacaaatatcatctataggttcttacaagcaatcaagattgcattgaaatctacactcactactgaacatgggacagaaaaaacgttctacttctaaacaagtcaggactcaagattacctctctatatactctgatgcaccatgcttgaagtgagtaccacctccaggaaaccaccaaagcttacccttctcgtgcacccagttctgtcctccttttacctcagcaaggcgtgaatggttgacgttactacgccaaacatagtcccgacttgttggccatcttataggtatcttgtagtcatttggtgggggcaccaaacagaacaagcgtttctcttgtggtgggcaaatactttcaagatcctcatgcctagatctatccagtttctttaattggcttatataggatgcgtcgtgacagggaatatactcgttgtatttcaaaggacaaacatcaactccataatctggaactgagattggttttgttcgataagaaagagagactctgtttgtaaactttggagcacctgcatatgaaaatcaaacagatttaataatttagcatggaaataatatacaacaatacaaattaaacagtgggcttgggtctaggttatgtccactaaaatgtatactgtaccatcaatacaaactgcagcacagagaaaaagagatcagagaaattcatatctaagacatacagaaatgtgtcaagatctaaaaaatataatgtcacgaattatgaactgaataggagtggcctgcactcttttgattttctatac

SEQ ID NO: 20651 - DNA, 9376 bp, Oryza sativa
  unsure (1)..(9376): unsure at all n locations
catctagcacgggaaaattacccggtgttacctgttcaacatcatattcctgccagttctctaaggattccattcgttctagtgacaagagttttaattttgggaatgccactaattgatgatcacattctttatcagagcagaacccgttacacaagtatttcaacttcttcatgtcttttagtcggagaacctcgagaaagggaagcttccacactgatggaagtttcatacaatttatggagtccgttactttgagcttaacaatgttgcgcaatgtgattccattttccatccatatgggaaacgtagtgcccatatactgcctcagctttagaacggtcaatccgttgggaggcttaagagcgtcaagtacttcttcatgacgatataaatgcaaatcttcagcttgtaactccgcagattttgatgtgccccagcaaagtgctaactgctgcaaatttgtcttacactcaaggttggcttcttttgcttctatgggatttgttactttaatcaaattaaatatctgaagcttgcccccaagttttaagtcattcagttcgttaatcctatagccagattcattaccaggtacgaactttgtcaatgtccgtaaattaatgagctgtcctagaccagctggcatgcttgttagtcgagcacagtcatcaaggtacacatggcgaaggctaatcataaatttcatgccatctggtaggtgggtcagcctcctgcatctattgagtatcaacacttgtaaattataaagtgcgctagctgcttaggtatgtatttatgtagctaccagacaaatcaagatatcttaagtgcttcataaatgctggttcaacaggaaatttttcgatgccgaaaatatgaagcccaactactctcaaaggagactcattgaatttaatgtcctgggcaatatgcatgtcattcttatctaaggcaaatacactgcggataactcgacaatgctgcatcaagaaaccaatcttttgttgaccctcaaaagccatatgatggacatttttgggtattttcttaattttagccagattttccaaagctaaacactcatcaccgcttatatgaactgcaagatcatgcataagatcatgaattttgaatgtagttacatcactttgcccatacctgtacactttacgttggaaaattgatccaatttgcttaacattttggaaaaatgacctccaaacaagctcccaaaaaacatgattcccattctcttcaatatctgacatcttcttggatggaataaatccattcgatacccaaagatgtattagatcgtccttatcaatctcgtagtccttcgggaatactgcacaaaaagcaaaacattgtttcatatgagaaggcaaatttttgtagcccaaagacagcgctggcagtatctggctttcttcatcccaagtgttgctttcaaggatggatagccaatctcgtgtctcctgttttgtactcatcaaggctcccatactctttatggctaacggaagcccgcaacatttctcaacaattcttttaccaacctcaacgagctctggagtctcaaccacacctgtgccaaaagctcttctgctgaatacaatccaagaatcttctgggttaaggttctctaggcacaatggactaattgactccatgattgatgcaactttcacgtttcgggtagtcacaaccaccgcacttcccattccacaagaaccaagcaatgttctaagagctccccatttctgtttatcttcattccaaacatcatctagtacaagaaggtacctcttttggcccagttcttcccgaagacgttgctgtagcaattccaggttatcaaacttcagtccacaatcattcccaattgcggtgtcaattatccccttgacaataacaggaacactgaagttctctgacacacaaacccacatatgcttttgaaaatgtgctttcacttttacgtcattgaagaccagctgtgcaagagttgtctttcccagtcctcctatcccaacaataggaagtattagcaattcgtcggtctcggcacttagaagcatatggacaatttcatctctttctttgtcccttccaataacttcctgctcgtcgacgtaggaataggtttgcatcctctcatccactggcatggagcaatttaggaacccaaatcgattcatttgcgaaacaagctgatcaatccgctcgactatctgctggagtctctttcctatcctatacttgaacagtaaaggattataatgagaagagaagaaagcccttacgccagtattgattttatgcccacgacggagcgcttcgcagcggagctcctcgtagtgcagctcatcaagggcgtcatcagcatcacaggcagccagcttcagctttgcgatccaagacttcacagcaggcttcttggatgcctgatcctcggcatcattgatcacttggttgacggcaagcagcaaggtatacagctccgaacgccgtcgttcaatacccccgatgaaactaaactctgtgccgagagactcacctgctttcttcaggagggcaggcaaaagagccgatagtaactccgccatggctcaaagctcagagatcaatggagtattggcagaacagaaaggattggaggacaattaatggtgggttgaggaatgagcgtatggtgtagctggttgagttaagtctttggaaaaaaccatccaaggcacaaagatgagttggagttgaaggagactgataatggaatgagaagaagcaagtgagctgtttgttccattagaaaaaagtgggtgggttgtttaagacaatggtgcattagatacatcatgttagttgacgcgcttcaaatttcaaataatcacatcatacaatcaaacaacaagtggtcaactgctcaatggtagctggcaagttgctaaaaaatcttaatggtaagcnccatttgtcaagctgggggtatcacagcaggcatcagcctagcaccagatcagaaggagaagataaacatccgcccactgcagcaaccgaattaaaccaaaccaacagcagcatgtatggttcacctaaacaaacaattccagcaagtttcctctcctaaggacgtccatagaaaaaatggaaaaaaaatatatgcaagagtgccaatttgtgcattataatgccctactaggctgtcatgtcgtgcattatataaatcgtccaagactttgaatttatctttgtatcgccgcaggtggctataattcagaacaccaactaagcttctattatttgcttattttagtgcctatcaaaattattagtggctatttctgttcacgggctgggaatctacgagcttaccttcggaggtggagctagccgtgccttccgatggctgctgctgaagacgggcttatttgatttaaagtcaatttttactctaccaaaatcttggtggaaagttttggcactaccaaattttctagcattgaatttgaactatagtagccaaaatttggtatcaaaccaaacatgcatgtgtcgctgtttaagttaccaaaattttagtaggataaaaattggcatcaaacgaaacaagcccgatatctcttcgactgtatagctgtgccggatcgagacaaattcctctgctccgtgaagtttcttgcgcccgcatccggctgtcttatgggagagcagcttccgccacaccggccaacaccgggttttggccgccggcagagtgtgagggggattgggtggaggcaaccaaagcggagacaatattgagcacgcgcagtccgtgttagataagttagttattggagataaggtttatattatcacatttaaccatttgatcttatatctataatacggattgatctcaggttgttgagagtgatccgttccctctgtaatgcgccacggcaaaggcttttcctgcctatatcaacaaaggtgcggcccctatcagggttcagcgcttccccctattattccctgatatggtatcagagcaaaccgatctacctccatcaccaagcaaagccatggcaaagtttgggagaatactaccaatcggacatccgatatctcaaaaaatatcgaacggtcaaaatgttgcagctgatcaacatgtgaaacattaatttatatatggtgaaacaaaaaaaaacagcaattgaaacattaaaaattttatgaaacacagtgaagatacacgttgaaacatgttgctatcacttatgaaacaacgagagttaatagatttaaacatatatttttctttcatcaaaatataatcgtgtgatatcttgttgtaaagatgtaattacaacgaatacaacggtatgatcgaatcatagattggataagtagtttagaagaaaaatcattttaaagaccgctaaaatgcatgcatgcaagcattgatggagggtagtggcaattattttcgagaattttgtgaaacacagtaaaaacaggcgctgaaacatatcgacatagcgtatgaaacatgaagtattaatagtttgaaacttatatttttctttaatcggaatataaacatgtgatatcttgttataacgatttaattccaataaatacaatggtgtaatcggattttagattgataagtagtttaggagaaaaaatattttaaagattgacacatgcatatgcatggttggaatgaatagctacgataattgagttagcagttagttgattacagatagaagcacccgtgaaacttgccatatcagttgacggattcgaatctttctagagttagcatgtagacagtgtggaaggcatcgatgtggtatccaatttttccgtgtcagtcgaacggccgattacaagcattttcccgaagtttctcgaagaatcatgccagcaatcactgctttcttttcggaaaagctaggaaaatcgaatcacgcccatggtttgaaattttggttcgaaatttcggcttccaccggcaagcacaaatctccccggaatttttggtttcttgtcaaatatttgtaaatttggtcaaaatttgttcaaattcagtcacaatatgttaaaaattcaaataattttggtcagaaaaacccggaaatcacgaaattttcaattttttggcaaccatcgaaattccggtgcaaccgaaattgcaaactcggatcatgccatatggaaggcgcgtattcttgtgattgttcggggtgctcggttggaaggttctcataggagcagatcaagctccagttgtcattcttcgagaaaaggagggcgaaaaggaaattatcatcaacaaaccagattgtgatgaatggatttcgacaaatcaacaggtgctttcatatttgctttcctccatgactaaagatctacttgttcaagtggcaacatgtagcacaacagcctcggcatggagtatgatccaagagatgttcgggtccatgactcgggcacgaacaatcaacacgcgactctccctcaccacgctgcagaagggcgacatgaacatcacgacgtttgttgggaaggtgcggcctttggctaatgaacttgcaatcatcggcaaacccattgatgatgatgatctgatcagctatatcattgctggtcttgatgaagaatatgtgccggtaatctcgtccattgttgggcgaccagatcaggtgaccgtcagtgaggcctttgcttagttgatactccctccgtttcatatcgtcagattttctagcattgcccacattcatatatatatatatatatataaatgaatctatacacgtatatatgcctaaattcattagcatctatatgaatatgaacaacgttagaaagttttacattgtgaaacggagggagtaaagcttcaagcagaggctagcactttgccagagtggagaatggagaatcctggcctcggctaatagcgcaagctgtgtccagggtcagcaacaaggcgtcagaggtggcggcggcaacaatcaatgaccgagaacgttaatacgtgaacgttcgcgtgttgctcatcccgcgaatgggaaaacacgtggctgggagcttcggacacgtgactcggaaatttgttgcggcacgctgatccaactacatgggcctcacgggctcatggcccatccgaatattttgtgcttatgtggaatgcaaatttgttttaaaactcatttgtaaaaactttctattacctaatgaattttagtttctatgcatagattttatctgtataaagtatatatgtataaagtttatgtgtataaaatatctatatataatttttatgtgtgtaaagtccatgtgtatatacattgaatgtttctacgtataaagttttctatgcgtaggctttctatgtataaagttgtattcgtataaagtttctatgtataatattttctcacccctacccaccacttctcagaaatttaaagggaaaatagaaacggataactctttatgctaaaaatcgttacactgggccttcgaagaaaaaaaaaacttcatgtgacttggacttgcaagtaacatgaataggggaaatgatcgtgggctggcctggtggagagagagactcccgtgtcgctctctgcagggcgacccgggaggcgaccgtcgccgaggccccgctcctcctacgcgcgcgcagcctcgccgccgccggcgatgctgcccccgatggcagtgccggcggcagcgcccacatttatgcaggtgaaacctgccctgtataagatcgttggaagttatatattcatgtgggcatttcgccccccggtgaccagtctaaaaaaaagatcgtgggctggcctacatcaacaaagaaaacaggaaggcaatcaggcttttcatcaaagtgcacgatggtttttctagttcgctcgccccggtcaccgcgaacactcgcgcatcagacttacccatcaatgacaaggtgctccaaacaatggtggaaactgaagtcgaggaagaggcagccctagcggtggtcgaagaaacataggaggtgtcgacaacaggcccaagtgtcaactttgctacaaaaggggacacacggtaaaagattgctagtaccgtttcgatgaagactatgttccatagatgaaaggtttgcaggttctgctgcattctacggcattgatttcaattggtatcttgacaccggcgctacaaatcatgtcaccggagagcttgagaagctaatagttcgtggcaaatatcatggcaatgatcaaattcatatagcgagtggtgcatgtatggagattagtcacatggtaattctgttgttcagatccctagttgagatttacagtgaaaaagtgttctttatgttcctaaggccaagaaaaatcttgtttcatctcatagacttacttgtgatatcttgcctacatagtcatagaattagtatatcgtaaatttttctttataaaggatttggccatgagaagaactctacttagggtcgttgtcataaaggactatatgctcttccatcttcatcctcgaatcaaacgcatacccgtagctcacccgaaaaacaaacgtcgcgcttgttgccaccattcggccagtggaagaccatggtgacttgggcgggtggaaatccacattaatccagtcctgcagtaaggtccatactctgtttgtgtaggcgcacgcagtgaagagatgattgcaatcatcaaaatcagactgacacagtgagtagactggttcatgaggccatccctctcttcagcagaatgtctgccgttaagcaccggcctttaacagccaaccacacgaactttactctagctggagctgttgccttccaaatcagctcaccaatggcaaggtttcctaccatgaaaatgaggtctacttggagatactgagtcaaaataagagagggaaatatataaattaaattgaatcatttgctgctgataaaatgtatagctacatttttcttagataatggattaaataacctggcctctacatccaagtggatgtacacagccacagaatagctacatatatcagtattatttctccaacaacaccctaattcatttaatgttgtttatcatctatgtttcgtgggttattgtacattgaacactacaccaagagagaaaaataatatttgcatcagtggctatccgaataggaagggcaacatcaatcaaacagattggatagaaaaaaaggtacttaattttttggctaaactcattaattttgtttgaaaaatgcatgaaagaaaagaactcagtgaataacttacgtgagcatggcaaacagccccagccaacattcctgtgcctttccatgttttttccgtgagggcatgttctccggaatcgcagccgtaatgctgcttcacgtctagctatgcccaggccaactgcaatcaaattattatcaaacgctgggaaatttataccaatattattgattattcgtaagaaatatattgtgattcaatgatctgtaacgcacattcttctctctttaaaataaagcatattcaaacaatattggttcccgttcaaataaaacaaagtagctcgggtaaaaccatgccctaattgggggaaaccaggcggagattgtggatcgttagtccacacacaacacaataagaaagggagtacagcaacaaataaattctcaccactgctcgtgcagtagtgcatcaggcgatcaatctctaaaatccgacgccatactccatccccttcaatctaaaccatggagaatcatgccctgattgaacaaaacaagttaaagattgaatacttaatactatcaccgcacaccaagaaaaggactaaatccctcactgaggctagtgaccctgcagcatgcccacatgaagccccttctgcatgcgccatgatttctatagcagattagcgtcatctcccacgctgtctgcatcgtcctcgccctcggatggcttacatggtattatgggtaattttactatccttcataagatacctagatgtaccatatttctagtgtaaaatttgatatctctaggtactaagtacctcaaggcaccaaaaattttagtgtaaaatttaggtacctcaaggtactttctcaagaactgtaaaattccactatagtaaagaccccggccgtagcattcacgtgggcgttgcgcaccacggcgtcggtcatggcctgcgagaagcagcgaatcatagcgtagccccctcacgaactcggccttgcacggctccagctccaggtccccagcgaaagattcatggtaagtcttcagaactccaggtccccagatttaagaaacagcacaagattcagaagcagg

SEQ ID NO: 20652 - DNA, 1461 bp, Oryza sativa
cgttgtcactggttacagtaatagtggcacatggattcttcttaaccttgttggcatgctctctattttcttgtgcttcctcatcatcttcagatctctcctcatcatcttcagctataccatctgtttcactagaatcttcagcatcactatgactgtcatattcttcctcaatgtcatcttcaacatcactgtcatcactgactccattgctaagcacaacattatcatcttcgttgtgcttgagtatttcagcatatatttcagctacatcacccatgattatgcattgagccatatataagcattccttatcatctgatagtgctttcaggccattgtttagttcagcacccggaaataaccaatggaaaatcacttcatcttcttcacttagtgaaacatggtctccaaggtatcctctgatctctggcaatgccaccttgtccctctctatgtatgacatctcagtttgaccaccattataaaccacagaatatccatcataatcaaattccccaccaaagtgaaaccggatacaaagtacatccaaattatccattacacctaacatggcaacaatgagatcatcagtaaacttatcttaaaaaatgaaacattaatcaagcagcaattatctaccaaatcctaaacaactcatcccaagataaaataaaaatcaaccaaaaaacagtcccttatacagtatgaagtgagatagctgatgaacaacaacttatgaagtgagccaccctcgccgggcgtcggctgccacccatgctacatcgtcgatggcaatgatttgctccatttcagcatttccactaggtatgatgcctgcggtgcatgtgccatcgctcgcgacggcttcaagacgcacacgccgagcgccggcatctgacgatggataatgagctcgcaagaaaaaaaaacagcaagggatagcaacaacctaaccctcagtagtgccctaccaccaacgaaatcaaccaaaaaaatttcatcaaccaactgccacacgcacttattatccccttctagaacaaccctaaacctaaagcatgccaagatcgagtggggaggagggagggaggaagggagggagggggagggacacaccacggggctgcgatctcacggatcagcaccgcctatctgagacgatcatcacctggattctccgccgtcggaagggagagaggagatgatgagaggacttgtgagggagaagagtccaacgcatggaggagaatacgacgtgtgattaatctcccaggttctctttctccacgttggatccaacctagtaagcaaaaccacctaatccatgtgccacatcagcaaagcggtttgcattaaattagaaaggtgaatagtgatccggttttgggaacctagggggttaagtaaaccaaattaaaggttagggggttatttgctccagggtcatacttgagggga

SEQ ID NO: 20653 - DNA, 9771 bp, Oryza sativa
tttatccatagtcaccaaaagctgagcgcctggatcttgtctttttaagagttgaactattcactaataaattattatggcattgcccttcatggtgctaaccgaagatcatagaatatagacaagcaatttgtgagggtaatatttttttctattaattttctatcaaatgatttgtaagcatggaaatattgtgtttatactcaaagtgtgaaaattgaagagtcagcaaggttactcccatgtttgtaattaagtgtccattttatactgaacaaatggaatttctaatggcatatatgcgtcatagcaatattgcataatagttttttatatataaatgaggtcattctgaaaataccgtatttttagaataattagcaacaattgttgtttgatttaacacctatattgatgctttccactgcttcaccaataactgatgaaaaaccaaattaagaacctgtcgttgataagatgtgccttaatttttgtcatgcttttttttttctcgtataaccaaccatacaactaatggaactaatagtcgacaggagtaataagtgaaattgcagacaggaggcgcgacattggcgcgccccgtcatctagtaaaattaaaggatcaacctacaactacaatccactagcccataaaaattgcaggaacgacctacaaggctacaatccaatactccaggaatgatttataactccaatcctctcttagtataagttagagcccactaaatactaaagcttaacatgtaaagatgccacatcatcattcactaataattattacatttaaacatcatgcaagcatgttatattatctataattttataatttattaaattttatagcttttcaaatgcttagcctaatgatatgatttggtagacacctctgcattggccaaaatttagtccctgtcacatcagatgttatgacactaattaaaagtattaaacatagactaatgacaaaccccattccataaccctggattaattcgcgagatgaatctattgagtctaattaatcaatgattagcctatgtgatgctacactaaacatgtgttaattatggattaattaggcttaaaaattttgtctcacgaattagctctcatttatgcaattattagttttgtaagtagtttatgtttaatatctaaattagtgtataaacatccgatgtgatagggactaaagttggatccaaacaccacctaagttacaagatcaatcgaccttgtcagtcacctcttcttcctcatcgttgtcggagctgtggacacaatctggtgatggtgcgtgtatggctatcctggcctcttagtcgttgtcgaccatggtgtagcccttctcgtggcgatggccaatggttccggatcatggtctggcactggacaagcttgtcctggcgggcatagagcgtctcggccgttaagcgcgcgtcctcgttgagcttctcctccagctccggcggcaccagagggttgggctcctcttccaggatcgtcgatgtggagggtcctcttgatggccagtatcttgtcaaccagcctgttggccagcagtatcttcccactcgggaccatgatcttctcgccgtcgatcaccgccaccacggggatcggcatcggtaggttcctgttcatcagaaacgccagcggccaccgccttcctcttggtggatgacttcttcatggggccaccgactcactcgccttctcggccgccgtgcctcgagcagagcacgccttcattgatatcttctcactggccaatgccgcctcctcatcctcctcctcggtcgccgcagtgatcacgcgtcgattgagcccaccctctttgccggtcatcacttccgatggggaattttccttagagaatttgatggctcttcttcgtagatggggattttggatgaaccctaacttttcgatagagggaagaggccgccggtgcgtggtagttactaaggtaacataagtgggctatataagttgccacatcagatttgtgcttgtgtggaggagagatgagaggagagagaataaaagtgggctacagatttgtaaccagctacatcacaagctccaatatttttaactatgtgagagagatggatggattatgcattcatgatgcagtatatttctacagctaactattgtatgagtaagctattagatagactataaatgatgttttaaattttgaagttagtagtgggctgtattattaaacttgctcttagagggaagcttaaggggtggctaatgggcgggtgaccaccccaggcgatcaccccccatcctcctatacgttactctccctcccttcctcctccccttcttctcttcctactacaccataaatttaaaaaaaataaaaaaataaagttggaaaaatttatgtatagaaaatactatatataaaaaatatttgaatttaaattcaaatttgaaacaggtatgtaaacttttaacttataaactttgggcctataaactaatatttgaattcaaattcaaatttgaatcgggtatgtaaacttttgacttataaactttggatctataaactttaaatgtatagaagtactatatataaaaaatatttgaattcaagttcaaatttgaatcggatataactcaaattcaaatttgaaacgggtatataaacttctgacttaaactttaggcctataaactttagatgtatagaaatactgtatgtaaaaaatatttgaattcaaattcaaatttgaatcggatatataaacttttgacttataaactctgggtctctaaactttaggtgtataggaaagtaatgcgatgcaaaaaaaaaaaagaacccacgtggtggggggggggggggggcggcggagcggccctgatcgccccgggcaatcgttgcccagtagcaaaaccgtgaagcttatcatagtctgactcgagatggcagtcaccgcctgatcaccggcatcttcattcgctcggatctcggaccatgcaacgcagccgcaccggccaagccatgtcacggcgatcacgccggcgtaggcatcgtcacgcagttgcctgcgtcaccctgttttcgctgccgccgccggagcggatagcggaagctaccgagccgacacagcacgagcaccggaatctccgagccgcgcaatcttaccaatttttagtaaagttaccaaaacagtggctacatttagtttgctgccaaattttggtaactatataagaaatattgttaaaattttgacaactatactaaaattttggtaatatcaaaatttagtaagttttttttttcatcaaagtgaacaggcctcaagtccgttggattggagcatatgggttcaaccaagcaggccaaactttacagcccatcaaggccttgtataagaggcccgccaaatggcccatctcactagatgggcctaaactaaaatcaatttccagcccatcaaatgccttgtctctttagtcgtcaatatcggcccatttactagtatgggctggaaattcgagctactccaaaaatttggcccattccagccaaatccaaacgaccaaacaagcagcgagttcgagagaccactctcctcagatctctaccccatctctcccaccgcttctcagatccaccaccaacacccgcggtcgccggcggccaccgcgcgcgccatggccgcgccagcgacgccgcggctactcctctcgccgacctccaaggacctcatcgccgccgcctcctcctccttcccgtcgccgccctccccgacgacctcttccgatcccgcctccccgctcgacgccttcgcctccgacccggtcctctccgcgttcctctccccgtccttctccccctccgacttctcctccgccgcgctctcctcgggcctcgccgcctcccgcgccgagcagctgcaggaggccatccgcctcctccgccgccacctccgcgccgaggtgctccgccgccacccgctcctcctctcccacctcctctccctccgctccgcctccgcctcgctctcctccctcccctcccacctccacctcctctcctcccacctctcgctcctctcctcccatctctccgcgccgcgcgcacacctcgcgcactcctcctcctccctctccaccctcctctccaccgccgacctcctgctccactcccaccgcctcgtccgcctctcctcccgcctcctcacctccacgccgcctcctgacctcgcccgccaggccgagctccaccgcgagatccgccttctctacgaggagaagaacctcgccggcatcaatgccgtcgacgaggagatgcgcaaggtcgatgcggctgcctctaagctccgatcggaggccagcgctgtgatcgatcgcggcattgctgagtccaaccagaacgacgtctggtgcgggctgcaggtgtactataatctcggagaactgaagccggcagtggaagggctcgtggcgaagtacaaggcggcaggagcgaagagtgtggctgtggcactggacatgaaggctatatcaatggctgcagggggtggaggtggccctggaggcgtgcagaggagtggcacgccacagattggtggcagtaagaaggcggcggaggcactgtgggataggatgagacagtgcatggaggagctgcatcggtcggtcacggccgcatggcagctgcagactgtgctcaccaagaaacgtgttccattcacacaaatgctgttcctcgaggaggtttggcaggtgagacctgatcaatgggctaatcctattgctgcaaattaattgaaatgaaatttagaatataagatgtgttaaagttggtaaacatcgaatagacactatatgaagattttgttgacaatatgatgttcgtctgtgactgtgagtcatgagatatgttggcagccgagagacttaggcagaataatttacatcgatatacctgtaactattttgcagggaacaaatttgatctaagtctacatgtttagttattgatcctatattgtttacacttgagttggcaggtttgcatgatatatcacaatgtaatttgtcaacctaaattggatcttacgatatatcattttcaagtagttgatagtagaaataagtgcatgccttggattagatataatatatcagttctagtcttctagaataatgaattatctttaagatgtcagttggaaagtaatatgaactatctattcatgatgctcagtgttgcaacatatactgagttattacttactacactagtaaacacatatagtcctttctatctcctataacttcctgctgtgtgaaatttatgtgtggatgttccatggtctgtacaatcaagtgctaaatttttcctcgttctaatatttacctgtcaatagtttatacttgtgtgccaatatcttgatattgctcaccttttttttttttttttgaaatttagcattgacatgctcaccatgcgttccgattcctgtttcttgccccactgacaatgagaaaaattgcaggagggtgatcctctgttaacagagagagtatgggatgctattgttaaggcctttgcaagtcaactgaaatctgcctttacagcgtcaagctttgtgaaggaaatttttactcttggatacccaagattgttttcaatgattgagaacctcctcgagaggattttaagagacaccgatgtaaaaggcacccttccagctcttactcccgtagggaaaaaccacatgactgcagccattgagatattccagacagcctttctggctctttgtcatagtcgcctctctgattatatcaatagcatatttcccatgtcaggccgtggtataccttcaaaagaccaaatatcaaggttaatttctcgcatccaagaggaagttgaagttgtgagaactcatgggcatttgcttgctcgtgttctacaagaaattggaaaagttttgcttctcctagcacaaagagctgaatatcaggtattcacctgctactttatagtgaagttatttatttctagtttttcctagggattttgtatgctttctcagtttgtcatgtaaatattagcatatgcgattcttatggaatggtaaatctactactaaactctgatgattttgatttgaaacttgtatatgttacttttacgtcatgacctgtttcactgactgttttgtagattttattctgttaaaaaaacttaagatttttttttctagcagatggttgtagctctatctgtaggtccttattgtgcattggattgttctcttttctcgactaagtttgtgaagctaatcagtcacctcacagacctcaatctatgttcaatatgcactgctcggtcgaccttttcattcacctcaatctatgtacaatgcatttgttggtgcctgtgttattctgttcttaggagctcctctagttataaaagttggccttttcattgagatgaataaaattctggaagttttttttgttagttttgtggttattgggggtcgcagagtgaaataagagagatcttaatcttacccagtgaatgtgtccttgtggggactgctggttgtttccaagaaaatagtgatatcatgttggtttggtgaactaaaaattgtgttcttaacttctgtctcaatttgaagtaaagagagttcagcatagaacttgcattatgaaaaaaatgatgtcctatagtgcactgctgcatgagaaaatgcgactgacgtcttaagcagaatagcagatcatgaaacatggacaacattcgctggtttaagccattctaaaatctacggcatagaagagttggatcaatgtgcctttgctggagagcaaaaatgcacgtacaatctaattatattgtttgctttgctgttggttgttttaccgactgagtactattttcaccatttcctcctatgtgatatacttgcttatttgtatgtgcgcgcactgcacgggttcatttatacacttgtcgtgcagtgcacaactgcaaaatgaccataaattggctgcaggcattgtcttggtttttgtatgcatctgctaggcgctgatgtatattttgcttcaatgcagatctctactggcactgaagcccggcaagttactggcacagtgactccagctcaactgaaaaactttgctctatgtcttcacctccaggatgttcacacacgtatttcaagcattgtgtcaacacttccaaatgttacctctgaaaaactttccaaatcccttgaggccatttatacagtcgcgtgtgattcagtgagccctctattcaaagaaatgtttgatcgtctcggatcatgcattctgaaaatgcacgagcaggactttggaactcatggaatggacgcaacaatggataacaacgcttcagcttacatggaggaactgcagaagtgtgctgtccacttccgtagcgagttcttgtcaaagcttctaccttcatcatcatcccgctcagagaccatctgtaccataatggttagaagtatggcctcaagagtcctcatattgttcataaggcacgcctctctagttaggccactctctgaagccgggaagctgagaatgacaagggacatggccgagctggagctcgctgttggtcagaatctgtttccagtggagcagctaggcgcaccgtaccgggcgctgcgtgcattcaggcctgtcctattcctggagacgtctcagcttgagaaatctccactccttcaggacttgccccctagtgtgatcctccaccacctatattctcgaggacctgatgagttacagtctccattgcagcgtaacaagctcacgccgctgcagtattctctctggcttgattcccagggcgaggatcagatctggaaaggggtgaaagcaaccttggatgactacgagatgaaggtcaggtctcgcggagataaggagttcagccctgtgtaccctctcatgcttcagattggatctgcattgtctcaggccaagggctaaacctgtgttcagttcaacccagcatcacatatgtttgtatcatcatcatgtaggcattgggtacttgagagatcgattgagctttggaatagtttatacaaatgaaatagcatttgcatttgttttttttatggaaataaaggtgttcaaagtacagactctttctcctagctcctattatgttgtgaagtgtgtgatatgattgatcattgtacatctattagtcctgttgttccatctgcctgcttgactacaagcatgggaattttgcatgcgcggcacgctgatcacttgccagttgtatgtatgatctttggtgctaaatcacccgaaatgaaggaattttacctactcatgtgagaactcccagagattccaaagtccaatttgggttctttaaaaaaaattccgtgtaaggcataatgcaattgtttttgtgcagtttttgaggtgtgcaatcggaaaacatatcaatatcgccgttgtgaattttcttttctatttccttgcatctccttaagatttgtgctttatttctctccgtccatgatagtagatggtagtgacagtggacatgtccctaaaatacaagagttagttaaagagggactgaggctcccattggttgctcattttgcctaataagccaatagatagaaaataaaaaataatttataattaaaacttttatagatttgtacgtagcgacttaaaagccaacattaacagaaattacgttaaaagcatctcaaaatcaactaaatcaagttcaaaaatttaaattttggtttattctttgacggtttaggccaaacgatgaggctctgagggagttacacgattttataaacttaataacattaattatttatttcttatattacagattttcagtatatttaacaaggatccgtactcactgcctagtaaacaaaagggatgaaaaatgtatgagcaacataaatatagaaacaaaatgaacatgagtcaaagctactccatcttcatgtcccaatccccaagcaatggatcgatcattcctctctctctctctaaaaaaaaaagaaaaaacaaaataaaaagcaagcagtagatcaacttgccgcggggggagagtgtcagtgactcagtagagagagaggggggcagcggaagaatggggcggtggtggccgccgacgtcggcggcggccgcgacggcggagccgcggtcggtgcagctgctgctgctgggcgtcgccctcgtcgctgcctccttctacgccggcaccgtcttccgctccccctccgcccccgcgctcttactgcccccatccgcctcccgatcgcccgatccttccagaaccccaggtacctcgtctacccatctcggagcgcagggaggtggcgcccgggggtgcctgatccgctgctggctcgcatttttcagttcagttcttggggggaactagaattaggcgcccatggcgttggcggtttgcgttttctggtagcttgcgcaactattgtggcggttttaggttcctaattgtagaaattttcgatgatcttgaattagtgtagaaaggtgattatttgttttgcatggaggactgctcggtttgtttgtaaccaggtgatataacattatgtattagacactgaaaagagtatagttttcacagacagttcggcatttttcagaaaaaaaagggaataaatcggttaggcatttg

SEQ ID NO: 20654 - DNA, 783 bp, Oryza sativa
tttttaatcctttaaatataatttgacatggtagttttatacctgattgacacaggctagggaatatgacagcagacagtactggtgttctccgctcggcaggagtggtccaagttttggatgttggatgtggtgttgcgagcttttctgcttaccttcttcccctagacattcatactatgtcatttgctccaaaagatggccatgagaatcaaatccagtttgctctagaacgtgggattggtgcaatgatctctgtgttggccaccaagcaattaccttatcctgaaaatgcatttgaaatggttcattgttcccgttgtcgtgttgactggcatgaaaatggtaaggtttacaactttaaacactgtttgtgtcaagctatgcagccacatttgacttattatgactcttgagattttgattgggcaacatagttttgtgggaacattcagctatactatgctggtgctattcagctataacaagttcatctaaaagtttagttgctctcaagttaaaaatctctgttctacattggtgctcttcctaaaatgcaatgatcctttgtttcaaaattttaatctgaatacataattcatattttgctgtatgacttattttcagatggaatattgctgaaagaggtagatcgtcttctgcggcccaatggatattttgtatactctgctccaccagcttatagaaaagataaggactttcctgttatctgggagaagttaatgaatataacaacatcaatgtgctggaagcttattgcta

SEQ ID NO: 20655 - DNA, 11746 bp, Oryza sativa
tgaacaggtgaaatttcgtgagtcccaacaaagtgctagttgctgcagatttttcttattctcaaggttggcttcttttgcttgtaacggatttgttaccttcagcaaattatgtatttgtagcttgcccccaagttctaagtccttgagttcatgaagtctacaatcagattcattgccaaccatatacattgtcaatgttcgtaaactgctgagctgccctagacccggcggcatcctttgtagactagaacaaccatcaaggtacacatggcgaaggctgatcataaatttcatgccgtcaggcaggtgagtcaggcccctgcatctattgagcattagtatttgtaaattgtacagtgcactgaccgcttcagggagtgtttttatgtcgctagaggataaatcaagataccgcaagtgcttcatatatgctggttcaactgagaatctttcattgtcacagatatgaagcccaagcgctctacaaggggacaccatgaatctgacgtccttcatagaattcatatgattcttatgtaaactaaatagacttcggataattggacaacgctgcatcacgaaaccaatcttgtgtggatgtgggaaaactagatgatggacattcttcggcattttatttatttcaacaagattttgcaaagtatagcactcatccccgcttatagaaactgcaagatcatgcataagatcatgaattttgcatgtagttacatctttgtacccatatatgtactcttccttgcgggaccgagtttgcttcgcattttggaaaaatgatctccaaagaagctccagaaaaaccttgttcccagtttcttctatgtccgaggtctctttagatggaatgaatccatttgatatccacagatgtattagatcatccttatcaatctcgtagtcctttgggaatacagcacaaaaagcaaagcactgtttcataaaagaaggtagatgtttgtagctcaatgataggactgtcagtatgttattttcctcccaagtattgttttgaaggatcgccagccaatcccttacactatgttttctactcagcaggcctcccatactatttattgctaatgggactccagaacatttttgaacaatttttgtaccaatctcgacaaactcacaagacttggccacacctgtacggaacgctctttcacagaatagagtccaggaatcttcttggctaagttgttctagagccaatggaggaactgtccccatgactgacgcaacattcgaatttcgggtagtgacaaccaccgcacttcccattttacaggaacaaagcaatgttcttagagcctcccatttttgttcatcttcattccaaacatcatctagtacaaggaggtacctcttttggctcagttcttcccggagacgttgttgtagcaattccaggttatcactcttcagtccacaatcattcccaattgcagtgtcaattatccccttgacaatatcaggaacactgaagttctctgagacacaaacccacatatgcttttgaaaatgtgctttcactttcacgtcattgaagaccagctgtgcaagagttgtcttgcccaatcctcctatcccaacaataggaagtattagcaatttgtcactcttggcacttagaagcatatggatgatttcatctctttctttgtcccttccaataacttcctgctcgtcgacgtaggaataggtctgcatcctctcatcctctggcatggggcaatttaggaacccaaattgattcatttgcgaaacaagctgatcaatctgttcaactatctgctggagtttctttcctatcctatacttgaacagtaaaggattataatgagaagagaagaaagcccttacgccactgttgattttatgcccacgacggagtgcctcgctgcgaagcgcctcgtagtgcagctcatcgagggcatcatcagcatcacaggcagccagcttcagcttggtgatccaggacttcacagcaggcttcttggatgcctgctcctcggcaccatagatcacttggttgatggcaagcagcaaggtatacagctctgaacgccggtgttcaatacccccaatgaaactaaactctgtggagagagactcgccagctttcttcagaagggcaggtagaagagctgagagtagctcagccatggctccaagctcagagtttaaaggaatatggacaaaacggaagagatgagagagcagtggagagtcggcagaaggtctagtatttagaatctacaggaggaggaaagacacagtacataacaagttggtgtaaggggcacataaagagggaggacaatatgtggttcgttgaagaattagaagaaaaaaaaaagattgcatccatcatgctaggtgacgccttgtgaatttcaaataatcatgttatattttaaaatttacgcatagatcaacaggtaaagaacaaacatgtaaatattgtccgcacaggcagacaggctatagtcctatgatcggcacctcctttgatgaagtccaaagctcccagaatttcattttttaaaaaaataacattaaagcggtgtcctattatccatatgtgtctgaattcgtgcttcatatcccaaattgttcatgaacagaacatatacaccaactcatgtacccaaagaattgatagcattgcattttttcagttaaaattgcaaaatgtaaaacagtaaaagccaatgcaacacagaatcaactatgaggtacattgtaagtcatgtatgtcaaagccccagcggacgttcccagggtttatgctgcaatcacagtgaatgttcgttgggtttatgcaaaagagaaatgatcattcgccggaattataaatcattgcataaacccagtaatagcagaatccccctccactgaaacatctccttagcagcaacacgatgaaacttcgaggtagtttcatctttcagctaaacagcgtcaatataaaaaatgacagtatgacacacatattactttattagagaaggtggcaaaggttcgcgcatcttcgcatcaagaatggagggggaaaaggcaagctaaagtataacacgcataattgcaactaaagaactaatatggatcttcttttcaaaaaggaaataaataaataaaataaaaggtaacacccttaacagcagttgttatcaccgcggtgtatgaatagggttatcattctctaccggaaaaggtgtccgttgtggaatcgacccaaaactctactgtatggccgaatttcttgtgattaaagcttcaacaagaatacaatattgctagaccgatccacgcatacacccaccaccaccaccaccaccacccattaaaaaaaacaaaaaagagagaagaaaaactttacctctagaatgctctaagctactggcagggtcaaaaaaaaagtaaagtaaagcttacagttgcaggtggaggctgtggagccatggctgccgcgccgtgccttgcgccgaccgcggagatccggcttcctccgctccgaggagccttggttccagaacgcgtacggcccttgtaggagagaacatggctgccggcgtgcggcggccggcaccgggttttcgccgccggagcggagagcggaggcgaccgagcaccggaatctccgcaaccgctactccaggccgtcggataggagcagacggccaggatctggcccggctcactctcatccaacaaattggaggcccggaatgacggcccatctctgtggatcggcctggaaattaaactaatatttcggcccatcaagggctcgcttgtaaaggccattataacgtgtattggaacagttataactggtgatcagcgtgttccatccaaagagtaccgggaacaacctacacccgctccaaaaaaaaaaattagagactataaagggcggcgccctgggcggccgctggggcgtgcccccgccgccgcgatccgcgcgcgccgccaccaccgtctccctccgccgccatcgtcgtccccgtcgcttcgcgccccgctgccgagagccgcgcgcgccgccgtcgtcatccccgtcgcttcgcgccttcgcctcctccgcctctgccttcgcctccacctcgcgctaccaccgtcggtcgccggcccccgccacgacccccttcatcagctaccggatccggcaccgtccgccaccaccgtggtcgaaggaagcccgtaagctggtgtcctctcgccgctggatgtgacgaggactcccgtcgccatcacgccatcgccgctgcctccgcctccgcctccgcctccacctcctcctccaccgctgtcgcgtcgcagtgtcggagctcctccgcctccgcctcgcgctgttgccgagcgcagccgtctccgccgagcggcggtgaaggcgggcgcagcctccatcagcgacggggtcggagctctgacgaccacgccacagggggcgcaaagagctgacggctcatattctagcatcaggagccacgccgccgcgcccggcgaccgcgacgacgaggaggaggaggagccccgtcgccgcgtccatcctccgccggctgctacaccttcgtccgttccgcatcccgccgcggcgggtaccggcgcctcggctcctccgcctccgtgtccacggccacggatgtgatttgggtggtggtggggacgacgaagcgagagaggagcttgttccatgtcgatccggccgtgcttgaggccgggctggtgcagcgtgtgacgccccgattttcggtcgggattaaaaatcatttaataatgcattttctataaactaaataaaagttaaagcaatttaatcaagtgaaataatgagggaatttaaaatttcctttaaaaatcattggccgagaatattttgtaatattctttgtgccctaaaatactctctgaaatttctcgcaaattttcggagctcgagaaataattttaatagcacaaagatcattgaatcaattaaaataaaaaagaaaacaaagaaaatcccccttcctctctttgggccattttcggcccaagtcttccttctctcccgcggcccgcgcgccccctttctctccctctcgggccggcctcctccctcggcccgctcggctctctctctccctcaagtctgttccgtctccccagccagcctctccctccctctctctccgacaggtgggacccgtggaccccacctgtcatccccaaccttcggcctcccaggccggcaaccgccatggccgcccgagccgcctcacgtcgccgctttccccgcccacctcctccaccctgcaccgctcccgcccgaccgtgggacctcgccgcccacgaccccgctcccctcccccactccgtcccgcgaaaaaccgccgccaccacccccacgacgccgccccacttccccctcgaaatccgccgctccccggccctctcctcgcccccttgagctataaaatcaatccccgtggcctcctcttcctttttccccattttcccgagtccccacgccctctaccgagctctccacgccgatccccatcgccgccgctcgccggcgatctccagccgcgcgccgccgctgctcccgccgtcgccgcgcctcaccgcgtgtgccatcagcttcgccgtcctgcgcagcacgccggcctccactcggttccctccaaacgccatcggaaccacctccccaccgtgtaacctctctccgccgcttgcctccgaactccggccgcctctcctcgccacgctagccaccgccaaaccgcgccaccgccactgtcggcttcgccgctccaagccgagcaccggccatcgactcgttcctctaatccactaccgagccgccctccccattaccaaccaaagccatcgtcgccatttctgcctccggtcgcgccgcgtcgcttcttcagtccgccccgtgttgtgtcgttgccctccccggtaccgcagccatcgtccgtggctcagcaatccctccgtgttcgccggtcgtcgccggactcatctccccatgcctcccggtgagctccgtcgtcatttcggccggcgtttcccgccgcaccgcaactccctaccctctcctaacctcttcatttccttcccaaggtcccttcgaccatcgactgccgtttcccgctcgcggaacgtcgccgggccatcgccgtcgtcgtcgcctcccaccgctccggccgctaccccggtaagaacccctccttcctccccctcctcttcgccggccgcgcgcgccgccgccgcccacgtgcgctgccgctccccttgccgcgccgcgtctccgctctctcgcgtgcgctgccgtcgcccgcgtgtgccgtcaccggccgtcgccgccggtggccgcgccgccgcgcgccgtcgttcggccagccggctttgggccgtgccttgcccctaccgcgccgcccgtgaccgttggatcggctttgggccgatccaggccgtcggtcccgtggaccacttccgtggtccgggtccacggtgccgcctcggccacggtggattgagtccaccgtgtgcctgccccttgtgccgcggacgagtggggcccgcctgtcggcgccagccctttgctgacgtcagcacatccttttcctttgagaaaataaataataattacgcaataattcgtgaataattttagaaattcatttaaatggctcaaaacttctaaaattcatatctaattcattcgaactccaaattgagccattcaacttgcaaaattcatctaaaattgagctctacatgtttgtttacttttgatgtactgttttcttggtttttattagagtttttcctcgttttgcgtgccagcgtgtagttcctgtcgtttcggaagtccgcggtcgcgaggaaaagagttcggaagatcaaagtgaagaagcgaggcaagtcacacattccccttgagcatgttgatcccaatttataaatgttttaccgtttgcaaataaatatgcatgttttgctaattacatggaatccgggtattacctgtctgctcgcttgtgccatgtttacttgatatctgtcctttgtcaaccgggagcaataaatcgactaactcatattacttatttgacctagctagaactatatgcttagccatgcttaattaccactagctcagttgatgggataattacagtattagacctttttagtatcagaatgagctgcgtgctcgagacatctggccatgcttcatggtcgtaattatcccactaaaatgcgactgaatggtgggctgtgggtgcatggttttgctagtcgcacccatggcaattaaggaccggttcgcgggaaaccctggaagaatttatcatgcttaccacaagccagcgtgggcaacggctgggcttgtaatgtagctttcctctagctgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacagtctctttccgatatgtcgtggtggcatgtcggcgcacgaaaacgtgtcgtggggctgtgtcttgtgggtacagttgtacacctctgatcagagtaaaactattcgaatagccgtgcccacggttatgggcggtcgaccagattcaccgtgattagtcccaccttaataaattgacccaatgcactgtagttcaggtgggttggttgggcctgttcaacgtggtgtagcgttgatcagtggagatttaatgttactttaattactcaactgttttactgttttgctcaataaaatattttacaactgcctttatgcaaatagcctcaaacccctttttgtatccccttgcacgtctgcatcattggtgtggcttgctgagtacggtagtgcttctgagctgaagacgaagttagaagaccaatgctcagaccccagttgagttttgcctgtggagtggagctgaagccccgctaggatcgcctttttccgctactgtcgttctcttttagtgtgagagctaagtgcctcttctgtaagtattttacgctttatttacgtttggaactgtatattacttgtcgttttgtgtaccctggctggtcctggatagggatttaatatacaaaatagtctggaaatttagggctaaatttctgggcgtgacacggcgcctcctcgcggcggccgggcagcgggcccgcagcggtgcggtggcggtcgcattggacgtgctgctgtggctgcaggcggccgggaacaaggggatgttgggctacgacgatgacgatgaatcagccgccgccgacctgtcggagatcatcgagttgtactcgcaggacgacgtagacgactccagccactgcgggtcctagcgccaactctctctttaaaactgcatatatttagttatgtgtatagggtcataatccctcctgaaatagaaataaggtggtgttctatacatagattaattacttctacgagttaaaaatatgcatctgggaacaaatcacaaatgataaatctggttgtatgtatgtgtaatcaatatagtagatagtaaatactgcagcctaatctgctctcttggttctccgaattaaaaaggacatacagctgtagatgtcgaaaaaagtgccgtttttcttgttgcttcttttggtgcattagatgcatgctggtgcccttcacccatctttcaatttttccaaggatgacataagtcatgatatgttacatgctgggcataaggttacgatagaacttatgtgccgcgtattgcataatgctgtctgtaaatatgaagtgcttgaatgatgatttatattcactctcttctcatattagttgaaaacttgctgctggctatctcttcttcaagcaatctaactttctgaatgattttttttacttatgttctgattttatgccatcacttttattttcatgctctggaaactagaaagtgaaaaaaatttgtgttattttgaataatcgcttcatctttacttgtcatgtaaagctattgatgttccacaaatttcattgttcgaggaatgcgtaatgctggaagacctcttgaagagatgcagaagaaggagagcaaaattgtaagtcttatatttttcaatcatgtaaagaggaaaatattactcagacagatgggcgcacataatttttttttcttctgggttgacaagctatcattcaaagaacaaatgtcctgcattttgttgaaagttggccgctttgaggaggcggagaaaacatataggtccctgctttttatgaatcctgataactacaactgagacacctgtgctgtttttttccctcacttaaatttctttgctttggtcttctggtaagctctaaaaacagtgaatatgggttttgaatttcagcatggacttatgctaatatgttgtttacatgccatttttattccttttgacggatatataatatctgatttttagattattgttattttatagaattttgtgattatgcatgctttagcgacttctgtaaaatactttctcccagtttatgagttatacttctgttaagtgtttgtcaatcggctaattcaacaaattttattggcacttgcattttgtagttaatcacgacaacaatttggtctgcaaccacatgaactatccatgaggcaaaaatcatatgttatcacgattgattctgagccttcagtccttcacttatttaatgtccatgttgcaaaactttgcatggcattgatttaagttatttcttgtgtttgtgctctctttgcctaatatatgtatatcacacgcatggtcttcataggaggacaggggagctataccattacatttctgtagcatgatggtgcaaatttagcatgtgggagggttcttagttaacctggtgggtggtgggtttaaacagaggccaggctgctgctcaaacaagggaaaattgtttttaggcacattttaaagcaatttggatagcggcagacataacattatggctattaccagaacctgattgcatttctgaattctgaacatttatgaagttttgtgagatcaggaaactcttttaccatttctttcttgctttttttatgcctaaatcatcttatcttatgttgttttctatagaaaattatataaccttctgtcactgaaactactaccaatttaccgcaaacttagtggaaaccacaactgtaatttactgcttgcagtgctgaaggtctccgcagaagatggcaagggcaacaagtcttctgtgactgttcatttgtatggcccaaatacagacttggtggttgatcggaagagggaattgcaggtgagcatttgaatagtgtgattattgataatgcgtgtatatcatgtcctataatgttccttcatggctgtgcaattggttcatctgttagtcctgctttattttatttggtgcatttttttacagcaagctcaaagaacctcattgttttttcaaatattcaagggcttcttgaccatgaaggatggtgacatttcagtcctattccacaaaaatatgttaatgaggatgtattattaggagcctcacttgtcggttgtcggtcttgattcttcatgtagtttgtagacaactaaggtttggcactaatagaactagactttcagttaaatggacgatttctatgaaggaagatctaatttgcttcgatactctactatctacatgccatttttaatgctcttatctggtagatcattgaatggttagtatgctcaattatgggttgtatgctaatatgggtgtatatttgtctgcaggatttttttcttccctttccctaccatgattctctatggtgaggtatagctttttatttgtattttactcatccaggccttctgctatctgtagtttccgtaattatattcagctatctgtcttttaaaaccgaattactagctatgagctcaaaatagcatattatttgctgtcgaaaatatagatgatttcttatagcccactaaggctgtgttcgctgctggtagttgggaatatttctcccgtgcatggaaaacggagcagtccattagcacgtgattaattaagtatttgttgttttttttctaaaaatggatcaatatgattttttaagcaactttcgtatagaaactttttgcaaaaaatacaccgttcaatagtttgaaaagcgtgcacgtggaatacgagggacatgggttgggaacccatgctgccgaactaagagcaagttcaatagtatagccaactaatagctccaattcatctatagccaatctaatagctcattcatacaatagttatatactacactattagtacctggtcccacctgtcatacacacactatgtcttggagtccgtgctacagctggctacaaatctgtagcccgctgcacttctttctcctcatttatctccttaaaatatgtttgcagctggcttatagcctgctattgtacctgctctaagcctaaggagtgatggctggatagatacgactctctgttattacccccatcgctgttactattaatgcggccagtgtggcatcactgtagttagaaaggaccgctcttacaaggat

SEQ ID NO: 20656 - DNA, 688 bp, Oryza sativa
tttaccttatgtacattgaagtttgtgaattatgtactccataaatgttacttgtgtggagtatttgatttaattagctgattttcccagccaagtttgacattttattttagttctgttttgcaaacaaaccaaagaagtccatatttgaggtgcttgatttcatattctattagcacaaattgatcttgagatctctgtccctatgttagacagaggatttgagagatcacctattcgttctaagcttttaaacttttggatccaccaaatgaagggcttgttttaactttttatgagaatttctatcatatttattatacttttatctatcaactgtaaatcacctgcagtcaaattttattgtacacaagcaaatagacataatgtgcgttgatgccccttattgcttttacaggctgttgaaaactggttagctgacagggcagtattgccacttgagaattcattgggtggtagcatacataggaactttgaccttttacttcgtcatagattgcacattgttggagaggtccgtcttgctgttcgtcattgcctgttagccaatcccggtgtcaagattgaaaacttgaaaagtgcaatgagccatccccaggtcaaactcttgcacaagatggcctaaatattctttattttttggtgtactaaacatgcagacatatta

SEQ ID NO: 20657 - DNA, 1010 bp, Oryza sativa
ttgcccaacctctttcaagcttttatgagactttgccacataactatgatcagaaacagttattgattcataatcacggcaattgaaaggtgatgctgaaacctaaaaaagggaacacttgagtgagtggtacaccagaaactaatgcatgaaaattgattctctcccagtgcgtcattatattgataaatgaaggcaaagtaaagcatcctagtactacataaaccaggtactctaacatactggaacagtacacttctggactcaagaaaaggctaaagaaagagaacctactattttcaaagaaaaaaaaatcaggaaaagagcaattagaggctggatttatttccatataattatcaaaaaaagaaggaaaagagcaatttcgatttctgggttctcattagaataccttcttaaatgcttaacactttgagatatataagaaataaatgctcaaacattaaacaaaaaaccataaaataagaatacgattcaggaacagtaattgaaacatttaagtttcttaactttgtagtagagaactgcatcatttagaaattcatgttcacagtatgcaacatttgagcaaatttcctcaattaactctgtttctgttttgaattacagaagttgttaatataagggcctactgaccttttcttccccacatgattcaaatgaagaatgtacagtttcagcaggttttttcaccaagtcctcatctgttgtgaccaatattttctcatttatgcagtcaaacgttgaaaagttgtcagttgaactccgcgaatggtttcgattatcatgagaaggggaagcagatctatgttgccgcaaggtctgatgtttcgcacaagcattcctcaagttatcttggctgggacttccaatttgctgcagtcttgatatatcgcagaaagagttgaagtgagactgaccactgtggtaagtatttgatgtatttgggataaaattactgtgaggggaattcttgtccaatgaactgt

SEQ ID NO: 20658 - DNA, 8660 bp, Oryza sativa
  unsure (1)..(8660): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaatgttacttgaattggtatagaaattctgcgttttgctattgaaaagttatcggttccattaattatattttttgttcaggttgatatgaacaaatattgattagttgattgggaaactgtacctgaggcttttgttatgcttgctgacaaaaaataaagcaataagatgctgttgctgtgacgctacatcgcttaactaatgcaatcagtgtgcttgaattcttcaaaaacatagcacaatttgtcaagatggcacatggtacatgccaatattatacatgaccaaagtcgcgtcaactccatggctgctttataattgtgtaattagagaatttcatcgctgcgaaattctcgtctcaatcatgggggacttgttctttcgtttgacctgtggccatgcgtttcgggttatggttgcttaattttgttttacccccacgaacatattaatcaacgtcgacatcagtgcccgaatctcggagcaaatccagcggtgaatatgtactcatccgggaaaaaataatcagttgactttaaatcctgatgagaattgccaatatatatacttgagcagctaagtcctcccatctattctctccatctcagaaattttattttttgcccatccacattgagtaaacaagcacaaaatcttttaaaaaagaaaacagagactttcagtttgaagtctgaacgcactcttctgatcaaagttacatattggacgctcatattctctctttcaatccttgtttaccctttatttatttttcatttaggatccccttgaggtaaagtggaaatgtgggctaaaagagtttaaggtttggtaaaaagtggtattcaaactgaaattaagacctgtttaattgtgagccataacttaccataatttgctacgtctaagattggataagtttgaccaacttagacagctaagcggttgtagactagtagccactgtaaattcctttccaataaaccgcacacattaataacttagaattaataacttagaaaagtgcgataagattcgcttaggtttgttaaggtgcggtaaagattttaaatatggaaattcaaataagtttgacaacttttattggcaaacgttatccctaaccctgaagaaacatacgaacaaaaagtggttatctatatagaagtacttaattagaggcaaagagttaaaaatacaatggttacttcttaatcttattgatgaacaaatatttaaaactgatatttcgagacaatgcacaactacttactgtcaaacggagtggtacctacctgctaagttcccattaaaattacaagagattcctgcacaagattattaaattgtaatataaatataaattcaaatgcaacggcaactgtatatatgtggtgcatatttgttacgaattatgcgtgtatttttttccgtaaaataagaaaaaaacaaagttactgcatgcttattgtggaaattttaaaattttgttacacataaatttggcaattatccaaatattcatttagattttttttttccaccgttaagagatggtatcttaactatatactccctccgtttcatattatatgccatttgacttttttttagtcaaaattctttaggtttgatcaattttatacgtaaacgacttttaatatttttgcccatgtggcacgtcaatgtggcaaccaagggtaaaaacagtgtggggcctactagtcagtctcacccttcctctctccctctggttcggcgtgcagcgctgagcacgcagtggcaccagtgcccggtaatcattgtcatcgccattgacgactatgagagccacataaaggcaacgacacgaaggtggttgtcccagtctagagccagcagttgtaggagcactcggggcaacaccgccgatggctgcggcggattaagcctcaccataaccgtggaggagcacggggggctggtcaatgtttggctgtgcaagtggagccgaacggtgttcatgggccatggcatgccggagatggcgaatgggtcaccattgcctggggattagcccggaaaagcgttgcaagctcgatgcccatggtgacggcggcttacgcacagttggagctcgttcgccgttgccaggcatccgggccatcgtgttgtggtcctgccatcgactgccaaatgatgccgctttagtgactccggcgattatgccgctcctccccgtccactccgtcccgttctagcgccgcctcctatgccgctgctgcttcatgtcgtccttggtagccgcggcccctatcctgagctcgggaggtctcttgagtggtgcgggcaacagatatgaccaaatgacaggctagacaatagtcgatagtgtagatcgatcaaggggaggaggataggctggagcggttgagagcgctacacgccggaccagagggagagtggaaggggacaattgtgagagtgactagcgggtctcacaccgacttttaccactagattgccgcatgggtaaaagtggtaaataataaagaaaccacctcttaacagtgaaaaaaaaatctaggaagaacatttggataattgctaagcctagtaaataattaaatttcccacttattataactattactttctccatttcttaataactgacaattttaattttcttatttaaagtttgatcattagttgctcttaaatcattacacaaggtgagttttgtgcttacgtttagggcatatacccaactttcataacatgccattatttctagtgttcataaacaataagggtagtcaaagtttgaaagtgaatagtattcttattactccctccatcccgtgcaaccataagtttccatgcctaacttggatcgttcgtcttatttaaaaaaaatttataattaatatttttgttgttatgagatgataaagcatgaataatactttacttgtgacttatgtttttaaattttttcaaaatttttagataagatggacggttaaactttggcgcggaaaaccatggctgcacttataatgggacgaagggagtataaatttaagggagtactgttaagtgaactgagtgtatgcagctcgttcatcggggtggaacatgtccagtgtccatccaaattcaaatcttaaacttgggtacgagttcaattttttttgactgatttacaactaattttctttcagcgatagacgatgtgcccataaacaagccgagtgtatgcattcacaaagataagtgtgcgtgacaacatattcatcgatatcaagacgttgcatcatgctcgtagaaacgagtgcgcgcatgtgtatataaacgtctagttcatatttcccccgttccaaaatagagtaacctatagtcagattggatacatatagtactattatggatctgaatagtaacgaaaataaatgggagtagctgtagaactgtcgacggttttttggatgaaaaacttttaaatataactactatgtaattacattataactattatgtaattacattgtaaatactttgtaactaattgatatgtaaatcgggtgtaactcagaaaagactggttagttgaacaaacctgcaagttgttggaggtgttgggttcgatccttggtgcatgcatctgattttttttctctgttttcctccaccagcacaaaaatctcaaagcatatcaaatggtttaaaatttgaaagttttcaccctgttaactgtcgacagtagtatagcaaatccgaaataaatttagagaaaactatgaaaaatccagttaaacccggaagccaagcaagcagcaacctctcatcagcatccgtcgtctatctccagccagacaacttatcccctactctcctcccaccacaggaatccttggcttcctccgccgatgcttccctcctcctcctccactcccctctgaccgatggcttccaccccctccctctccgtctccgccgccgccgccgtcttcccgtcggccgctgacccccgcaggccgccgccgccctccgtcgccatcgtcgacaaggtctttttctttttcttcctgtggcctagcttgcattctaaaaaaaagaaagagctcgaatcttgttgggacttcccattttctaggccctaagttcgaagattgttcgctaattatagatcgcattcttgccactaattagcttagcaatgtgaataatgcgaaaagaaaagaagaagcagctaggattaatttgcgctatgtcaaaattgtgttgttgtttttttttctttttctgaatgtgaataatgttgagcgtttctaggtcttaagttcgaagattacttcgctaattatcgatcgcattcttgccaccaattagcttagcaatgtgaataatgcgaaaaagaaaagaagaagaagctaggattaatttgcgctatatgaaaattgtattgttttttttttcctgttttgttttgcagaatagttcatatggcaggagcttgcaggcggctgacaatggcggcggcggcggcatggaggctccccttcgacctctggatgtccaggaagcgatgaccatgctgacggagggcaaggcggtgcagtcagcgatgtacgtgccgctgctgcaccggtgcgtcgagacggggagcctcggcgccgccagggcggtgcacgggcacatggcgaagacgggcgccagcgccgacatgttcgtggcgacgtcgctggtgaacgcctacatgcggtgcagcgcggctcgggacgcccgcaggctgttcgacggaatgcccgagaggaacgtggtcacgtggacggcgctcgtaacggggtacaccctcaactctcagccggcgctgggcctggaggtgttcgtcgagatgctggagatggggaggtacccgtcgcattacacgctcggcgcgacgctgaacgcgtgcctggcatcgtgcgatgtcgatttggggaagcaggttcatgggtatgcgattaagtacggggccgagtcgatcacgagcatggggaactcgctttgcagtctgtatgccaagttggggagcttggattctgcgttgagggcgttctggaggatccctgagaagaatgtgatcacgtggacgacgatgatatctgcgtgtgccgaggatgaggaatgcgtggagcttggaatgagcttgtttatcgatatgcttatggatggggtgatgccgaatgagttcacattgacaagtgtcatgagcttgtgtggtacaaggctggatcttaacctgggaaagcaagttcaggccttctccttcaaaattggttgtgaaacaaatcttccagtgaagaactcgacaatgtacctctatctgagaaagggtgaaactgatgaggcgatgcggttgttcgaacagatggaggatgccagcatcatcacatggaatgcaatgatctcaggctatgcccagatcatggactcagcaaaggatgatctccaggctcgatcaagagggttccaggcgctcacaattttccgcgacctcaagaggtctgtgatgaagccggatcttttcactttctcaagcatcctatctgtttgcagtgccatgatggctttggagcagggtgagcaaatccatgcgcagacgataaagagtggcttcttgtcagatgttgtggtgaacagcgcactggtgaatatgtacaataaatgtgggtgtattcaagatgcaaacaaagcctttcttgagatgccaacacgaacttttgtcacatggacttctatgatctcaggctactcgcagcatggccaacctcaggaggcgatacaactcttcgaggaaatgagattagctggggtgaggccaaatgaaatcacatttgtaagtttgctctcagcttgcagctatgcgggtttggttgaggaagctgagcattacttcgacatgatgaagaaagagtattgtattgaacctgttgtggatcactatgggtgcatgatcgacatgtttgtgcggttggggcgggtagaggatgcattttcctttatcaaaaggacaggttttgagccgaatgaggccatctggtcaagtttggttgctggatgccggagccatggaaacatggaacttgccttctacgctgccgataagctgcttgagctcaagccaaaagggattgaaacctatatcctgctgttgaacatgtacatttccacagagagatggcaggatgtggcgagagtacgaaagctgatgaaacaggaagatgttgggattcttagggaccgcagctggattacgataaaagacaaggtgtatttcttcagagctaatgatagaactcatcctcaagcaactgagttgtatcaactattggagaatctgttggagaaagctaaagccattgggtatgaaccatatcagaatgcagagttatctgatagcgaggatgatgagaaacctgccgctggatcactaaagcaccacagtgagaggttagctgtcgcgctagggctgctgcaaacacctccaggtgccacggttcgcgtcacgaagaacatcaccatgtgcagggactgccacagctccattaagctattttcgctacttgaaaacagagaaatcattgtccgggacagcaaacggcttcacaagttcaaggatggccggtgctcctgtggagattttggtgctctattgtgagaaggatggaaatcttaccccccacatgctactctaggaactcaacagttttgtagtggaagcagggttacaagttacaggttgcacagaattcttttgatgaactgatcaccctttgtgatttttgtagatctttgtatgaaatcgaaatttataaactcaggcagtgtccccaaatgatctgtacacaaggttagcattataggacagtgaatacttgtgaatctgctgtaaatgctaaaatgctagcttcttaggatcagatctaagattttattgtttaaactcacaatgcaatatggcagtaacccccattctttgatcttatactaggagatcagtgtagcatacaaaaatatagatgctgtataaatgatagagttgtttaataaaaagcatagtgttactcgaaatatatacattagtgaggagactttgtgcagtttgttcatagaactggtttctgaagatggttgcatgcacttgtacgctattgctggtatttgaatatccaaactcaaagaacaaggaatttctactatgttttgaaccttttaactttaaaaacgaattctgtaaaaacttattttcaaatattaatcttttgaccacaccatctactcagtgaatacggaatgcgtggctgcgttgtttcaccacaccagtcaaactagcctaagtttgtcgagagtatatttttaaaataaacaaattaaaaggtccaaactatattaaaaaaagaaatcaagaacaagctcaacaaaacatcaatttggcaataactggtaagtctttttatgggctgaagggattgatgcttgaaggaataagtctacctaaagtgaagttattccatacttgaatgaatgattgcaacttaggccctctttgtttaggtttagacttattgtcttagacttttaagttaacttattggcttatatgatttataagccggtggatttaatgtcctaagtttagtagtggagtcatacatctacttcacataagccaaaaaagcttctccaacataatttttggcttaatagtgttagagtggcttacggcttcaaaaaaaaaaaaaccaaacgaataagctgcttgtttgtttagccttatacttttcggcttataagcctaaataaagagggccttaatgggccaagatcccattggccatgttttggagggctttttataatgtcaggctcttttgtgggagtctaccaatcatgaagcctttgtagtcgacatttgggcaagtaaacaaccatatccaaatgtgagagtaaggacatatttggcagagctgtctctcaaatccgatttacttgtttggtaaccaaattgtccaaaataaacaaaaactaaaacgaaacaaggtgaagcgctctaaaaaaaattgcactagagaggtggaacgggttaggccagctcaccgtgaggtaaaatacaacgctagtcatccactttcttagaaattttttttgaggtaccactttcttagaaattatagcaacttgctacggcactaccctcccctcttccatacagattgagattctctgccttaaatcaagtaaatttacagtcactgaaatgtgggtacatagaaaagagggtctacatatcagtgacttaaagttatgtgacttaggctttgttcgggagtgaggg

SEQ ID NO: 20659 - DNA, 1858 bp, Oryza sativa
acgcagaagagaaaatgaagtttgatatttcgattcaatcacaaatttacaccttcctctgtaacatcgaaaatagcctacacatcagccacgttctccgtaccaagaaagaacgataaaacttaaagtgttctacacaccaaggaaaatctacaatcttacaagatggtgacacacaatgtgctctaaaactaagatattagaatgcgcatggcacaatggccaggttatttaatccattatctaaaaaaagaattgctgcacagcctgcactgataggtaagctaagattgctttggcggtcatgagcctgctttcttcttcatgttcctccatttcaccctcaggtcggatgcgaggcgtgtcctgtggaacacatccctgccgtaatccagtatctggacccacggaattggcccgttgtcacttggggtgaattttgccattgcttcctgaatgaaaaccccgcgaattgtgtaagcatacaagagacacatgtatgcgcattacttactagctgggccacagaagatggcgcaggatatcggtgaaggtaaaagggattatacagaccaagtgtgcttaccctcaaagttgcctcctcttgttctgtccagcagagctttgtgcgccttccagctggtccgacagggttagagctgaaagaaaaaggcatgcttaaattcttgatactactaccaaagtgtcacactttcaagtgaaaaaaaaatacaacaaatgaagcatccgaattggtatctgtgctaagcaaacactgaagtcctgtaaggaaaatgagtcaaaatttccattgatgattccctttttgttgtatatacttgtgttttcacgcatcagagaataataagaaaaaaccattatctatgtcaggaccacaagtagagtctaatttcaatatcctaaatatgatttcttggatcaatggttcctaagaatttgctttccatcttacaatactattacatgataaagctaatgtcctcttaaaccatatggaagctattgcatgatgctgtctatcagtctatgacattgaaccatgaatattcatggaaacttggttgcaacttgcaagagcgctgatactcaatgttctatcccaccaactctcacagtacagttttatttgtcacatgtctaaatcagagtgttcaatttcatttggtccattgaaccacaattcatagacatgtctaaatcagagtgttcaactaccatttcttttggctatatgcaaactggcagtaaatgggagtacaacaggagaaagaagtttcctcaaaaaaaaaaaaggagaaagaagtgcttatgaagcttattagttattgatatcacttactaacgcttgggtggatatgcatagttccttttccttgatggtgaagccatatgttgatcatggtgccccagtgttttcttagaattaattggaattgctgtattattatcctgatatcttgctttgcggtgtctcaacttgcgccaatgaggcgatggttgcttgctagggtcactagaagatgtagcttcgatttcatcagaatcttctgactgttgagaacttgcaaggacatcttctttgtcagcatcaatattctgacttgcagcaggactgcacttgttctgagatgaatgtgctgttttgtgcgatgaatttgtattaccagactctccactagcttctgcattttcctctggctgctcctgctctgcaacctgagcttgttttctgttattctggagtacaagaattctttttcatggatacaacatcagagttatgaacagtgggcgcctttttagtgactactttctgagtgcaagcatccctagcatt

SEQ ID NO: 20660 - DNA, 23625 bp, Oryza sativa
  unsure (1)..(23625): unsure at all n locations
gatcctcactgttggcagctttttgccgcactgcagcttgttgatattgctcagccaattgctttctaccaaggaaagctgataggttcttccttgcttcagaatatgttttctttgccttttgatatgcttcagttgctttagtatagaagcatacaggacagtagaactgaccagaatcatcaaatgtcactgatgagccaaaacatgtatcatgaacggctaaaaaacagccactgcatttcagcaactgaccatctttgccacattttatgcacaactcttgttctgacaagccctcaacagtaccattagcatattgatcctgagtacagaacggtagtttttcagccattgacagaagaccaccagctgcgaagccactgaaactaccatctgaagaatgcacatgcaatgtttctgccacagtattcgccatggtttccttgtttgaagcttgctttgctcgcttgtcattaacatcattaggagaggttggaatactgcagcaatcattctgaacttcagttctgttccttccaatattctgctcagagaaatggttggcctctgaatttctgttatgcaaggtcatgctgcagccatgagactctagagcagtttgcttattcagcccaccaaagaccatattattttttatgatgttgccatcatcatatagagcttgattaactttgtcggaacaaccaacttccaaatgagccttgtcactattttcttgttcaaaagtttcagtatgctgtgtagtattccctgctggatctttaatttcagatttgtctccttgaacatccccattaaagccttcagatggtaaagcagcagctgtctgaataccagtactgccacaacccacatcttgatttgctttatcaccagtatcatgttgccctgaatttggatgagttttgctgaagtgtggttctgaagtcattattttatcctctacagcaataaactcaggcaagtgggtcatgttggatgccggtaaagcatcattgcttctgtcaacagctggagaaacagttgtctgcatggttgatccttcatggatggaatcctttggtgactgaatgctggcaacaagtggcatgtctccattattactgtgatgtttattaggatatctgaccccacaagattgtgattgaactatggttgtatgatctatcgtgtcctgctcagacattcttcctgtattacttcccagcaaatctgcagaactagctaaagaaggctcagctgcaactgacatgtgtctatttacattagttggactgtcttctggagacctgatgttgacaccaacagtattaatagaatcttcttgtcgctgatcaaaacacctattgtctgatgtacatggttgttgaaaatcagaagttgccattgcatccttctgaagattttctgtgtttctttcatcgactaaatttgctagatcatcctgctgaagttgagcaccatctgtagtgaatccggtcttctctgtattcacaagatcatggctgatattgtcgtgttggtcatttccattctgctccactggggatggtggaaccacaggtgtaatctctgggtaaacttttctgagctgaacataaaacaagcagcacactaattttaacagaagtcctttcttcagatgtgaaagacagcattttaacataccaactcaaaagaagtttctggtaatgtaggtctctttatgcatataaacttctggatatcttgtctaaagggcggaagcatatccttctccaagctccctgagctaccaacctgaaaattttacattatgtaaagtaaacctcaaaattatctggacaccaggaaggtattacagacaaattgcagcacactagcttcgaaacttgaataaaccatatgcataatattgtttcacagagaaaaaacaggtttaatcacaagcaaacaacaaaaaaattaaaagggtgacagtagatacatgcataatcatgtgaggaacaatatttaacacagctagcaatatatttatatcaatcccacagttcttttcttaaaaaaaaattagcacagcctccccttttccctgcacaaattaaagcattcatggagcactcaggccaccaataatcatgtgaaaaataacatttaccacagtataccccctttcccagcaacaatgatcttttgagacttcataagcatatgctatatataactagagcaaaggtaccaaaatcaattgggaatacgtaagacaaaaaatgctagaggtaatatcatgttcatatcaccagaatgcttgagctcagaaaacatctgggtcttgcctagcaatgttgcacataataaacatgcatcagtgaacaactcattggttagagatctgaaggttcatctaagcacatattcttcaaaaggtgctgagcagattacaagtcaaagggtgaaaatgccgtttcatatcactggaatggatgagctcaaaacatagaaagggtgtctgaaccaagctaccaataaccctattattcaagaaatgtacccaaccatgcgaatggggatcaccttgtcttcacgaatagtttgaaacgaattgcagagttttccagtaaacgaatacttaatacttgatcgaatgaggcaaatatgtcaatgcgttgcgccgaatacctcacctcccggatgagttgaagcagcaaatcctcgcaggtgcgggatgcgtcctccaccccaagcatcccctcccccggcgccgctatggccgaggccgtggcgccgcgctcgccatcggaggaggcgagggagacgacctcctggaggcaccgcagcgccacgcgctcccgcaccgcctcaggggcggccctgacggaatccggggagacgcccaccatcgctgcgggggcaaggcgggcaaggcaaaccctaggtgagagtgtgagacaaggaagaagaagaagaagaagaaacggacgcaaacgagagcgcgcgcgagagaggagggggggggggtggatctacccttggtgacggcgaagtcgagggcgtcgtcgccggcgagcgcgtcggcggcccaaaaggcggcgaagcgggaggcggtggcggaggcggaggtggaggggcgcggcatttgcggttacgcggtggtgggggtggtgggcggcgagtttggtgggcgggtggagcaaccggacgccgacgaggtggccgccgtggaggcggcgcgccggtgagccgccggcgaggagggtgggggtggggatggtggtgcgccgccgctgacgaggcggatgggccgggatgcgagtaccggaaaggcccatttgttttagattttggatccacaccctatgaggcccatcggggagtatttgtggatagctttagttggtgtttatttcttttttcgccataaatatagctacaccctattattttatctcgattttcgtaaacgatgtgttctgtgcgaatttattttttagaattttcctaaaatatgtcaaataaatatattttgcgtatagtagtgtattcaggtcatttataagagatcgacaaataggtcagagtcattgattagccaccttgagcattgttttaggaggcgaagaaggctttagagatgtttcatactccctccttcccataatatgatacccaaaatcccttttattataggacggagggagtatatcgctattgtgatttgaatgttttgtaatctacggtaatctaggatatgaagttgtgatatgggctaaggacaaggctaatgtatactctccgttccataataagtttatttgtgtctctcctatttatcataaggttctttttacgtaaccattgtattggagtttgtgaaagtaaggaataaatgtgctaggagtagataaagtataaaataattatattgagatttgataaagggtattttagtctttttgttgttgtattggtatgtgtgggatgggtgaaaaataaacttattttagatagtgggagtatgtctcaatggataataagagtgggcccatgtgtatatagtaatatctatggctctctctacaatggttaatatgtgtgtgggaggagtttaaaagtgagtcctgttggatctcactaagtctaaaaaatggatacctagtcctttgaatgaaaaataaatcagtatctatctatacctaattaaaaaatacgcgaggcttccggaaaaaaaaatcgtccatcttttttttcggtttttcctttctttctgtccgttttctccgtccgtccattttctccctgttttttctcttttttttttttgtccttttttactgtttctctccatccgtctattttttcgctatttttttcgtccatctttttctccgcctttttccgtccgctttttgttacctttttttagttttttccatccgctttttttttggtaggatttatttttttatctgccatatttatttcgtcgtcgggccaaaccctagcgccgccgtcacatcgatctgcctccccatgcctgattaactgcaaaaattgatgttgcactactccctcgtcattttcctcatgattttccctttcaattccgctttaattcactgaatttaatctccatttgaaagtcattttttatcgtgaattttaggattcactccgattttaataaaaacagattttggagatcgagtgtatcaaaactctaaaccaattaaaaacagaaagatgagatcgagtgtataaaaaatccctcaaccaattttagaatatcgagaaagattcgatcggatttgatgaggaggatcggttttggcatcatatggacatgagacagtctttcggcggttgaagagggccggctatccagctccacttgtgagttgggtcaaagagagacaaccaagtagagggagagaggtagtgggctgggcggagactgaaaaggaaggggctgggctggtctaaaacctaagagtaaaatgtatagccgatccaaaaatattttttagcatgaagcttgttctgtaactccagaatggtaagatttttgtactattctgatattaaaggcctaatgctatcttttctataacgttgtggatgccctaatcattttgttttctgttgtcttggcctgatctttatctgttttctttcaagactaaatgttcccatcagttctatgcgtgtttttttttccgggctaattaagcctatgatccaataagatcaggacataggctagtacaaaatgggctatcagatccgatccaataggaacaacgggacagaggctcgagcagtgcccacgggaggcggcaccctgcgagggcgaggtactccctccgtatttttgatctatgatatagtctacgaaatactaatttgaccaaccatacatttctatctctactattataaaaattaaagatgtttttaccggtattttggtacgtcattcatgtttgaatcggttttaattttatgcttccattttaatctatatctctacttaaaaaaagaaatttctgtcgttgtagaaaagaaagaaaaaggtctgactaaaaaggtaaaaaaaaagtccgactcaacaagcgataaataaaaaagcttctgttgtaagtataaaaaaagaaaaaaaaacatctcatcgtaaaagaacaattgtccgactcccatgaaaaaggaaaaaaaaaagtctcccagtaaaaaaaagtccgcttggttttttaaggaaaaaaaaatatcccagtaaaaaaagtccgcttggtttttttggcactaggtttttttttctgatttttttgcacgctaaggcttttggttttttttcctggcctttttaatccgatctgttcaccgcgcgcatcccgggcgcctttggtttttttttgtcaatttttttcgccggttttttttctcctatgcgccttttgtttttctcatccggttttttaatctgatctgttcgccgcatgccttcccactttaacctagcgccacgtcgccgccatattgatcgtgcgttttctccaatttgattgaaaaatcgattcctcattcatctctcatcatttcctccatgattttccttcggctttaatttgctagatttaatctccgtttaacactttccaatgatgacggcgatcttctctggtcatttttatcctgagttttacgctctgattttgggggaaaacggaaagagtagattgagtggatcaaaaaccctcaatcaattctggctgatcgagaaagattcggccggatttgatgtagtctagggctgaaaagcaaggaaggccttctgccgaaaaccctggaaagtttttcattaacttttttaattataatctatagcgatcccaatgttaggatttttattaactttttcaattataatgtatatagtgatcccaatatttcttaatatatcactaaaaaacgtctttacccgttgcaacgcacgagcatgttttctagtaaaagtaaaatgttttatataaaaaggttgcatattatgatagtttatttaatgataaatctaataacatcaatttaattgattgatattttttatttttttttctattaatagtcaaagttaaaaatattaacttgtcactatgctaaaaatgcttataagtaacatattgttcccttcgcgaaactcaatcataacatttagctctaactagcccataaacgaaagcttgccctgctagtttatttgtttgtttttctttaaccattgtgatactaacattatgtctatttcatattgtctaacacgtttgacttttttttaagttaaacttattaagtttataaaaaaaatatactaacattttcaatacaaaacaaacatattatcaaaatatattcaatactaaatttaatggaactaatttggtgatgtaaatgttactaattattttcaataaactgggtcaaatataacataatttgatagaaaaaaagtccaatgacttataatatgaaacttagggagtaactacttggatacttgcaattggatgctttgttctactttaaagtaataatgagtaagaatgtcgctatcatctatccaatcatcctgcctttgagaaacctgcacattgtccccttgtctcacttgcagttctgctgatgactatcccttgaccaatacaatagcatccaacacagcaatgaaagctacaagaactattttcgctaccatccaagaagttactcacaatgatgataggaatgcggctaatttatccacatgttacgatgaacaaattgcaaccaacatccattaaacaaatcatagtcgattgaaagaaggcaaatgagaaataagaaccgcaataacgtgcatggtctctcttgcactaaatacctctccaatagggtcaagaagaaagtattctcgcaacacgcaagattgagagacatgcaccataagtatctcttgctattggtaccacctcctcttggacaaaatctggcctgaggggcaccaatgagggcatctagcaagatttccatagcactgtagggcgatgacacgagacaaaccgagagagtgaggatcattacccttggtaatggataagttaggggtcttatctctgccgagggtgtcggcaacatagtagaaggcaactggatggcaatgtgtgtggggtgggggggggagggggcaaaggagtaccttgcaacatgaaaaggaggggggcaaaccaaaaaaaggcatgatgcatatgttgcatttaaacactccataattgtctctaagatatatcacaaacattgtggtggtagagagaggcattacaatggccgaaggagtttgagtgggcaaactgcaaaaaagtactccctccgacctaaaatatagtaaactagcactggattaaacataacctaatactatgaatctgaacagaagctagtttatctaaattcgcagtactaggtcacatctaatatagtactagattgccatattttggaatggaggaagcatgatgctagctttgtattcaaatatgtatctgcatgattacctccaactcacatcatggttagtttagtgatatgtttgggattctaatttttcggcccatcaatagtatagaaatgcatcaccggtgatgtaggaggtagttaagaaatgcccatcaatatgtatcaaacatgttagctagacttcactcttttctctctttttatcatggggatgtaggaggctctcatgaggaaagacattatccagcaaaaaatagacatggaaatatatcaggaaaaagaaatggtgcaacactgtttctccctaacttgtgggtatcgacgaagcggaggcaaaaatatcggtacgttagttggtgggcggtttagggggtgttacatgcaaatagctatagtaaacacgagtatagctagcactacaaatctacaatgatttcacccataagtcaacattatcatatattaaaaataattaatatatgtttttcttatatggtaacacttgtttggttataatcaataaactcttgtttagttaacccattacatgcagtagccacgttaaatgcaaatggcccaaacacatttctgcaaatggttgcacggcctgcttgtctcgaggtatctgcaaaaattggtattttttcaagtgggggacacaaccgtgtgtgaaaatcaatgttcacgggaggccagttaagctaaccgcctaataaataaaaattccaaaaattgaaacactcattcccatccaccccagccccatcgttgttgtcgccacaattgttgttgccattgtcattgttattgcccccgtagttcgccatcgccgccgaagtttgctgccaccgtcgtcaaaggccccaccattcctgaggctgtcaccggcggatccgaccctcccggagccgggggcggtgcatccgcccttcctgaggccagacaacaccagatccgccaccacatggcttactgcttcagaggctgcccctcctgaggccagcggcactggattcgccaccattgaggttgccgtcgtcgcggccctagcctccgtcatcatggtagccctagtctccatcacccctccggccacgtgtagattcggcgcatccaacactacccctctccacccctttgctgtcagtgccagatccacgctcatggtggcaccagctcccattgggtgcccatctgccgcgtgcaccttctgcaggcctctagcggcgaaccgcccctcccattgctgctcactgactgctcctattgccagccgtcaaggagagccgatggaggagaggagaaaagacggcgaaggagaggaccgaagagatgtggaggagaggaaaaaacttaacgggtggaagaaaaggagatggatttgactatgtgtaaaaattcgtaggtgtgcatcttaagaaatccacatgtaaaaaatgaatttttcacatacggccgggtctatgctgggtactttttaaatctttatatatagtagaaaaaacgtccgtgcattacaacgggtaaatgctattttaatttattgttgtcataaggtttagctatggtaaaaatttactgtgggaattcacttggatattttctttagaatatcataagctataattaggagtctgtatttcatctcaagttggcatgtgagttttttttaaagagattttttataaaactccttttgtatttccaaaaacaaatgagcttaaaatcctactcaaacacatgtctgaatttgtaaaagcgaacgaacttaaaaaccgactcaaacacggatgacgtaccaaaataccggcaaaaacattttcaaaagcgaacacacttaaaacccgactcaaatacgaatctttacttccaaaagcgaacgaatttaaaaaccgactcatacacggataacgtaccaaataaccagcaaaaatatcttcgatttttataataggaaagatatattttttttcggggtgcataaaaaaggtgtgttcgtaaaagtcgtcgattatcatgttcgtacacacgacacatcgatcgatcgtcgacacttgtcgatgtgagcttttgctgctttttatacgtataataatcgtacatacagaacgctaggtcgatcgatctgaattttctcgtgtgatctgaattatattttctcgcgcgtgtgtggattgaatgtattaaacgacaggtcagtcaaaaagatatcaggttcgctttgtgtgttttctgcgactacgagaattttgagtacagtcgttctttggactgtacctatatatgcttaagattggatctttcgaaatcattgtacagtcgtacgtacgctaattagattattcgtttcgatcgagagatgtgagtagtttgactcatgattatatcgaataaaataacatgattttttttctgcatctaacataaataaagttggccaaaatcagttgccacttgccaaacaaatgcagttaaaattattagtactgtgttttctgtgactttagccacccaagaacagacgaattttttattttattttttgagaactcttttaatttaaaatttaaaaaataaaccctcttaaaacttatttccaagatctataatgaaaatatagctaactgtaaagttctagaactcgtcaaagctaactgtcatatgaagttcgctaacagctagccctatctcttaaaaggaaaagtgctggctatatatccagccagtcatccgagttcccacttctgctaacttcaaacttcttgaccgagatattttaatatttaccactatttgtcactttgaatggcactcacagtgtatggcatgttaaccctcatgtgtctatgatatgtgggtccaatagtaaattcttaattaccacttataatagtggcaaagacttagaccctatttgtttcagcttaagattattgtaatctagattattgagacagattactataagctggattataataagccgacgtagaataagttgttagctgtttgtttttctgaattattagctggttgttaggtgttagcaaaccaataatctaaaagaagtacctttagagtggataactagattatagtaatctagcttatagattgtaataatctatcataataaactatctgtttgtttaagcttactcctaataatctagattataataatcctaagctgaaacaaacaggggcttaaatatatgtcaactcctcgcatctataccctttatattgttgatacccactaataattattagaagttaaaactcaatatgtaagcatatcacattatcacccgctagtcattactattctaggatatcatctcatgcaaatatgacatatccttattttactcacctcattttgtcaaaacatgtcaatattcatcatttttataatatttaacttatatccatttatgtattccatagcaaagtacgaggtatcacttaacttagtttagttgatgttagtaacattcatcttcgtctgaatttgtatgaaaaagtatagaatttctaaagatgaggtgacctacaattattaatttaagtttatgtgaactacaatgattaatttctagaatttaaaattttcagtgtaaattaaagcccttaatactgtcggtttgaaaagagaatctgtagtgatataaggatttagattattacttattagtgtttgcatagtggtgacagtaagtcatttaaccgatcgagtgtgtttgttagtttcctattcagtatatatcaaacatcaacaaataaaaatatctttatttcagtatcaaacatcagtggataaaaatagcctaggcaatcaaatggtcccaaaacgaaacaaaacatgcctaatcagtcatacggtccccaagataaagacataaaaatgactgctccctccgattccaaaatatatgtcgttttagacataccctaccgctttcaataaatataagttgttttggaactttcgacgtagcactttttcatcatttccctcttttgtgctctcaccaaaataaacactacccctcgcacaaataaataacccatcttctataatataatataaacaaaagacaacaaagttatttgagcactttttctttattctcacgctcgtcaaaacaaacactaccccttgaacaaataagtaagtcatcttcttattgtaatactctcttcattttttaatatatgattttttaatatatgacgctgtaagcttttttagatatgtttgaccattcgttttattcaaaaattttatgtaattattttttttattgtggcttaatttatcatgaaatgtcctttaaacataacttaattttttttatttgctcaaaattttgaataagataaatggtcaaacttttatcaaaaaaaaattaatagcgacatatattagaaaatagaggtagtataatataaatagaagtcaataaagtcatgtgagcacttttctttactcttgcgagaaaaagtctaaaaacgacttatatatttggaaggaatcaaaggaaaatacctgttgatacgatgaacttgatggacacttggcccaaggcccccccgaccgggccggcccacgctgtccttgtcaaagcaggctgctttcatgtcctatacgatggatttggacatataccgattaacaaaagagagagagagagtattctattcttccgtgatgatcgagcacactccttttccaaacacgtgtgtatatatgtgtgccccgatcagacggtcttgcaagtgcccatgtgttccttcctttgtggcttcacatcgtcttcaacctgcttggttagcatttaaattacattattttctccgtctcaaaataagagtgtgggtgtgtttttcaaatttaagtaacacagctgtacttattttgaaaaagaggagtataaatttgagttaattttgctttttatactatttaaatttcggatcggctttagggttttctgccactttaatttattgctagctctacttaattttataagatgctatgagcataaggaaaaaaaattattcttaaaaacaagctccaaaattaaagaaaatcatcttggattataatcaagcgcgtgtatagacttaattaggctccatttgagtttgcacgataaagattgagtacacaacacgcaaaataagaatgccattagcatacgactagttgagttttaattattttaaactttaaaaaaatatttgataattttaaataacttctgcataaaatatttttacactaaatataagagggttactacaaaacaggatcccattgcaacgggatagacatattagctattctctttcacgagtatcacagggattaggttctagatattacagttaccgggtaacatgtatcttaggtatcgggtaccatgcaactggtaccacaacatgtatcaggtatcaggtactgtctccgttgtctaggttttctgaaatataaatgtaatgtttagtagctcaaaaatacactaccagaaaccaatgtgaaatcaatgtgaaatctgtatcttaacatggaaagaaaacggagctaattatcgcggagacgagtcgtcgattggagggtctttaattaggatccatacatccctctcacagtgggccaagcctagctggcttcggctgccttcctccaattgccttctgctgcgatttcatggagatttcataaataggccacattgagcatgtgtggttttactccaagacagattctctctctctctcatctctctctgtgagagataggcatgttgatttattattattattgttattatttccagtaaaaatctcccctgacagagacgcatcctccaccctacgccacctttgattatgttattaactgctaattaattagtgtgaattgcaaccacgagctatagctaattaagctaagggcacccacaatggttatctatagactctctacaagagatccatgtcagcatattttcctactttaaaggtattaaataaatagagagagcaaagctatctactaacttagagatagtctatagagaaaaacgaggcaatgcatgagagagctatagataccaatgtagacatactattaaggtggtttactattaatcgagtctattgctgagatgtacatattttatagagaacaccttactttaccattgcgggtgctctaagtatatatagctaggtcgtcaccgatcactacacatgctgattaatcaaagtcatgggaagctaattaatacgacgtgatcatgttgaagaaattaattaacagtactacttcacgagagcatcaactaattaaacgtgttgggagttaattatatttaattattgtctggaaatatattccagctcgtgccagtgatcatcaacttggggtttattgtagcaaaaatggaggttacaaccacttttaatttctttaatatatatatatatatatatatatatatatatatatatatatataattaatcatggccatcagggtcagagagcctacacattaattgtttttttttcttggttagaccatccttctcacgtatttaatcgtcaggctcaggcaagagatgatggcaaaaaggatacatatgtggccaattaagcaatagggggccaggtttgacctttgatgataattaattatgatggatgctgccgtagttgtgtgtggttttcagacacgcagcatatttcggttttaatttaattgattgattatcacattgatgccttctctcttctttttaatatatgtggttgtaaggacatcataatttggctgtcattgtaaaggggcctgcaggttctctacttggtttgattcccatcgtgatcaactctagtctccaaaatggaagaaagtactttttcctttgaacaataatgtgtacattttggttttagagacgacctttagcacttgagagaatattgtgggaaaacataattatccaacggctaaattaattaaatattaagtgtgaaaatagtcgttgtcttgctaattcaaaaaggcatttcaattaataatagtgaaaagttcctttcctatgtcctaattaagctttttgtgagttttgttcggtttgggataatccttggaggataatccaaactcaaaacctgagattagcaacaattcttgcaactggcaagcatagagaaataggggtgaagattctctatatgtgggtctcacccacctattgatccacgcatcaatgtttattatatcaatgtttataatgatagtgctattatgatagatgatgagaaatggatattaaaataactgttctgctacaattctgtggacacatattttttgaccggttacagtcgatttttcggctgttcgatcctatcaaaagggtcacgcagtacaaactaactaagtaaacataatggatcttatcacagtcgtccgttaagttcttcatgcagttaggagtataatccatagcattaagttggctaataattgaagattgagttttctttctttctactagaaaaaatacctgtgcgttgcaatgggtaaagactattttaatcatatttttgttaggttttttttatctaaaaagtatatgcgatttttattttgatagtattgatatctaatttggaaatcttattgagataatggccatatcctgtgcgttgttttcttatggtttggcaaaaattctgaagcaattaggagtccgactctcgtcttaagttaacatgcgagttttttaaaataattttttatacgactccttatatattttcaaaagtgaataaacttaaaaaccgacgcaaatataaacgatatatcaaagtatcagtggaaacatcttcaatttttataatagtagagataacgcttttgcttacttttctatttggttccaactaaaatctatatatagtgcaaggcttaaaatttatagtgtaaaatttgatttttttttccttttacaatgtaaagaacttattacaggattaacatctactcttgtacaacttctccctccatcctagaacctccatcctagaaggaggagtacaattctatagcgacgaccatataaaattcactcctataaaattactgggtgtctctatttaaaggtattggtatttctggtacttagtactctctccctcccaccttggtactctccttaagctagaattgttttttttgggaggggggacaaattttaaaaggtagaattacactgcttttgagacagattgagtagaacttatggcgtaaattatatgtttgaaaaaatgacttttttttacctggaaaaatgactgttttacaatgaaaaatatgggaacataaatctagctaatccatcaaaacaatatagtaaaaacttctattattgaaatcaggatttaaaaaaaattagatttttctacttgtgatttgaaaactacaaacactaataacataatgaatttaatagtctaaaccacaagaaactttgatcgtcggaaatcacatttccaactgcaaaaccccacatatcttggtttcagttttttgggggaaaaaataaaagctgatgtttatattcttgaatttagaaactttcaaataacaacaattaaaatttataagacaatacattggagttattgatttgagttgagcattaaatgttttttaaaatataatgagatacatttgatcccctctccaccaggagctagtaactatgtcaatttataacctaattgaaaaaaaatactttcaagtcaatatgcagtacaatttaaaattaaaatttattttttataacatgaaagatttttatttagttctttgttttccccaagtatatatatatagttctgtgaaacttgctagttcaatttttcaaatataaattttgcatactcaccaatattaattttaattcccacatatgttttgtaatatctggcagagacatctgctatatttagacactgacaggtgctacaaattttagccatttttgtcttttacatgtattgtcataatacaagggcagtggggtttctctcgtgcctgcacgtacggtagtagggcgaggagaactcctgtggctcttatagttcatctgcagtactgtaggtcgagcccataccggtcatgcatttctaagtatttaatttctctctttaattatgcaagacaacaacatgcaaccctgacaataagcccttcaaatactatatgacagacaagagacacagctcgctagctatgtggtgcatggatagataccaaaatgtcctacaagaggacaattatagaatctcaaatttttaaaacactttttatttttaattttaaaaataaatatttctaaaacttattttcaaagatcttaaccttttggcggcgtcagctcgaactgatgtatgctgccacgccgctagcgtaacagcgttatttggccacgtcggtctcggcggcgtggcaacgttattcggccatgcctctctcgtcggtgtgacaggataaatatggattgcgccccctgcagatggtgtatcagtgttgttttgctacgccagacggactggcgtggccaaaaggatcggataagattttggaaatatgttttgaaatgttttatttttgaaattaaaaatttaaaaagttcaaaaagaaaaaagaaaaatctagaatctccgcatatcatatttcattaagtgtgagtgcatttttcaaataattagaaagaaagactaacactagactatacgtttagattatcagggtgatgcccggctgtttgcgagtgcttctccgtcaacacccccactcactcttcccagttttagaaattttagatctattaggtggattagggtttgtcttctagattgtccatggacatgcaattgcctagagtattttagtttttctagcttactctttgttgatgggtactgcattcatggggtttttgataaatatctaaaatggtttgtatgtcgtgtgatttgccaatatgtttgttgatgatggcttcaaactagacgcgccttaccaacacaagggtaaatgtgtactttcatcactatttctccctctatttgcattagttataataaaaaaatgtgtttggtgtttagcagataattatcatgtttttgcggtgtcctttagcacatacacattatttgagtgttttgcggctaaaatcataaactttagatgtcctctgataaattttgccaggatgatatcctcgttcatatgcctttacgtgtcatagtttgtaagcattgtagctatgctcctcatctcacagctcttgcaacattccaatatggagagcacctttgttctcgattgaaaggtttcgatgtgttttttttacaaccaggttgtaattgtttgttgtatttaatactccctctgttatataaaaaaaagtacatttttcagtttttataaaacatttgacttttcatcttattgaaaaaaatattataattactacttttgttgttattagatgataaaatatgaatagtattttatttgtaactaatttttatttttttataaattttataataagaaggatggtcgaattggaaaagaaaccaaaaatgcgttgcttactctgtcccaaaatataagaagtttttagagttggacacggttattaagaaagtagatagaagtgaatggtggagggttgtgatcactactagaaaaactatttgtgtagccaaaactcgttttcgcaggcggccaaaccatccgcctgtatctaaacgactgtgaaaatcattaatttttttcagacggaccaagcatccgccagcgaaaatcatttacacaggcgaaaagtcaaatttcccaggagatagcagcacctcttgcaaaaatagtttcggcgccaaaaaaactttttcgccaccaaaccagcccgccctcacgtttcacccaaaaataaaaaattgttcatcgattcaacaaaatacaatcacaagcatccatttatcaacacaatctatacatgaacacaaatacattggatttaattccacatcaccgtcttgtattgcagcatcaatcaaaataaaaacaaataaagaaacacaaaaaaatcacagctccgtcgccgccggcctcctccctgccgccctctactgctccagaggggaggaccacgccacgaccgccaccggcctccacccatccctcctccgggccgatctgagtggaagagggagggatggaggggacgaccacaccagggaggggatatgccgctggacctcatcgtcggcgccgtccctcgtcgccgagcagctgcctccggccctccttgcctcgccgagccgcctccatcgacctccttgtcggcgccgacccttgtcaccgagcctcgccgagctgccaccggacctccccgccgaaccgccaccaccgccggccctccccgccgagccgccgccggatctgggagaggaggggtcgcggagaggggcagcgacgtggccggcggtagtcgtcgtagtggcgcagtagttgtcgtcgtcgtcgctcgtaggctccatcaccgatgccctccgccctgcgccgctgacggccccctccgcccgcgccgccgccgaacccctccgccggcaccctccacccgttcctccgccggccccctccgcccgcaccggccctccgcagtaggaaggaaggaaggggaggggagggaggagagaaggaaggaaggcaggggaggaaggaaggggatgggaaggggagagagagaagggtatagcggtggagagaagaggataaggatgactagaatttatttggataggtagcatttttgcaggcggaccacataaggtgcgtctgcgaaaatagcgcaggcgaactgtgaactttacctcgatttatatttttgtatgcggttatttgctgtaagagtcatgtctgctgcgaaaaaaagacccacacgtcaggaaaaatgctttttctagtagtggattggttgggaagagaatgtttatgaaaaagctgttatattttgggataaatcctaaagactaaaagttgttatattttaagatggatggagtacagtctgaatcaacctcgtttctcgaggaaaataaaagactgaagtggtacgtacagcgtcatgtcaatattaatttagctcatgatatcatttcttgcagcagcagttgaaccacgtcccgttgcctttactcctaaatgcaacattgcatatatgcatgtgacacatgtgtacatatatatatacctatcctagatcaggccgcccctagggggcggaaccctagcctccgccgccgcccctcctcctccctcctccatgcttcaaagccaccggagctcgtcgccggcaaagccgggcgacgcgttgggatggcggcagcggggccatcctcctcggctccacctcgccccggcgcgggcgtggcgacgatggcggcaggacggcgaggtcgtggcgacggggacagcgtggcgacggcgcggcggtggggcgctcggtgtcggctctccgcggctccagcgacgggcaacggcgtcgccagatctggactccccacttggccggggtgaccggcgatgggctcggtcaacgccagcgccgctccgcggacctggcaggggggtggctagcggcggcgatggtggcggatatggaggcgacgaagttggcgacgacggcagcgcactgcggcacgtgccgtgacgccggccctcgtcaagaacctcgccaccacgagggaggcgcgacaccctcgtcaatgctccggctgtgaacgccgtgcccttgacgccttcctccatgatgccaacgacccgcgcttcgcactgcacctccgatccgcgccaccccggtcagatatggacggctggcgtctggcggcgctggctagcgacggtgcggctggacggtggtggctggactgggggtgtccgtggcagtggcgatggcggtggtgatggtggctgacggtggcggctggcgacggtggtggctgtggcagtggcggtggcggctgtcgacgatggtacctatggcagcgatggttgaaggccatcatccggctgacggtgcgtcgtcgtcgacggcggtatgtggaggcggagaaggggtctagcggcggggaaggagtccgggtgcgggcgcgccgtcgacggcgggaacaattgtgggcggtggccttgaccgaatcgctgaagggataatgttgttgaccgacgacgatccttcttgtgcggattggtggtgtgggtttggacagggaatcgcgggcgaaagccttgccaagccatttggccggctgacaacggcgacgccgtttggcgtcgttcctctccttggaggcgttgttttagcatacccctttcctttccctactatattctccgggtgaaaaccttgcttcggttccgaacgagcggtggcggcgatccacgtcgcatcctccttgggggcaccgctttggagaaatctcttcgtgcaaggatattgtcattggtctatgcattggcttcgaatttcagtcctaggcctggacgaggccttctagctccacattttattttacttttctcagtttgggtcctctcttctcttgtttggtgtgttcaacttgtcttgaactacactctcttcttgagtggatctttgtaataattggctgtagttctttttgagcaaagaccggaatattatattccattatctaaaaaaaatatacctatcctagctatatattctatctctcgatgccaatgctctcatcaccccaaaacggcccaaaaccgcaccgatttcgcccccacgaaacaacatcatttgcacatacagaaactccggccaaaccacaaccagagagagacacacatatatacagagagaaaaaaacatagagatgtgtacatgtgtacacatgtaggggatcagagagagaaagaaaacattgataattatacaaagggataaaattaagaacatggtgggggatcattgaaatctgaacttggacagtgctgaggggcagggggacatgctggtacatgttgctttcagggtgtttgtttgcatttgcattgcattgcatgatagcaaatgtgcatgaatgcagtacgcgtatggtgaattaccctttcgagggttgcgtccatggggaggcatgtgaaagggcagcttggccactggccctgctgatctatctcatatatatatatatgtatatatatatatgtatatatatatatatatatgtatatatatacatatacatatatgtatatatatacatatacatatatgtatgtatgtatacatgtacatatatgtatgtatgtatgtatgtatgtatatatatgtatgtatgtatgtatgtatgtatgtatatatatgtatgtatgtatgtatgtatatatatgtatgtatgtatgtatgtatatatatatgtatgtatgtatgtatgtatatatatatgtatgtatgtatgtatgtatatatacatacatgtatgtatgtatatatacatacatgtatatatatatatatatacatacatgtatatatatatatatacatatatatatatatatgtagtaaatttgtttggtgcccgggcaccatcgttgaaattgagtatatacccaattcaaatgagtatgaatctttttcaattacttagatattaacattaaccactttactaactaactagttcaaagcaagtttgaactgaatttaaacttgtttttgttagattttgattctaggtatatagcatccatatatataattagttaggtatgtaatcatggattgtgaaataaaattaaatttgagttgttttgttgataggtataggtatgaatcgaattattaaactgggtatatactcataatttaaaaattttgagtgattttgtgcaatatataccatggtgcccgggcaccatggtgccccatatgagtgtcctatatatgtatgtatgtatgtatgtatgtatgtatgtatgtatgtatgtatgtatgtatgtatgtatgtatatatatctatctatatgtatatatatatatatatatatatatatatatatatatatatatatatatatatatgtgtgtgtgtgtgtgtgtgtgtgtgtgtgtgagaataatgctaganagtcttgtaacctaaaacggagggagtattgtggtttggggacaaatttcagactaagcgacaaattaagggacctaaattgaacttattccaaagaaaaaccgtagtaatacccaagcagtcccagcatactgtcattgcttttcacgagtccccaagcacgaacctagtctcctgcgtctacgtggtccatgactatagatggccataagggccgagacccgacggcctggcccacggcacgacgttttggcccgacccaagcacggcacagcctgacaggggtcgggcccatgccggtcccgccgacgggggtcggggcca

SEQ ID NO: 20661 - DNA, 23678 bp, Oryza sativa
aaatttactatataatatatacatatgtatatatatatatatagacacacacaaacgtgtcttgtgcaattgtgaatatgcatggtatgtgcccatatggccagttgggggctccggttttggaaggtggtttctgctctttcccctcctgaggttcgtgcccttgcccttatgcgcaaagccagtgccgttcctgttccgcgaccgcaactttgcgaggaaatgtgtgtagaatgggatcgcgagatggtcaagtacgattgagatactcttttttccgtgtgattgaggactagcgtgcataaaacttagtacgtaacaaattttacgtactaagttggtcagaatcttatatactggcataaattatgtgcttctattatacatatttaattaaatcctttttctgattgttttagatggaattatcattaaaatggtaggttcttagtaaggtcaatgtatctagctttaattaacaatagttatgttgagaggaacaaatatatgtggaaacttaagatgccgcttaagattaaaatctttatgtggtacttgcttaagggggttgtgttgtccaaggataatttggcgagacgaaattagaatggtagcttaaggtgttgcttttgtatgaaaaatgaaactattaaacatctcttcatagattgtcattatgcaaaattcatatggagagcagttcagttttcttttggttttaatcttccaactagtatatctcatatatttgatgggtggcttttgggggttgacaagaaaaagagtaaactgatactggttggagtttctgccatttgttgggctctatggttgagtaaaaatgatttggtttttaataaatcaccatctatttcatatatgcaggtaattttcaaggcaacgcactggctccggttttgggcacagctacaaaggtatgaggatgatggggagttcctaaaggttgcatgccgcaagttggagttgatagttatgcaattatttgctaattatggatggaggttcacgaatagacttcaataaatatgttctccttattttggcttggttttctctgtttttgtttggtgtgtcctatttagctgaactacgctcttttctgaattgttacaatgtaataattggctgtagctctttttgagtaaaggctgggatgttaaattccatcataaaaaaaaattacaatgatacctctcggtttctctcgagaactataattaattaattttactctgttttacaatcggattcgtatagatgctactcgggtttttataaaattcatcatctttgggttcagagtacacatgtttgcacgttctctcgtggagatgttgaaatgaacctcaaataattgagaatgtcccacattttcccttgaagttgaagaagctgatgtttttagctcagcttgacaaggcttgaaaagatccctgtttgacttactatagctagctataataacaaattacaaggtcaataactatatataagaaatatgtgccaatttaaccaagatgaatatgtatctcaagattgatccatcttaggtgccgagggtgtgcgcccatgcatccgaaaccagttaaccctcctttggaatgcatgatttttcaattggaattaaactgattgtcgtgaagaataaaatcctagcgttccaaactagccaggcttaaggaattctttacaaatacaaatccttttggtttgtaaccagctgttttttaagggaaaaatccaaattacaccccataactattgggtgaacgaattatctccctaagcctgaaaaccatatatctttcactttcaactatcaatgccggacaaattaccccctgacttgaactggagtagttttggccctacgtgacaatccactcaataattcttctattttaaaatcgatgggtcccacctatcagtctcatcctctctatctctttcccctcacctctatatatctctctctttcccaatcctctctctctcttctcttctcggctccactctctctctatcaccgagcagtcggccgagaggaagccgaggacaacagcggtggcgcggggacagcggaggcagctcgaagcggcgaagggagagccgaggacaatggcaacgggcagggacgagggaggcgcctcggagcggtggtggcgggtggggatgacggaggcaactcggagcagtggagggggagccgaggacagcgggagcactggtgctattgtgcgtgctcgccgcagtggcggccatgtggggtgtgctcaccgccgaagctcatgccagcctgctgttgcgcgccgccgctctccagtgtggagctcccgatgaacatcgccgacccatacatcgttcccggattccccagccggccatcgcctctagctatagtgatgctgcgtcgtgagccacgacgacacgaactgctgctgctccctcttgaggcacaactcttgccccccccccccaaaaaaaaaaaatcgccaccaccaccaccactgttgccgccggggctcctcatctacatttgacgtgcgcgcgagagagtgggtgtgagagggaaagagataaggaggagagagatatgtcaggtgcccatcagttttttttaaaaaataattgttgactgggctgccacataggattaaaaccacttgcaaagttgcttggggggttttcatccgatataatagttgaggatgaaagatttctgtttttttggtttatataagggggtaattcgtactcacccaataattcatgtctaatttggacttttcccttttttttaatcgatgagtacacacaaaatgtgtaacgcgtgtaagagaatcaaagattctgcaacatagagtatgaaaaagagtacatttggtgttcagctgctctactgctttatcaaacgtatagagcctgagagaggcgtaggtagggcacgaggagtgaaatgacaatagttgctggatggaaaagacaacagttgctgcctcaagtaaagtacccaaaaaaaaaaagaagaaaaaactatagctaggtcctcaacagctcaactcatggtactataggcttcataggttctgtttctaggattatatttattaattatttatatttaggatatggctgtagctatcacagtcctaacagtaggttgtcctgcctttgtgtaacctttttaaattgttgcattaaatatttgtttgtactcacagacaaattaatgcaaatttacttatatactaaaagtctaaaatatgtacccctccgtcccaaaagaaacccgtatccagattcgtagttagggtttgtatttttgggacggagtagtacaaatagtcacaaatcacatggttgtaaaataatcatggatcactccaaggctttccaagctatactagctaacaaatttaccatagaaaatatatatctgattctgcaattgatcatacctgtgtggttcagtgcatcttctcaccccgcgctttgctgcgggattaacggatgagtatatgttaaatattgtcgaataataaaagttgaaatgttgagaaaataatgtgaggaagatgatttgacacatacttatcaatctctataatataatatctattatctatctatctttatctattatatactaaaagtctattaatcttcctacaaacgctctcaagtaaccacgtggcttcctaaaaacactctcaagccgccacgtggcactctaataaattagataaaatcctacaaattctaagaaaaaagcaaaacatctagcccttgattttacttaaattggtggacccgatatttcaagccattagattaaatctattaaaaccattccttctaatatggatctgatccatatgatgaagaggaaggtacgatgtagtattcgtaaacagaaaaaaaaacaaaaaagatctttcctatccgatgcatatggatggagaggaacgtacatatgtactaccaaaaacacaaaaaaaattacatgtaacgtaacgtacgatcgtatgatcggaaattaaaaagataaagccgaaaaaactagattatacataaaaatccactgaactttcgagaaacgctcttaagccgccacgtgactcctacaaatgctacttagccatcacgtggcgctctaataaattagagaaatctaaaaaaattccgggaaaaaaaaggaaaacatcatataattgattttcacttaatatggtggacccatcattttatctcctattatctcacctcctcacttttttatccaaattttctagctagcataagccattaacacataattaattgagtattaactattttaaacttcaaaaatggattaatatgattttttaaagcaactttactatagaaaatttttgcaaaaatcgtaccgtttagtagtttgggaatcgtgcgcgtggaaaaagaatcaaacaaactccctttcatctccaaacgaacacactacataaacaataagaaatgctatattaactatctattatatcgtaaaaatcaaataaacttcctacaaatgctctcaatcactgcaacaaaaatctcatctagaggcacttttgtagaggcgttttacaaattgcttataagatcagaagtttcatagtgtagagacactttataaaggcactttaaaaattgcctaggaaacttttagtctagagacatttttagctcagtttattatagtttatcttgtagaggcattctttcggtactgtaaaatgcgcctgataggtataggcattttcttgagacattaaactatgtagagacactttttggaatgataatgtgtactaaaggactaaatataagtaaataaaggcataaatgttcaagtagtggcatggagttgagttggttagtgcattgaagataaaaatgatttgtccaagagatcattagttcaagacttgataaaagcaataaaactattttattctccttttttgactggttttatatgtttgtgatacaatttaatgtctcttaaaaatacctctaccatcttatagatattttataaaatgtctcttcgtttatagagacaactcaccataagacacttatgagatattttttaaaatgccttctaccatattgtaaagacatttgaaaagtgcgtctacagtactagaaaaatgtctccataaaatatttttcttgtagtgaacctgtcacatgcgtggtgtactacaaacactcctaagatgccatatggctctcaaataaattaaaaatcctaaaaattatgataaaaaaataaaccattgattttcctttaaataggtgaacctaataattataactattataataaatactttttaaaagattttttctatttatattgattcacatgcataactaattgcacatatatgagaagtaattaaagagagggctagcaggatggtaaaaaaccaatgaaagtttgttgagatttatttacgaaagagagatataaagacacttaattcaaaatagaaaatatattactttaattttaatttgttttgttagaactattttagaaataaactaatgcgcatgcccgtgcaaatgcgcgggctattttcctagttgtaaatgatgtgtcatacttgcatgtgatttaaaataggctcgaataatattttttttgacaccaggctagaatagtaattgctagtgagtgaagatgtggcatgcttccatgggattttaaatgggttagaataataatggctagtgggtgatgatgtggcatgcttgcatgttgagttttagcttctaataattgttagtaggtaccaactatatagaaagtatagatagattggcgcacacacacatggaaatgcaaaaagtttgacaatactaaatcaagtaattaatcctgcaataaactctaataactaaatctgttacatagactcagaaaaaaatgacaaaccctttgaaaaagaaatcaaaaaaggaaaatgataaaggtagaattcatagttgcattgtttctgtttctcctaacatactacagtatatatgttgcaatatttttttgtcttaagtttgattacattacgatgtgtgcaagtttttacttatatattgtgctatctgaggtggggatatacacgaacaaggaacaccctcatcactaacctacagtcatactctctcttcgtcccacaatatagtaaactaatactcgattagacataatatagtactacctccgacccaatttaaatacagttgtgggcttctgtatccgacgtttgaccgtctatcttatttaaaaaaaatatgaagaatttttttaaaaaaatagtcacatataaagtactattcatggtttatcactaaacaataaaaatactaatcattaaaattttttaaataaaacaaacgaccaaatgttggatataaacagtacaaaactatagtctttttggacggagatagtactacaaatttgtactaatatatttattttaggatggagtagcaccatagtattattattagcacaatacaagtcactctgtgatgtgatctcaaatattttactactagctctaatattataatatttactcatatataatttttaggcacgcatgaggtgatgagatcagaagaaaaatctttagacatgaggtgagatcagaatatattttaaagaaacaagtacatatgcgtgcgtggaagatgaagttgagctgcccaagccatgaatttaaaacagaaagatgccctgacaggcacctcctccctgcagctggaatctgatgatgcagtcaccgttggcactgaaattaatccaatccaatccaacccaatcaccattgtgcatgagagcctccccccataaggacagttgaagaatggcattaaaagaagaaagctgtagtagtactccctcagtgtcacaaaactctatttttcagtttttgaatataggagtacaacgtttggctcttcgtcttatttaaaaattttcttaatatttttattattattagatgataaaatataaataggattttatgcataactaatttttaaaataaaattatatattttttaaataagacgaatggccaaacattgggaaaaaaataaaaatgggaaaaaaataaaaatgaagttttgtgtaacggagagagtagtagtagctgctgatcaaggaaggacagctacctaatgatcagaaaacagaagggagactattcattcattcattcattgattcatgagcacaacacacctaaattttgggtcaagcaaaaaaaggtaaacaaattgttggggctctgcttcttagaaggtgacttttaatgatattgtttaattctttgttatgggacaaagatgaagtcatatcaaaagatttacccactggtgttgcaatttacttcctgtttagtagtccttgtgatggcattttgctctgtaggatctccacatcaataagcaatcatcagaagatatcgtggaaaatgacacgataaaaacaaaaaaacaacatgtatttaataactaaaataaattaccagaacatcacatctatctaaagcatggtaaaagatgtcctactccagttatcattgataggcaagcaccaaaaaacgaaggtttggatggagcactcctccccttctctccacatgctcagatgttctttcaagagttttttctagagaacatttgaaaacaactaatattaaatgtagaaaaagatgtttcaggaccatggaaatcttaatataaacttgattgatgaaatgtggaaaacaaacttgatctctttgtgttttatacatcttgcaaatatatttgaagattttgaatttatttgtagacttttatattagtatcattcattcatcaacgtctctacaactatacatttttatgaaatatacttgagaaagtttgcaaactttacttgagtttattccttgaaatgggttggcacggcactaatcttccttgtatatagtactccctccgtccaaaaaaattaaagctagaaggggatgtgacattttctagtataacgaatctgaataaagggctatccaaattcattgtactaggagatgtcacatccttgtctaggttatgttttttgggacagagagagtagtattagctttgaattctataaaatttgttccccagagtttcactccatggtcaatttgatatcatacatagtacttatggatcaatttgatgtctgaaagattttattattttgttcaacagtctcttccaagtttgtcgatcccgttacctgatatatataaggcatccacaatatgtatagaaaatttagatcttaaacaatgaaatatccattatgacttggtcacagagacattatgagggtggatcaagctcatgacacaaaaacaaacccacaaacttgacaattttaaaacaatatttttcagtatggttcttctatttttttttcaaactgtatggcctagcttaatacccatctgaggtatgaaaattgtgaaagatgtcactatacttttaccaacataactgaacagaaccttatgacctccttgggccatatacatttcatgatataaaagggtgccttacatagaagtttgttgtgaccgatatgtatttatttatgtaagtcaagtagtgtatgaataaattagaaacggtataaccatgttgtgcacacatgagaataaggtacacaacctcatgagtggcatgtctactggacttggtcaactttaaggtaataagacgcccttttctctatgtatctgattttcatgtgttattgtacacataagagtaaatatagacaatttcccatgaatcttgtcgtaaaggctagtagtttactatggtagcaagtccactatatggtgtttcaagtaggggtgggtgttcagtttttccggttttatcggttcggtttgttcggtttagtagaagattggtttcacataattactagccaaaattcctcccagaaaaattaaaaccgaacctttttaaaccgaattaattcggtgcggttctttcgggttcggtttataccgaacttgattttgaccactccatcagttcatcccactaccaacaataatcaggaatcaacaacatataaaaaagagtaaatttcataaaactacacatactttgactaaattatcacaaaactacagatttaaggtcatatatcccagaactacagatttagtaacaaatttaacacaaaactacatgtttaagactaattatcacaaaactacatatttaataataaaactatcacaaaactacatattttggggtttaaatcctttgcactaatgttatgttttgagttgtaaatgtccaagttttataattaattgatattaaacctatagtttgtgataactttgttattaaatttataattttatgatattttaccttaaatatgtagttttgtgataaaattagttttaaatctatagttttgtgatacatcatgttaaatctatagttttgtgataatttgatcgaagtatatgtagttttgtgaaatttactctataaaaagaagttccatcatccatcttaggggaaattaagagtattcgtgtacatgggcttaatcaccataggccattgaaccagaacaacagcaagatggcagcaagatgttagagaatcgaagactaaccaggaatccaagattagcacctgctggcctatgaaggaggaactgatcgatatctcggaattgactgccactgccatggttggctgcgccgtctggctggtcgtctgcgagggtcgaggagcctaggacgagctcactgggtggcgctagggttggataaagttatgctatctcttgggctagatggaaggggtgagttgggccttgtattaccttggactgtcccttcctcggttttctcggtggaccgatttattcttttgaagaaaccgacgcgatgactgaacaccgaactacgaaaaccgatggaaaaaccatagaccgcaataaccgccacttcggtgcggttcggttcggtgtccggttttcggtaatttcttgcccaaccctagtttcaagtaggccggaggaccatatttgaaccacaagacgaacttggagaacaaatttagataaaaatgaaacatcagggaccaaattgattccaaagcgaaacctagaggaccaaaataaaaacataagtaattaacagttaacagaaaataccaggtgctcgtacgagcctaaatgtaagtctttcttggctcatgcttctcacttgtctcccacatgttaaattttacaatggaacaccacaagaccaattctcaatccatggtactacgcaaatgaaagaaaaagaagtttatactgcatcgcaaaaaccccgatcatcgcccctaaggccctgttttaacttgattaagatacatactttttctcaatttccgttagcacgcttttcaaattatgcaaaaactttctataaaaaggttattttaaaatatcagttaaatcaaatttcgagcatataatagttaaaactcaattaatcacacgtttatgaatcacttaatcatattcatcatattcaaacgggacctaagggcctattcggcacagctctagctccagctccacttctcctaggcctggagctcagtcaaacagtttcagctcagctctatctaaaatggaaacagagctaggtggagcaatatcacaaaatgaattagagaggttgagctgggtttaggctgctccacaactctacttcaaaactcaactcctgaaattaaatttagaagttatagctctaccaaacaggcccgaaatcaaaacacaaaaggcgcggaaattaaagcggtttgtcaaaacgccccgatggagaaaccacaccacatcaaacacagagccttataatttgcccatgactgactaggccccttccccctccctcctcatcagcaaataaaacgtgcattaacaatgaccctcccaagatgagcagccgcaggcatggagagcctccaatggcgccctccctgccgaccttccccatatatgcacacactcacatatatatatacacacaaacacacaagcatatatgcatcccaacagtccatacctccatctccccccatgcttcgccttcgccttcgtcttcgtctacctcatcttcgaaattctaacaccaaaattaatttcattattagtaatatagtatattagagtagtagagggatcgagagagaggagaagcatgatttgcttcatggcgtggttcgtcgcggcttggagctgcctccttgtggtggtgatggtgagctcgatgaggcttagtaggtcagcttcatcgtcctgtggatcttcttgcggccatggcgggtgggggccgaggagctacccggtgatcgggtgcctggtggcgttctaccgcaaccggcggcggctgctggactggtacacggagatgctggcggcgtcgccgtcgcagacgatcgtcgttgaccggctgggcgcgcggcgcacggtggtgacggcgaacccggcgaacgtcgagcacatcctccgggcgaggttcgccaactaccccaaggggaagccgttcaccgacgtgctcggcgacctgctcggcatgggcatcttcaacgtcgacggcgagctctggcacgcccagcgcaagcttttaaccaccaattcttcgcgcgcgcccttccggaacttgaaggcaccctgcctcaaggccaaggcccggaaccgcttcttcccgcgctcgcggggctcccccgcgcggggtggtggacatgcaggacgtgctccggcggttcgcgttcgacgtcatctgccgggtctcgctcggcgttgacccgggatgcctcgacccggcattgccggcgccgaggctggccgcggcgttcgacacggcggcggggatcatcgcccggcgaggcgcggcgcccgtggccgccgtgtggaaggtgaagcgcgcgctcgacgccgggtcggagcggcggctgagggaggaggtcggggtgatccatgaggccgtgatggggctcatccggagccggaggaaggagcgcgcgctcctcctggtcaacggcaatggcgtcggcggcggcggcggcgcgaggagcgacctgctgtcgcggatgatcgaatgcgggtaccccgacgaggcgatccgcgacatggtgatcagcttcatcatggccggccgcgacaccacctcgtcggcgctcacctggttcttctggctcctcatgcgccaccgcggcgtcgaggcccaggtgctcgacgagatcgccgcgacgcgccgcgcccgcggcgcgggggaagaaggcggagacgacggcgagggcgaggggctcgacctcgacgactaccggaggatgcgcgtcctccacgcggcgctgtgcgagacgatgcggctgtacccgccggtggcgtgggactcgaagcatgcggcggcggacgacgtgctccccgacggcacggcggtggggcgcggcgaccgcgtcacctacttccagtacgggatggggaggatggaggccatctggggcgccgacgccgccgacttcagcctcgacaggtggctctccctcccgcgcggcggcggcgacggcgccgccgccgcctcgccagccgccgatgcgttcgccggcgtgtcgccgttcaagtacccggtgttccagggcgggccgaggacgtgcctcggcaaggagatggcgttcgtccagatgaagttcgtcgccagcgccgtgctccgccgtttcgagctccgccccgtcgacgagggccgcacgccggcgttcgtgccgctcatgacggctcacatggccggcggcctcaacgtgacggtgcggcggagaacgccggcgccggcgacgtcgacggcggccaatggcacaggaggggaattgaccagtagttaacccacgtgtaagtacaacaaaacaaaggattaattaattaattaattaattaatatactatacaactgtgctaagcttacactgcagcttacagctaagcactgtacacactctgtatcatatgaccatcatatgaaattaaagagatacacacaccatgtttcattgagatccttgatagatccaaggtaaacattgggtggtgcttttcaaggtatcttccctgctgcacaagcagcttcgtttgttgtgccgatccggccacgttttttttcttttcttttttttttcaattaaggatctgtttggtttgtttgcggctacggtttgccgcacatcaattaattgtcagacgagatgccgtagcttgttaaataagtgtctggttgatcactgtaactatgatccgaaaccatgttagcgacaccacaccggtcgtgctgctctacccctatgccaacttataaacccctttatgcggctctttcggcatttttacgcccgattcatcttattatcaaattgtactataatgcctcatctcgactcgcatacatatgcattgttatcacctgcttgaaactaatcacgaaaaacacatcatacacatactacattaactggaattcacacacattccggacggttaaatcatgaacggatagagatgttcaccgatttactgaaaatcaaagttggcatcaccttttaacgcacacaccccactacacacaccgttaggtgggatttgatgcttagctttttgctgcctgaaatattgcagtcagcctctctctgatgtgagctccatttccatcatcaatcaattggaaagttcatgggttcagtttctagttatatgaccactactagtactagcaatgcatatgcgtagacaaacaaacagacagacagacatgttgaatgataaaagagcatgtggggattttgctctaatggggttaggtgaagggatgagcccaagtgcaggtgcctatcacagttgcatagaggggaattaaacgttgtggaaatatatatatcaaagagagagagagagagaaaaaaataaagatttggtaaaactgagactagaatatatgcatatatttatgtgtgtgtatggagtatggttgaagtgaagaggaggagaaaaagaaattccatgtgttgccacaccacgtgctgaatatatatacacctgccccatcatatcctttgctttcacacttggaatattttttttttcttagctagatcgatggacaagagagagatgttaattacattattgttgtgtagtactaattatgctacttaattagaagggcaattaaagttgaaagccacatttgtgtgatgaatttggatgcagagttatgttatgtagtgttggttattgggatcttgtattttacaactagattttataattaatttaaggaagtttttactgctaagagtaagtttttctatataattgttttccgatgcatcggtactgtgccttcggacttcaattcagcttataatccgcagccaaaatgccttccagctagctatttggatgaaattaattacgtcactctttggagagttttcgagcctttgaatcttgacccagcatctatctatcgttgtcttgtgttgtttccatcacgatggataaagattgggcgtagaatattctaacttgttgatttcctaaaaaaaaaagttaaattcaatgaacttatacaaattttaaagacaaactaactataatgtcaatcaagaggcataccactaaatatacaaagaaagatgtacggtaattaaggtttgaagcaaagataataagccataatgtggaaaattaaaccacctccacaaccatttgtttgaacttgttttcatacttaattaatgaaagtaatatacgtggttttcatatttcatcaggaagttaactagacttttctctttttttttcctattgcagtctactgcaattgctgacacattaataattacttaatcgatctcttcttagcgtgtgaagagtgtaaaacattaattaatttttttaccaggaatactgctagggctttgcccagcaatttaaattttataggtaaaacagtagttaattattagaagtaataaaaataaccaaagtactaatttgttctcacagtttagagaggtcatattgggtaaaaaaaaatagcacccttaatcaattatatgtagatgaaaagaaaatgtgcgtaaacaatcaatcatattttagcacatggaagattgcttaattaattaatcccaagacacatacatgtatggtcagtatcactgtttggtggttggtagttttcgctgatgtgcatggcttgtctgctcgcttcttaattatgtaaatcctactcttaatttcctgtggaacttgggctgaataaataacgataatgaagtcaacttttgtagtttatcggatgcatgtacgtactttattagagcaattaataaagaacaaaacatgtttaagaaagaagtcgtgttgtcctgttcaaccaacattatactactatattatattaatcttccatgtgttttctttcgttattctgggcaaattaataatcctcaattattcatagactgatattaagcataataccaattgatgtcattaattcgactttttgttgtggatatatattaactccatgtaaacacaacagggagtaattaataattaattcagctagcaccacgtgagagctggactaatgggattctagaggtagactattacggccaataaatctttaaaataatgctaatagatatccttaattcgactattcttttgtggatatgttaaccccttctagaggaattccatctacattgacccttttctaatcgtaattgtaggaaatgaaaactcctaatgtcttcctttcgcggatctccctatatatacaccaccattttttcattagaaaggtttttttccttttacacctcccgccattatatgtattcctattatattaatatattcccttgtctcaaaatataagtgtttgggttggatagggcacatcctagtattatgtgtgtttcgtactactagaatgtgtcccatccaatccaaatctcttaatatattttaagacaaaggaagtattagaaaagacagcacagttactatgactccataggagagatttttagcgtgtagaaaatcttaacgtggttatttagtcctaattatatgaaaaagtcataatttagtcctagttcttttctaaatagttatccgaagtatatattagagtcctcttgttttcctactgcgtatttctttaaaatatttcactactggggaaagcctctttagtgttaggttgcaaactgggactccgaatccgggactaaatatgggtatctttagtctcggttaaaataatcgggactaaagagctctaccatctttagtcttggttggagttaccaactgggactaaaggttttattttttactgcttgcatattgatttcttcaaatcaaaaattcatagataagatcacatattaatatgcagatcaaatacatcacaaattctcaaaaacaaatacattgtagatcacagattcacgtaccatcatccattcatccaagaacacattaatcatcacttcacccatgagatatcatccatgaacacaatcatgaaaaacaaatcaaaatcataaatcataaacacaatcgcctcatgaacacaatcacaaatcatgagcagcaacatctactccgccaccaccacagccggccgccccttcgcctcatcctctccaccacttctcctcctcctcctcctcctcctcctcctcttcttcttctccctaccgtgcgccaccatctgcttgctgcggctgctggtacccgccgcggcccggatccggccggatccgcccgcagccgccaccgtcaccaccgccgccaaatccaccgcgggaggaaggcgagagggagaggtagagggggcaagcgccgccggtgagggaggcggagggggcggagggagaggaggagggttgggggaggaagaaaatggacattttgccactttgaaaacatggtttcgctagaatgccatcccgaaaacatgtttcgctaaaataccaatatggagcgtgccatcacagctactttgccattttctccattttcaccattttggatatcattttctctggaaagtggcttgaagagacgagaatgcccctccttctccgatgacgagttctcccgtcgagctgtccgacgatgccaccccgatcgacgacgcgttcgacaccgcccccacctcctcctccacgaagaacccgttcacctcctcctcctccaccgccgtcgccttccctttcctgaacccgtgccacgccggcatcatcccgccgcacgccaccaccgtggacacacacaccccaaatcctcctcctcctcctcctccggcaagcgcacggatcgacggatcagagcccagccaccacggcaagcgaaatcaatctcagcgagaaagagagagaggagagaggagagagagcacacggatcgtagtatgcctccaccaccggcagcgacaacgacgaggagcgggagatctgcaactgcgacggcttcgtctacaagcactgtcgggtcctccacccgcccgacctcgaggatgccgccgccgccgcttcatctacaagcgccgccgggtcctccacctcgacgacctcgtctctgcctcgttgagcatcccggccatcgacatcggcacgctggtgggggtgggggttcggcatcccggccgtcgccgtcgtcagcttcttcgtcggcggtggcgtggaggccgtgcatctcccttcgctgcggcatcgccatgcccacgtcaccgtcattgccaccgccgccatgcgttcgctcgccacctcctccatttcggccacgcggaccacctcgccgcgctcgtcctcttcctcccatgaactggatcgatcccctcttagccggtgagcaagggcaatttggtcccatcaagccacattccagcgaaaatgcaattgaaaatgcacaaaatggccaaaatggcaaagtggtggtgagtgcacgcttcatattggcattttagcgaaacgcgttttcggaatggcattctagcgaaaccgctttttgaaagtggctaaatgtccattttctcgtgggggatgtgagagggagggggcgggagagagcacgtgagagataggggggttccgcgtgtgcgcctcgaggagataaggatgagggatgggtggcgtgcggctgcatttttcttttcagtctttaagcccgatttaaaaagtcgtcaggtcatgtcaggctcccattatcattagtcctggttgctaacatggcctgacgattttttaaactgggactaaaaatgatctttagttctagttagtaacaaaagtttcgtgctgcttttttcaccatccagcaaagattagttttctagtagtgtttttattggacagagaagagagtttttttcatcttactctctttccttttatatgaaagaaacatgttgttggttttgcttatgtgagacggcaccaatcatcactcacaagttccaaaattctaactcatatatgatcgcaactaaagtgacatttgctctaattaatttctctctagaaagaaaatttaattatgacttgtcagcaaggaaacaaaaagtgagattaaggaaccgcacgttgtccataatctctctagcaccgggtatataaaatagtcacaacaaatgctggtcaaaatctaaaccacatggctgtaccttgggtggaataacaaattaaatttgcatctagggaagtgcctgttaaatatattgtaaactgctatgtgcaccgagcaacgcatgctacaagcaaaatggtggttaattaattgtggatgcatcatagctcaagttttgatttttgattactctttccacttaaaagattgaaaactagtttagagtacgcccaagttcgagctaaatactataaaaagccatttttcattgtaaatataagtatttttatgtcttattattatgtcgaagcggtctcttcgctactggagaacctatctttgttgggtcggccgaaaactacattagcttcggttccaataagaaccggaactaaaaatgtttcctagtcctggtttaaaacactaacagaactatgtgatctttagtttcggatggtgttacaaaccaggactaaagattatcttgacatttagtcccggttcatcccctggcctgtcaagggcctgtcaggaggccggagatctttagtcccagttggtaacacaaaccgggactaaagatccccactttagtcccagttggtaatattacacgggactaaatattatttagatctttaatcccggttgatgttaccaactgggactaaagattgccacctttttatacttcttcttcctcctccagcctgagccattgctataaattgaaggtgtaagggagggaggtgctgccaaaatttttggtgaaagtgttttagtgataatatacaaattgtagggatcgaaaaggttagcaactccattatctaatgatgtattcttggcatattacatttatagctttgtttctaaacaatattgtctccaacaaggtttatggtggaaaatgataagagagaaaatttgttatttcaaccgagactaaagatgagatctttagtcctagattttttttttgtcccggtttgcaatccgggactgtagggggttgcaaaccgggacaaataagggtttctccaccagtgcatcatatattgagttgagtttcaaggcgtttcttttcaacgaagatttgtttgatttgattttggtaggtcttcggtttaattgttaggagatatccatctcttgggcatatgttgaagataggcattgattctgagtgtgcgtgtgagtgtggtgtgtgcgcgtgaaagtttttctgtgtatttgaaagtggaataaattaaagttaaagaacatgtgtagcatcgtctggtgtgctgctccattatatatatcattaggccatcattgaatatatgctgatttatactgctcccttgccaaagaagacgaccttgactaggagctaagagaaaaaagagagaaccttagcattttctagtgcaaattaggttggtggctgtatgccctgtatgttgtatgtgacaagtttgatgagcccacgtttccatgtgtttctcccaattctaaatagagcactcgcgtgttgtgatggatctcggatacgtgcagatgaccttttttttcctcaaaatagtacaatatgatgcttatataaacatgcatatactcatctttataaaccccacacgcataccgtctctctataaaccccttcaaatgttagacctatataaaattgacgatatcactacagacgtatttcactgtctaaggaccaggtataccgcttagcactgaaagaaaaattaacctaaatgcatgagatacgttgagatacactcattttcgttgatgatttttttataaagacactattgagtgtcatttttagagaaatattgctctgatttctatcaagaaacatgcgctgagctattatcgtgtgactggagataccccatttagtgtaatttgttataaatatccttatgtatctgattttggggcaaaaatgtaaaaaaaaggagaaagaataaaaaaaaaatttctgcttatgcttgtcctttttcattcgactccgcctgagatatataacaaactgggtgaaagagcacaaattaaaggtaaaaatctatttgtgttctcacatggactagattttccttcgctttgctaactaacacgtttagcacatttggatccatcttgaggaagcttcctcgatcacacctacatccagttgcataataggttactgatagatgggaaaatatatggaaaacctgaaaactggcgtcgcattgtaaaaatcactcctggaaaagtgattttcgctgggtcggctgttttccacaatagtcccggttcttattttgatctttagatcatttttagtcctgttggtaatcctaattggtattaccaaccgagactaaaaatctatctttagtcccgattggagttaccaaccgggagtaaatatttctctcccatctctgatcggttaagtcccaaacgaaacttcctcctcacgagatacttagataagatcggatcatcccctctcttcctatccctcagatcttcttcctccttctcccctcccctctcctccccttcctcctcctcccctctcttcctcacatgcggcggcgtggcagcatgcgcagcgcgcggcggcggccggcggggccgcgcacggggcggtaggcgccggccgtggcgagcggcggcaggcggcggccatggaaggcagcagcgcgccagttctcctctccggttttttttataatttgtgattgagagatgtataatttttttttagaatttgtgatttattacatggatctgagatgtataatcgatctgtgatgcatttgatttgtgtgtaattttgtaagatttatgatgtatttgatttatgtgtaagtaatttaggatttgtatttgtgatgtgaatgatttgggatggtagtttgatttggggatttgggggttaatttgggtttatgcatggcacttgatttgggcatttggggttggatttgggtatatacatcccactcgaattgggagaaaataaaaagaaaatggactaaagatccctctctttagtcccggaaggaaacaccaaccgggactaaagatcgatctttactcccggttatttcacacgggactaaagatagcgatatttagtcttggattcgtagtcctggttggaaaacttggactacagggggttacaaactgggagtaaagatggtttctccaccagtgaataggcgtatgagatttgtccacgtcatcacgaacaaaaattatttttactcgtagttttactcatgacagtaaaacttttactcatggtgatgtggacaaatttcaaacatccatttttcgatctaacagtagtttttaggtttccataaaatatgtggttttcactccatattttttctagatagatagttaaggggttcttcttacaattttagtatcaattggttatctggattgaatccacagcttaggggggatattgaaattagtaatatgcccgtgctaaatgctactgtacaattctattgtctttaataattttaaattttcacattagcaaaaaaaatattttctataatctgtgcaccatgtcggcttaccttccttttttttttcctcactgtcagctcatctttaattttttttcttcctaatattttcctccctatctgttcggcttccattttttctccggtatatttaggctgttctctagatcgtgttctccaaaagaaacccctcccctccacgtacaaaacagaacaatgaatttacacattaattaagtataacctaaaaaacttacaaatagattaatatgattttaaagcaacttatatatatatatatatatatatatatatatatatattgttaaaaaaatgtcacgtataatagtttgggaaatgtagcggaaaatgagacactggaggttcggaacctcaataaacgaacacagccttactgatatttgacctcaaatgaaatttataaataaaacacaatacaatactacctcaggaaaaattaatagcatcgattttcattattcagatgtgccatcatctttcacaagtacaatacatagaaaattgagtatattcccgcaactataaagagtccaagaaaatataatttctgcatgttacgaatttggatgttctcttaggtcaattatattgatttttcatttggcttatgtatataaaaaaacttgatttttctatttgtcacacaaggcatacgtcggccactgctcactgagcacatagtatgagggcgtgaatattaagccaaataattagtagttgatatgaagcagatgtcaaatgaatagtttcaccatatataacaagatagcaattgttggttatctcgttaacgtcttctttcaagatctacatgatacgactactaaaaattatcgattataaaagtccatatttagatagacgtacgtgttaacatacagtcttgttatcaactcggtgcaaactgacgtatgtagcacaagatggtatctagaagataatcacacaatatttcacctgaaaggtgatgacttgctatctaaaataagaggatgttggtgagtaaaataagaggatgttggtgaacctgcctttgctcatggtcatgaacgtttttataaacgatattcctagtgctcttccctgtggggtatacttgtttctttggcttcgccaaaattcttaatggttgccttcccacacctcttgacaatgtgacagacaactgaccatgtgaaaacacgggatttagaagatagatcgcaacatttggaatggtttatccttatgattaattaatgacc

SEQ ID NO: 20662 - DNA, 8129 bp, Oryza sativa
caaaaatttaaaaaaaaattaagataatctttcgtcatagagcacttgagcttgcaagaagaaatatttaatgtctatgctattattgagataaaatgaataaaaaaggcgttgaatacgagaaagatcgatttgataatcctaaagatctgattatagtatagggtataaatatcttatttctgatcttctgtgtatgcttgtctttttgcacaaattaaaaggtaaaaatctatttgtgatttcatatggactagattttccttcgctttgctaactaacacatttagcacatttcaatccatcttgaggaagcttcgtcgatcacacttacatccagttgcataataggttactggtgatagatgggaaaatatatggaaaaatcctagaaactaacgttggattgaatagatggacatcgtaaattcgtccacgtcatcacgagtaaaaaattttctcgtagcacaagtaaaaaatattctcataggtttactcataaatagaaattttattggaagtaaaatttttactcatgatgatgtggacgaatttcagacatctatttttcgatccagcggtagtttctagatttccactaaatatgtggtttgtactacatattttcatattttcatagtttaagaggtatttcttacaattttactatcaatgggttatgtggattgaatccacagcttagggggcattattgaaataatggtttttatttacttcctaacacgccataatcacaaaattaatgttgtaaggcataatattcgaaggcccaaaatcatggcccatcctcgtgaataggcgggcctctgaaacaaagccgagtgcccatgtgcatttcacatctaaccattttgtctccaaatcatcatacggacctcctttttttttgccacttatcacaaaaaaaacgtccaaattggttcggtgtcgtccttatcaaccgagaaatttgtatatatatatatgccatcggaaaaaaaaaaaaacgttgatttcactaccataccatgtcaaatgtgcttcgataaatattctcgatcaaacgaagggtattcgctagcttgaaatgccattgtggacagtattgcccttgtatatgcttcctcccccctccaacgctagctggccattggtcgccgtcggctccggctgcagctcacgccgcccaccaccatctccgatgaacacccactgcacgggctccagcaacaaggctagctagctagctacctcacaacttcagccaggagctaggacaggaagaagcaagccggccagctgggccagaagcttctgcccgtacctcgtcctcgtcctgtaggctgtacctccacgggtgcctcgtcgtcgcctcagccgcggacaagctcgatcgggaacgaattctcctaccccacatattatgtgtgtgtgtgtgtgtgtgtgtgtgtgtgtgtgtatatatatatatatatatatatatatatatatatatatgcaggggcgaagtcaggatttttatatcagggatgctaagattttccgcaccattcatcgccgtggcatgatgatgaagttaagactgtgttacctcgacgtggttggaaactaatccctctaactcgcaaaacggagcgactcattagcgtataattaattatcagctattttttataaaagggattaatatgatttttttaaagcaactttcatattaaaatattttacaaaaaaacacaccgtttaaccgttcgaaaaacatgcacgcgaaaaacgagggaggtgaattgggaaagggagagaattgaataacacagcctaatggcatcggcagtgaataatgcccactagtgccataaggtgggcccacgtgggtccagtctttgtagctaataacactttctataatgtgtacagagcaaaggaggcattacggttggtcccatctaaataaaaaatcgtaccacttttcaactgccacttcctttcttctccccctcctcctcctcctcatctgatccctttcttctctcacatcctgggcggtggactcacgggcgaggtcggctccggtggtggcggcgctcgtgggcgtggctggatccggcggcgggactcggcactcacgggcatggtggatccggcaacagcagcgacgcccgtgggaggaagaggaggttcgcggcggcgcccacgggtggaggcggaggtagcgaccgcgggaggaggcagcggcagcggcgcccacaccaatggctcatgggcagaactcccctcgcgggagaaggcgacggcggcgtcgacctgcgcgaggaggctgtggcagcggctcgcacgaatccacgacagtggctgcggactgcgatggcgctatccagtagtcctccggtggcatgggagactgtggctattgtgggcggatctctggcggtctcctcccgtgggtgccctcctctcattcccggtggcacggcaagcaatagattggttagagagagagaaagaggagagttccatgagagagaaataatgagtttgttattccatatgggcaggcattagctataaggatgactcatccaaacaatacctatgatgactacttgcacaatgtgtaaagactacttgataagcttaataccctctatattttcacattgtagatgccttaagaggtttccggtttgtaagagctattttatatagaaaaattattacatgtataaaaatatattacaagtttccggcgacgggcctccgcttcactccggcaaaagctaacctttaaagatgtgcaaatgaatttggatcacaactcaacaaactccaccttgagacaaattccttcttgtagtataaatcaatccttcaccctgaacacaacaaagaaaaaacacttccggcgtcaaatagcctcttgggctaaaccactatacaaactaagcttgagcaaagctcaaccttagcaacaggaactggctttgtcatcatatcagcaggattatcttgagtgcttatcttatacctttagcttaccttgtgcgactacatcacgaacattgttgtcgaatgacaactgcgtcacgtcgaagaacgtggaatttggatggaaaagtagtattgacttaataaaatttttgggatcccccgttacatggccctagggggctatttatagccctagtacaagctgttaccctctagggtttattgtttaccggggatattacataaatgcccttatgatgatgacatttacaggggtaaccaattcctattgagttgtggacctcctaacagtcttcttgggccggaccatgaaagtggcgaacaacctttttgggccaggctcgtgcgaagctgcatccctgcttcgccatgggcttggccattgtaccccgccaatgggcttcaccatgggctatgctttgccatgggttccgccttcatgcttcgccacgggctctgccttcatccaaacttggcttctggccgctttgccgttccttaatagtttcggcaggtttgggcaaaggccctcgcgacatgcctccaacgaacataatggtacttgatatcaatgtgctttttcctctcatggaacatctgatctttagtgaggtatatggactttgactgtcacaaaacaggttaatgcaagaatcaactccacaaagctcagcaaacaatcctttcagccaaactgattccttacatgcttcagcaataaccatgtattttgcttcagtggtagactgggcaacaacaggctgcaatgttgccttccaactcacagcacaactaccaatagtaaacacattacctgtgagtgatcttcgcttatccaaatcagaaagaaaatttgaatccacatagccaacaagtcccttatcagtcctgccaaacttcaagcaagccgctgtcgtgcctccaaggtacctgaaaatccactaaacagccttccagtgttctttgctaggatgagccatgtatctactaaccaaactcatagcatgagataaatctggacgagagcaaaccatagcatacatcaaagaaccaacagcactagaatatggaacccttggcatgtattctacctccttatcagtactagcacattataaggctgataatttaaaataaggtgcaataggggtactaacaggctttgcatcatgcatgttgaaaggttgaagaactttcttaatgtaactttgctaactaagaaataacaaaccagaatatcgggttctagtaatttccatacctaaaattttgttcacagtgccaagatctttcaattcaaattcattattcaactgtttttccaaggaagtaattttttcctggtttttgacagcaatcagcatatcttcaacatatgccagtaagtatataggtgatccattaataaatttaatgtacacccaggtatcatattcagacttcttaaagccatgtgccaacataaatgaatcaacccttttataccattaacgagaaaactgtttcaaaccatataaggatattttcaaattgcaaatataatcctccttaccaggtactatgaaccctcttggctggtctatgtatatctgctccgcaagctctccatgtaaaaattatgtcttcatatctaactgctcaagctcaagatcatgcatagtaacaatactgaagaatgtacaaattgaattatgctttacaactggagagaacacattactataatcacactagtaatctaactgaagccttttgctactaaccttgccttaaaccttggaggctcactgagagataaaccctcctttctcttgaagatccatttgcaacggacagtcttcttctgttttggcaagcgcacaagctcccatgtgtcattcttctcgagagattgcatctcctcctgcatagttgagatccacttttcacgatcaccagaaacaacagcttcagtgtatgcagccggctcatgagtgttcttcacctgcttagcacaattaaaagcataataaaccatatcacattcctcaatcagacggactagagctccacaactcctctttgttctacgatgtgcaataggttgatcttgtggctgcaaaacagggggtgagtgctgaacagtatcatgaacatcattatcaacaatttcagtttcctgatcatccatgtgctccacctgcacgttgacatattgctgctcctcattagaaccacctggtataacatctgtggacaagctatcattaaacataacatattcattgaaaacaacactcctactcaagaaagtccttttattttcaggattccataacttatatccttttactcttgaaccagtggcggatccagcatgggggtggcggggtctcgaacccccactactggcgtgaagactatgagagaccccacgaagaccccactaaaattttttaccatatgtaaatgggagggtggactgtaactttatttaatttgctcagaccccactgctatttatttctagatccgccactgttttgaaccataaccaagaaacaaacacttaatagttttaggctctaattttccattatcaacatgagcataagcagtggcagccaaaaactctcaactgtgaataatcagcaggcataccagaccatactttaatgggagttttcttattaagtgggatagaaggcaacctgttgatcaagtagcaggcggtgttagcagcctctgcccaaaaacacttgttcatatgagcattggacagcatacaacgagccatcgagatgatggttctattcatgcactcggccacaccattctgttgcggagtgtacgggatggtgtgatgcctaacgatgccttctttcctgcagtaatcatcaaaagcatccgaacagaattcaccaccattgtcaatgcgaagtacttttacctccttttcaatttgtctttttatcataactttccactctttaaaagcaacaaaagtatcatctttatttttcaggaaataagtccacacttttctagagtaatcatcgataatggtaagcatataacgagcacaaccattagagggcttacgagaaggcccccacaaatcagcatgcaaataatcaagtatacctttggtgcgatgaacagaggtattgaattttaccctcttgtccttaccaaaaacacagtgctcacataacttcatgttaccctgagtacaaccatccagcaggttcctcttcatcaattttgccataccaaattcactcatatgtccaagacgcatatgccataggttagtattactaggttcattattagaaacaatagcagcggaaacagaaccatgtaatgtacttcctctaaggacatataactttgcagaattcagatcacctatcatataaacaagagaaccttttgatacctttacaactccacctgaaccggagtatttgtatccttctgcatcaagtctggtaagagagatgagatttctcgccatccctagtatgtgtctcacaactttcatcatgtgtgccatgccatcatgcgtccacgatctaacgcgggttgtcatctcccatatgcacgacatctccattctgcacagatgttggtatttcttaacgatattactagaaatataattcccagcaatggcgcagaaaaacttctggtatattgcggttacagagttcatccgcaagcgcacggatataccattgtagcatttcacccgagagtattccaagggtatcatatttgtttaatcccgtgggaagattataatagagataatcgtactaaagtctaatttatatattacttgttacaaccaaagtctaagcaggggttaatgtaattcagagagtatagtgacactaagcagaagcattcatacactcattcacaattatataagttaagtggaaaaaatatagaaatatcttattcctatacttcatattatacatacatattatacatacatcctagttatagcattacttagctaataccctctttccgatgccctcctggtgcttcgagaagccacccctgattgccgagtttcttacgacaatccgtcatgaacatccaaccggggctaaatacggaggagtaccctccccaggaaattaacttaggactatatacacgcgcggaggaatacccgtactaagctgtcaccatcagcggcccacctcgcttccatagcatataaccctaaataatgatatccagtaatctaaacaccacgcttaaattaccaaatactactctaatatcatcgtcatgacatagagtcatcgtaaatacgatcattatacccacaccattgcatctcccagataagctagcatcgtaataaatataacttggacatataataaagttggtattcatatactcggaaagtaatataataccgcaatagtataaaaaagaatattctaataaaagtacaagtcttacaaaagaagtaaaagctactagagccatacccgaattcttcctaagactccgaggactgaagattctatttctatttctattccactatactctacagactatactaaacttaagaaatgtatgaagcttcttgcttgaggtgtgtggagaaatggagagagtgaagtccttttatagcctcctaatgacggttgtgatagttggaatggtcggaaatgccttccaaccgtcattgggatgcaatcctggatgtacacgccgaactctggcctcaacgatggagatgggggttcggccgaaccatgggctggtccaatctagcccatttttggccggcggccacctggacttcttctctttgcagacttgtgaattttggcccaattgatcatgtcatttatgagttcttgtcccatttattgataagtctgattctcgacatcgttcgattgattgatcgcctgttttgatgtcgattcccctccattttatgtttattccctgcaagaggttagtaatcctagtgctagtggaatatttattattaaacataaatatgcattgcaagcattactagttctcctttattttggtagtattgacggtcaaaactaatcgctaacgaccgtcaacaacagacttgtaag

SEQ ID NO: 20663 - DNA, 32382 bp, Oryza sativa
  unsure (1)..(32382): unsure at all n locations
gtccacagataaatccgcaagcgcacggaataccgctgtagcacttcactttcgggtgaccccaaaaggatatcaaactcagggaacgtgtgtaatttagctaaggctaagactatccaaggacaacaactgatgataggcaggctagagaggtcttcctatgtgttttatttacctaagctaagttgaaggtaatttcctatctgttgcttcgggcaccgacccctgctggtctgccagcgtggttccggctatagctctatgatgtatccgtacgtggaggattactgggatgagattcagggctgtcaccacctgccgcctacctctgacaaatccgtgggatacacaacaaacaaaggtaatctctaacctagacaccacatctaagttattaattactactctaatatttgctcaggaacttccttttctatccagagtcctagaactagagcgcttagtacgaatactaaacaatgaactcgcaaagatggaaatatatcttactcagaccaaataattaaataacataagaaaggatcacgaatgcttacttaacagaagaagttctccgaacccggagcagagtgtaccgacagctccggtactcctccagaattcctcctaggaagctacactcgtcgaggtagaagtcggatgagcgccaaacttccgggcactcctctagagcttcccctcactctataccttattctagtgtacaaaagatacaatagagcctcttgtaattcatctcaaaattgtgtgttggaaatgagagtgagctcctccttttataggcaggtatgacggttacagcctatgcgaaatgaccaaactaccccggaaccgccatcaggaagtaatcagggccgtccacatcaaatttggcgatcaacggccaccaaaagggttcggccgaaccagggacggctccgttcggcccgttttttgtcgtggacactaattttgaggccctcagcccattggcatgatagttgggcccatttggagttgtttaattgacttacgaggcctccaatccgtgtaaatgtgtcctgaatgcgcggaggtgcagtttgtcacttgacggatgtgttttcttctcaaaatacctgcatacacatatttcaccaacactagtggaaatcattagtaataatacctaccactaagttggataccatgttttatttcattatatgtaggtattgacggtcagatattatgatttaaggaccgtcaacaacaaccagcaaaaacgacaagacagtcccttgaatcagagttttcagcacccgagacgacagaggccttatcatcggatttccttttctccttattctgcagtttccaatattcttcagtgaagtgatttttcttcttgcagtacttacagaacttcttacctctggactttgaatgacctctatcattctagctcttgtcatgatcgttgatgtcgttgtaggttctctgctcagatctgcctctgacctgcaatgcttcgcccttggaggacaacacgtcagactgaaccatacctttcatcttttccctattctagagtgccttataaacttccgaaagggttagttcgtcacggcttaatagtatggtgtcacagaaatttgcatataaactaggcagttagcataacaggagaagacctaaatcttcatcatcaaactgtacctccatcgacactaggttggcaacaatctccttgaagaccgatatgtggttcaacactaaaccagtcttctgtaacttctgcgagaataacttcatcttcatatgcctcttactggttagatccttagatccatagatcgattctagtttgagccaaagttctacagcagttcgttcctgcaacacttcttgcaaaatatcattacatagatgaagttgaatcaacgacagaaccttacaatctttccgcttcttctcagcggtccattcatccttcttcttcttcccgaagctttccagcgcctcatcaagatccgaagattgcaccagaacagcccgcatcttaacttgccacagtgagaatcttgtcttgtagtctagcagcggtagatcatacttcatcgatgccatcgcggaaccctcgtgtgagaacaagctctgataccacttgttaggaaacgataggcaaataaacgataaagaaaatagatcaatcacagaagacatgagatttaacgtggaaaaccctcccaaagcaggagagaaaaaatcacgggcgccagctagaaaaatatcttcactatatcggggtgaggttacaacaccgaacagcggcttacaagaagtatatatgaaggtgaaaccctccggcgacaggcctccacttcgctccggcagaagctggcctttatatatgtgaaaatgaatttggatcacaactcaacaggaacgagttctggacttctagtcgcctcgtcgacgatgagctaaaggtttagggcaaggcgtattacaaatgggttgatggagagcaggttggcaggggacgctggctcgtcctatgcttgacggaggacggcggcggtggcggccaagatggcgggctccgtcatcggacgatgacatgacatagagaggaatggtcaacgttggaaggaagtggaagaaggaagatgaagatccaagggcaataccatccacgatgcattctagcaagaacaccctccgttcaaccatggcacttatcgaagcattttagcgaagccagctatttttgatggcacatataccgatttctccctctcaaccccctccatgaagacttaaatagttaattcatttgtaataaatcaattccattactgtaatgggcagtgtagcctagtggttgcagtgacttgagtagcacctaaaagtcttgagttcaaatctccataggagcgaatttcagattgggttcctaatttaaaaaggttgcatatatccagttgatgctctctatcacaccatcttagagcaattgctataaaacctttaaactgtcatataaactcaaacaataagttagaggagagagaagaaatcgtccattatgtaaagggtaatctcaatatataaacttcaaaaaagatcaaagaagaaggtcaataaattgaaagataaagaaggaaaaaaatattgtagtctattaggacaaattgcttgagataatatgttgagcgtgtcacttcttaattaactaatgagtagataatgtggataaaactggagatgattatattacctttacttataaaacttgttcttagatgtcagcggtgagcctattttgtatcttggcacatatcagtagcatcacttttaccatctttacataatccctctcaaaagattcaccgtttaccacatgctatgcataaattaaaactgcacattaaaaataatctgttatatatgcgtggcattttaatgaattttatcaatggactgataacagaaaacacagtcaaatctcgtaaattttggaccattcgattgatttaagatttacgcacactccctagccctaacctcctccctcttatccttcttcctccctctacgccgccaatgcacgacgataagcacacactccctgcctccagttccaccgccagctgccgaaacgcacaaacagtgtcatttggcccctccccccttcctccttcccctttcctccctcttctcctcctcaagccgacggcagcgaggtactcccatccttagcgtctttcttgtctccgacgagggtcatcggatctatcacctacaaccgttatcaacatcagtccaccacctgctaccaaccttgtggctttggcgccgacacctgtgcctcgcagtccgcctactccgccgcccatcatcaagccaccacctctcactcttgtgtccatctaaaggctgcgaactcattctctttccttcttcttactccgatctctaaatcaggaccataatccatatgtccttcttcggaattcatggtgtctccggagaagaagaagagaaggttgttggagttgaacaacaagggtttagagtacgagccacaaaactcatccgatggcctaaattaggtaatatttggggatggattttttatcgacgaaaggttagtaattccgttccataaacatccatacgaataaattaaatggaaatcattccctaaatctttcatatagcattaacttctcttttctcttttagacgcaaaatttaaaagcttattaatttctaccacgattttattataaataaaaggagactccaactctcgaaggaacgaaccgagaaaagaaaacagaagaaaatcaaagaagcggtgcgagaaaggggaaagaaaggaggtgcctttccatggcggccgagggttccagccgcggcggcggcggcggccggaaagcctcctggctggggatgtcatcggagggcggcgcggccaagttcctgtctggcttgccgtcgcgcggcaatttctcctcgatctccgcctcttccactctcgtacgcacgcccaatccctgactaaaacccccacaaatgatgtactttttttttaatttcccttttggcgttaagattcttgttgaattctcatggagggtgagaggattctgagatgaatttctttggctgtgatctgcgcagggacggctcagggtttacgtctgcgagcatgacacggatcctccaggtcagtgggagattcattcttgtagagattttgtagtagtatgttgtatttctgttaactcagaatgctctattttgctagcttcttaggttaatgttttaggtttttcatgtagtggttgtggtgttttgtgtgtggaggcttcgattgatggaagctgtctttaggattccacatgtccactagtatctgtggaattataagttttttttcttcttcttcttctagggtttatgtgtattttgcttaaagtataaagtaagaccgatgagtaaattctagtgtgctaaaaagcatgtacaagtgttgttttcactgtttaggatttgtagcgaatctagtgtcgctgtttatttaaaatgtctgcactgagaatctgtgctgagttgctcttagattatgtgcctcaatgcacatgaattttagtttttcatcgcgattcgttgcactcaatgcagccagtatgacggaactttggttcttggagttaatgcagtttcttcctttcaattttcattcattcttttaggttaagttttggtaatttagttgtaaatctatgatgtttctagatgaaactacagtagatggttactgcagaaatttcttccatagaaaaggttcttcccaagggactgttgtttctgttatacgctgtaccaatgcacaatttaggctttaatgttagaaatcatggaaactcgcagctctcctattttactgtgttctagtcaaaacaaattgaaatggagctctgcattggcagtaggtcttggggataggagttggtggagaatatcaccttgatgggttgttcacctgcttcatatgttttgtggctataatttgctggcagattcattaaaattttaactgtttaatctcttttctgtttagagggacaagttatagagaccgatacaacaaatattttgatcagacatctccagctaaagaaaaaggagatggatgccaaagaagccaaagaggccagagatgcaggttctaggaaccaaggggaaaccgtcaaatggaaaaggtaaatctgccaaattgacagtatgtgttttacagtgccttattggagcatccttttattactaattaccatgtcattccatgctttatatggactatggtactcttgttacatatgagatggctcatcccttgcagcacctttctattttattttgttctggtctttttctatgggtattatgtgattcattaatttttaggccatgtatttaggggtcttacaacacccatttgatcttgaagcataatgtaacatccttgccctaattcctgggtaagtcccatggagtttcagtaaattaatgagcagttgctgttggaattttctgtgcttaagaaagctctatggattttcagcataccatgctttattagtttagttggtttgcatacctacatcagttttcaactaagtctcatatttgtgaatgactttaccattggtggagattgaagagcagctgccataattattgaatggccaaatttgacctgtctagcttgaccctacttcaatgtcatgtgcttattggggcaaagcaggctctactattctacatttctagtcatatatgaaaaaaaaagtttatgagaccgagccttttcccctgacaatttcacttgttttttacattatcggcattgactggatttgaattccataaatctgattagttcacaatgatttgaatccactgccaaaagtaatatatggatttatgaacatggtatttttcttaccgggttacatatgattggtgagcatggcactaaattaggttgttcagcctttatggtgtaaccatacaatttggctccattctgggtactaataattctttatggaatgttttaggcctagcaccctttaaaaataccaagtctaaactcaaattgtttaaaaggaaaagatgagataagttcctattaacagtaagtagaagcacctgccactttttttgctttttccttttgatcctttttgcagagaatttctcattttgttattataggatgaattgtaacttggttttattcatttctgatgtatatacaaatatgtagttttatttggaatctgtcatgtcaacttggtgcacaaacaatactagattacaagtttacaaataaaggaagagttacagctggtgaattgttgctcttcactaacaagttatatgttgcgttccacgacttagaaagctggctagattaggttaatccatatagtgtttaatttagttgaattataacattcttttccacagcctcttgaattatcctgaaaaaccacacaaagagcaaattatccaaactcttctagtatatctattgatctttttttttctcgaaaaattaggaggaataggcttcatttcattaagaagaaaaggaaatttacacaggagagagacggaaaggatcctccacccaaacacgtcacacaaaagacaccaccaaaaccccaactaagcacctggggcagcgacctcacaaccccaactattttgtcattttgaataaattagtatcttgtacatttgtgagaagaacaacagatagtttttatttcttcagactctttacaggattaaatcctttagtagaaggtacccactgtagtggcctacagaacaaccaagtacaaccctaaccatagaggtaatctcccaccatgcagcattaaatttgtgggaacctaataaaacatatgaatcttccatttatccattacagatcatgttactgtttgtatcatgctatgaagccacatacgctctaagcgatttattggagtgatttctttcatacttctatgctgatgctgacgaatagcttggccattcagtgatccaggattaatacaagttctttgagtcatacctacttgtcctcatgaaactgtttatccttcttggttgcttattacttgggatgatatgactatataaattaggtctggaagtaattatttttccttttttgtttgactagagttgctcccagaagtttggatggccaaagttcatctaaaaggcccaatttgggtagctcctctgggctgtcttctgctggtaagttgtctaagtcttagtcttccagtttgggcatttgtgaatgtctgatacttgataatgctaagatacgaatagagagaataatgtttcatttattagcattttgttgaggaaaaagagagtaaaggatatcaattgtccagatttacctgaagccaaccctttttcaagcttctacccaaaaagaaaaaagaaagaaagtggccagagttaccaccttccattgaactttttgccacgactgtccacttgaatttgtgaagtgcccaaccaggaggaatgctttgccttgttctaggtttacaactttacatgttaagccactaactgtctttctattttaaggccccattcgtttgcttagtttggaggagcttttcagccgctgtgaaatgagaaagcccattagcacatgattaattaagtattaactattataaacttgaaaaatggatttatttgattttttttaaaaaaaacttttctataaaaagtttttgcaaaaacgcgccatttaatagtttgaaaagtgtgctgatggaaaacaaggaagttgtagtttggagttgaagaaaagaactaggcctgaatttaagatcagtaatatgctgatgcatgctttagcattttaaaagaagacaaaaacatgctcatgtacagtctcacaattcctctaataactttaataaactttcatattgcagaagaagcggcacctggattttcaggtcacacactacagacattcacagttgagaggttgcgtgcacttctgcgacagaggggcctcatgaccaaagggaaaaaggcaagcaaaaattgtcgttccaagttctcttgttctaaatttaagtggtttcatgcttttaattctgtcactagtatatgtatttgaatttttgcttgtagaatttattttagtagaatgtcagctaagatgactggatatccaccatttttgaacgtttggatgattctgtagtgtctgacacctgatattttcctaggaagcttagtcagttacagaatttgtccattagtattccaaatgttccctcaggacttattcgttgcatggcatatggtaggattttgtttctgtagaagcttcataattttttagtgaaagttggctttacaaaataaaatgaatgggatgataagagcctgagctttgtcatgtaactgcagtattgtgcctaatagattattttaagaacaaaatatagaagttcccaaaacaagcttcttctagagatgcttgtgttgtcagtaggctgttgcttttttctttcagtggcagcacattatggtttttgttatatttacactatttgattttgacgccgcggatgtggcattagtaaatgaactttcttgttaataaagcattgacagtcttcattcttgcacattagaaaataacacaggttcccaaataagaattattttcacataattgatcatgcctacattgatctacctaggccataatcttttgtgcgagaagtgtattcaattttttgatgtatgatgtccttcctactgcaggatgaactcatcgctcgcttaagagaatcacaggactgatctagagaaagctcgtgccgtactctctttgtaggttgatgcaatgtgtttcctgatttgctatgtcaagctttgctgggagcagaatgagaaccaggcttcatctgttggctggatgttaaggctctaggagatgtagtcacttaggttgggccttgagaacttgtgcctaattgcattagcttgtcagaaatttgggcttgggttccctgtttgttagggcttatccagtgctttacttggtacatgtagaaggctaatctggcagtgtttgtaaccttttgtctcatactggaggagttaccatgctaatttacaagcatagttaaaagctaatcgtaccatgtttgaccaattgagctatggaagaaagcataggcgtgaacccagctcagaagtgaatggcagatagcaaaaaagaatagacttggaaatggaaaaaaatggagcgaaacaaaggcatacaaattggaaaatcagcaggaaatgtgctgattactcgtatcgattgctttaggaaatatcgcagtcttgagcagataaattctttttgtgtgtgtgatctcaattctacattgtgttaggtgcaaacatcacttctttaacctaatgcttcctgcaactcgagctgttttattgggtggctgcaaattgcaatttactacttatcttccaacttataaccctgaaagaacagcattacagaggccgtttcttcctatgtttgcccctttatttcttactccctccgtttcacaatgtaagtcattctagtatttttcacattcatatatatctatctagattcattaatatcaatattaatgtataaaatgctagaatgacttaaattgtgaaacgaaggaagtatatgctttgctgcgagatagaaaatatggaatacaaaggagcctcagtaaactagaagcaaacagtcgtagagatggtccaaagtagtggtcatctgtcaattgtcatcctctcagattttaaattttttgctgatattttttttctgattttaaatgtcatctgtcaattgtcatcacttataaatcttttgctgattatctttgtattttttttctatgacaaatggaatagtttcaacagaaaattagacaaaagacagtacaatcaaaataaaattgggttttactccctctatcccatattaagttcacttttggttactctcattcttagtaatcatcgcattggagtttgtgaaagtagggaataattaaattgaatgtaaataaagtggggaataattatattgggatttgataaagtaggagcattatagtttttttagtgtttgtattggtatgtgtgagaccgttgaaagatttaacttattttaggatggagatagttgtaattataaactagcatattatcagtaaatgacagttgggaataaaaggtctccttctcattggtggtgtatagcttttggcattatcaactgttcaactccctgtcagtcaagtttgtcacctttttcttttgtgttgtgattattgattacttcttatatttgttatctatgcaaacgctttgcacaaacataaagctgtcgcagttggcagaatttgtgttgcttctgtgccattgaaagtttcaatcaattggcatcactgactgctacactgcagctgtgcctgttcttttccatctagatctagaatcggatgtaacatatcctaatattataaatcggtactgtgttggttttttatgggacgaagggagtacacttcttctagctactaaatgctatatttttcttaaaaaactttctacatatatatttcttaaagttattattttaaatctattttttaactttataatagttaatttatccgtttgtacctctcgaatcattcatctattaagtattccattcaggtcaaaagaagacacccaattgaagtaaaacatgctagctgtatgatactttataatatatgattagtgtattttgcttgcacttggatgaaggggctattttaatattagaaaagattttgactaatggtgatgcctcgcttcgggatctgctcaaaatatgtttcttcttttctaaaaattgtttttgggtacagatggaccgtgtaaacagatcattgttcaaagccaactaggaaagtaaaataaaaattatttacatgttaaatgttaatgactagttattgactgctgatgaatgtgtttaacatgtgaattatatattatgaaaatatttctaataataaatctaaaagtataaattttatgatgttaaactatataagtttatagaaatctatggtcaaagattaaaatgttacttaaaataaaaacaatcctaggacgataaataatttgaaattgagggagtaccgtgtttgtactctagcagtctgactctaaataattgaacaatcatgaaaacttggccagagaacacaatccaataagtaaggcccccaagcttaaagttattccaaataatgtatttgactgatcattctgcaagcagtgaatatatatatatatatatatatatatatatatatatatatatatatatatatatatatatatatatatatatatatatatatatatatatatataatttatttggtgctctatggtgcccgggctacatgattcaaattgggtatatactcaattcaaatgagtatgaaatttttaaaatgtttaggtattaacattaactactttactaactagttcaaaacaagtttaaactaaatttaaacttgtttttgttagattttgattctaggtatataggatccaatcatataattagttgggtatgtaatcatggattgtgaaataaagttaaatttgagttgctttgtttataggtataggtatgaatcgaattcttataactaggtatatactcataatttaaaaattttgaaaaatttaagtgaatttttatattttataccatggtgccccatatgggtgtcctatatatatatatatacatacgtatatacgtatatatacgtatatacgtatatatatacgtatatatatacatacgtatatatatatacgtatatatatatatacatatatacgtatatacgtatatatatatatatatatatgaatctcaagtgaagtcaatataagaaaacgttttagaatcaaaaaaagaagaagaaagagaacatttcaatctgcaaatttccctcatgtacttcttgtttcatgcattccattccatgttactccgtgaacattcctgatcatccacactatttggcattgtatttctctgaccaatgagatcacgacaagtgcaaacgaaaaaactggcaacatctacatatgctctcccatgtgcattttgcagttttgactgcatcaatccatccaacacaaacactgtatatcttcatcttgtgctgccatttcagtttttaggagtggtcagtcctggcttgcacagaaaaaaaaaaagaccgtgaatggtcactcacaggtggggcctagccgcctaggaccaaccagccaaacccagcatgaggaaagccacccatagatatagcagcctacttacacataaaaataagagcttatcataataagataagacatgactagaaattacatattcagcttaccagggtttaagtcctaaattcagtgcatttttcaaaagaaattctaacactttccgaacgaatcatctgaaacaacacacctagaactctcatctcgagctggctcaagcgagattataaaccctcattggtactcgtgagcttccatttcagtttttaggagtggtcagtccttacttgcacaggcgaaaaaaaaaaaggccgtgaacagtcactcacaggtggggcctaggacgatccagccaaacccagcgggagaaaagccacccatacacatagcaacctacttacacataataaaaataagagcttatcataataaatgagccattggttatatattcagcttatcaggatttaagtcctaaatttgatgtatttttccaaagaaattgtaacacattccgaacgaaccatccgaaacacctgaaactctcatctcgaactggctggggacgtccaaaatccacgagactcgagtgagatctcgcgacatcataaaccctcgttggtaacagtttacaccaatttcaagacacgtgtataaaaatatgcacgcggctactacgaacacggtgcgtgtgtggttgtgtgcgcgcatcgtccagagcgaaaagtacactccataagagaggctggggattagatgataaaactaaaactaaacaaacagagcctgggctgtgggccattcttggcttggatttactgggacagttcttccctcttggatcaggaattcaggaggggggagcttttggccgaattgatcaggaaagatgcagctagctgcagcgttgcggtggaccaccggacggccggcgacgaccactggttgtaccgtggtgatggcatgtcccggcatgggaagctagcaagtgcatttcagatttttccaggtcccctcttctgctctgttgctgttgctgtgtgtgtctctttgttttttatgcttgttcatcggtcatatgctaagggaatcttttaatgctgatatatgaaggcccatgtgttagagcaggtacaatagcaggctataagcaagttataaacatattttaaagagataaaagaagatagagaagagcagcgggctacaaatctgtagccaactgcagcacggactccaaaacgtaatgcgtgtatgacaggtaggaccagacattaataatatagtaagaactattgtatgaattggctatagataaattggagctagtagttggctatactattaaacttgctcttagtgtgggtgggtgggggtggaagagtcttctctccaagagtaggactatcatttttctagtggttttatagggtttttcaccaatttattttttcacaggtttggaaaatagtttttcgaaatctaaaataggcctgagattcaagatactggggataaatacgaacttcattataggttgctaagtgtcatgtgtaagatagtatatgagttggcagctcttaaccacaacataccatgttgtaagctaaaagatttgtaaaataagattgttcacttttttttttagtattatcaaaagttcacacttagtaagataaatcaggtggctatacaggcatagatgccacacgaacaaacggagaaaatttttgtacattatatctagaagaggcagtatgttgaaccacatcttggattaggagggtggccggctgactcagcaccaacgagtgccattgttcgttgctgtaaaccgctcttacatgcttcatcttggtttgatggccacacaaatttaaatgaagatcaggaactgaattttctctttttatatataggtgtatgatgttgtgccctgttttatctaatcaaaagggtttcttaccactatgaaaataaactgtaaggcgcgttgatatcactatcaaatgcacaacctttttttttttaagagtgaacttcataaaactataactattttatcaaaaatgttagtatgctgaaaatttagctagacattttagagaacgacaataatattatataattttattagaaaacctcatctttacatctttgacaagtttgggtctcctgaaatacttgtgctcttgcatcccacatgacatacacacataggagataaaattatagttttgtaataaaatcgtccactattgttgcggttttgtaaaatacattcccttaaaattatagcaaaatgatagttttcatcaaacaattatagttttgtaaagtccacttttttaaaaaaaataatgaaactagtacatgcatgtacatctcgatggccagtgcattgtgtagtatttcctttaggctgataatccttgtcgttttagacaaggctattgttaaactaaaaaactttgactataaataatatttaaaacatttgtcaaataaatatggctcccatatgtataggttgatcttaaaaagtgctctgataaaattatatacttattgatatttctatatatatatatatatatatatatagagtaataaaaaatagttatcaaatttattttttgaaactgtgtccttgttcaaaatgataagtattattagtccggagggagtagtataatccaaagttcaaactctttgtttaatatagaaaaaccttgctttttgactgacatatttcctccgtcctaaaataaatcatcttatagagtttattttttttcaaaataaatcaacttctacattcttacctaccattggtctacaaataaaaaaaattatttcttcaataccctttacctatccacccatgcattaatataagtttataattaattaggggtatttgggtcgtccattttgggaatttaggtttgaagtatttgtggaacagatcgagggattatttctctagctatctagctaattaattcgattcattcatcagtttttatttgtagggataaatgagccatgtctgtactgcaaactgcaaacatggataggtcaaaaaccaaagtccacaatagctgaacagctagcggcgacaaggttccttccacgctatgaataagggtgctgcatggcacggcaaaatcatagtacgtaagtacatgctacatgcatattatgattgcatgctggttcacatgcggccattatatactccctccatcacataatataaaggattttaagttttttttacattgtttgatcagtcatattattcaaaaagattgtgcaaatataaaaaaacgaacagttgtgcttaaaatactttggataataaagtaagtcaaaaaaataataataattccaaaattttttgaataagacgagtggtcaaacagtgtaagcaaaaactcaaaaccccttatattatgagacggacggagtatatccgagtgcaacaagaaaccatcatatgattttttttttctttgtgatgaacaagcctgccattttttagtgctactttatttggggacaaaaaggttccaagaaaaaaaaaacatgagggaactaattatacctagtaccccaacaaagttagggtatgtctaataatagagtcaattatcattatttatcaataagttatgaaaaaaaaccatcgcatcgttatttacctttatttctaaaaaatgaaaactattttttaattagcacccgctggctaggcaatagcaatatgtaggaaggtccttatattgtttttccataaagctcctagcatattacagatttatggtaagtttatcgtacatgttggggtttttttttatagagacaattagacaaacatttatatgttatactcaaccatcattttttcattgtgtttcaactgtttctaagattaatttgaaggttaccactcatctagtttgccagagtactccaaattctttcgaacagtgagcctatatcttgcaaaaaaaaaaaaaaaaaaaggaaaagaaaagaggaccgctctttccagccttggacacataggatccacagtaaagtttgcaccccgagatggatctagcatagaggcggcgggatctcgagcttccactactggcgtgaggatagatgattgatgctattaacttcttgatacacatttgatcattcatcttattaaaaattacataactattagtatttattttgtcgtgatttgatttatcattaaagaaaatatgacttacattttcaataaaaaaattaaataaaacgaaatgaccaacttatgtaaagaaatcaacagtatcatctatcaaaacagctattgcattttggtcatcaatatgcaactgggcattacttaggacatcaatgcaagcgaagagaaacacagctagctgccgtgctcattgcgtagtagagtaactggccattgcattttggagtaaatggattgatataattttttaaagtaattctcatataaaaaattttgtaaaaaagcattatttaataattttaaaagaaaaacaatgaaggtgaattggaaaagaaggacatgaagacacggaccattatatcttgtctcacttgagcattgcagccattgtgtagctagcaattagctaggcattcaggtttgcagagtaacaatcatggctttgatttgacacggcatctgtgtcatgcgtgcttttcttttaggactgacggatacgtgtacggtatacgcttccatcaccacaactggctacagctactactgtgtatcctacgcgtgtgccctggacagacagacacaaggcatgtctcggataggagtggctgcgttcgttgccttgaacttgagggaaattttctcgcactccaaacaaaagaaactcgttatcatatgattaattaagtattatttttttattttatattaaatttatttttagcttctttcatttatcttaaaataaatttatttttttaattattgaagaacttttaaaattacagaataattatatttggagtagataaagtgatcaatagttgtattgggatttgattaaaataggggtgttctagtctttttctgcaaatacactatccgtcctaaaatataataatttttagccctcagaatttatcccaaaatattaacaacttttccaccaacattctcttcccaaccaatcacaaccctccaccattcacttttcctatctacctccacactccccatccaatcacaaccctctaccattcacttctacctattttcttaataatcatgtccaactctaaaactttttatattctgggacagagggagtagaacataccatttcgtctctccacattttatactcgtattgcttatatactacttgcagagagtaacttttgccggtctttcaattgatgttcttgaattaatacacggatcactctggtttaacactttcaggagaagaatatgtgtccatctcaggaggtcgtgcccatgttaggatggcaatttccctattggaggtaggtacccgcccctacggggacgggacggggctggttttccacccgtgggttggctggggacaggacccaccacatttgcgggggcggggccggataaagggttccacccaccccgctagtccctgtggggcccgaaattaagataaggccaaccagaaaagcccatctagtccatgtaggggatgataaacgcgaattcccaatcccatccagcccccacacatgcaaacgcgagcactcgttcagacttctaaacgcatgaaggttgtggtgttgactcacagaggtcctcttctcgcgattgcggcgcagcgccagatgcctgcacctcctcgcatcgccggcatcttgctcctcctcgcgctgctgatatctcactactcctcgcgtcgccgacatcccgctcctcttcgcatcaccggcctctcccttctccttgcatcgccggcctctccttcctcctcatgacgccggccaccttttcctctttgtgccacatacctcctcgctcctcttgttcctctcccaactaagtcttcttcttccaatggcagagtgagtgacctccagcggggccccggtcaggtagcattttgtacccaagttcctcttcggggctggggccgggggatgaagtcaagggttagggcagggtcgttcttgcccaacccagccccgaccgaccccattgccattcctaacccacatacggctcatctatgtattgtccttgccaaccgagcatacgcatggcctcaggcgcatgggacctctgctagtgggcctcgagaagctcaacctcctcgttgtggcaggtctcaccctccctcaccccctccccctacggcacagatccactagcagcagcgatggatgggcggatccggcggcccctactcctcctgcatggatccaacgacttcgagcgaccatgacgacaacgacagtagcctcaagtgtgatggtggtggatcctgacgtgatggcggtggcggcttcaacacgatgacgatgcaggggatccggtgtgatggtggctagggttttgggttttggatctatggtttttgtatttttgggttttgcaatttttattttttttgtcaaaattatttttgtagattgatggcttaagcacctgcctacgaaaattgtattttttttcgcaagcagttgcgccaaccacatgcaaaaatattgattttcgtaggcatcttggtgtaggcgggtcacctagccgcttgcgaaaattggttttgaccgtattaaaaatttgattcctatagtagtgtatgttcagcactctcctttcacgacctctattctcttgtttttcacgtgtacgctttgcgaactactaaatagtgtgtaaaactttctataaaaaagttattaaaatatcttattaatctttttttatgtttttagctaatacttaaataattatatggagtatcggatgtgacacattttagtactacaagtctgaacagactctaaacatattaaaacatattaagacatgtcatatccgatcaaagtaaatattttgagacagatagagtattatttatctattgtgcatatatgtattttatatatgttgatgacttagcaagttgacaacatttgtgtccacttgtatagaaacgctatacatgcataattaaggctgtgtgtttggtatttcggtttggtaactacttgaggcacataaaataacttactattgttagtgtataattaattaatattagcctaaaatataaaaaaagattaatataatacataaataatttctctatagaaaattcttgaacacgcttagtagttcgcgaagcatgtgtatataaaaaaaaggagaaagtagatgttgataaaggagagtgccaaacatctcgcctacgtgtccaatgacatggacgcctagtttatttcaatttgatcgtgcataatactccttccgtttttaaatatttgatgccacttttttgaacatatttgaccattcgttttattcaaaaaagttaagtaattattaattcttttcatatcatttgattcattattaaatatactttcatgtatatatatagttttacttatttcacaaaaaaattttaataatacgaacggtcaaacatatgctaaaaagttaacggtgtcaaacatttagaaacggagggagtatgcgtgaaggtcaatctactctcggagtctgattcttttactgtatactagcattgtcttttatttatatttatagtaatcattatattccgaaacctacatacgtattttatatggtagcgatgcgttttgtatttacataataattctagttctttatcggagcaaatatgttggctccagtttttattatagaaactttgtaaattgagcctttcccatacaaaagcttaatttatacacgtgaactttttcgaaataagatttcaggccacgcgagcatcgacgtgtgtgattccgattcagcttcaaactttcggtgtcaaaaaattgtatataaaacctttgcagaaagtttgcatatatatagaaacatagattgcgcatacacacaaaccacgctaaacacgtcctcacgcaaaaaaaaaaaaaaaaaaaaaaaaaaaaaaaaaaaaaaaaaccctcaaaaagaccgcaaaaaaaaaaaaacacgtcctcacgcgccacgtctgtcgtctgagcaaaggttgacacattaaaactgctccatgtacattaattcattcccaggagaaaaagaaaagagatactccctccgtattttaatgtatgacaccgttgacttttcgaccaatatttaaccatttgttttgttcaaaaaattttttgccaatatgaaaatatttatgtcatgcttaaagaatatttgatgacaaatcaagtcataataaaataaatgataattacataatttttttaataagacgaatggtcaaacgttggacaaaaagtcaacggcgtcatatatatatatatatatatataagttttttagctaatacagtaaattatcacttaatctattatataaggaaggagtacatcctaatgtgcccagctctcagcattcaaacacgaaataaataaataaaactagtcatgacaaatataaagctgccagatataagccatagcttacgctagatccataccaaaaataaataaataaataaatactcctatactccttacaaacatttataaaaaggtatggaaaaaaaatagagagagacaagagctgtgtttgtgttgtgtcgtgattggtatttaaatccggaaaaagggtccagccactacggttttattagttggcgacaagccaaagccgcaaccccacccccgacgtgctcctccgccaccgccgccgccgccgacgacgaccgccgcctccgccgcgatctctcgcctctcctccctccctcctctgtacgcagtgtactactacggtactaccgccgccgtagtactcgctggtgttggggagcggccggatggaggcggcggctgcggctgctgcggcggcggaggcgcaccaccacaatctacacgggtgcctggccgtcagggcgccggtgccgaggtgctcgctcggcggcggcggcgggggcggcgcggcggcgatgggtggatcttctggtgaggctgtctctctctcctgctgcgctcgcttgtgcttccattggcttctctggttttttttttcttcggttgcgatgtagtagtacgacggttttggtcgcctcccacctgcttgtgttattgctcgtgtggctggcggttgaagtttcttagtttttttttctctctctctctctctctccgaatttttgttttttttactcagaaaagggaagtttgatgcattctaggatttctttttgggggggtttatttgtgcgtcagaattatggggagatttttgcactgttccaaatgttgtgctgttcttgctggagtttttttttttttttttttggttttaccttccattggtgctgttcttaatctactgtgctcttgaacatttttctttcgattgatgctgctttcctctgctcctgccgttctaatccagcattcttgtattttatactatacattttcctttccctttttcacctttcttagaacagttccagtatctttggccactggtgtattctgatgatttttgtgatgttacctgaatatctcaaatttttatttttttttcttttttcattgacaagaagtcagcactggagacccaagaggaatcttataaaaaaaaaagctcttggtattgtcaatttctgtacttgctaccgcttttggccacatacttgtttgtggtggctcagagagaaagttgtggcataatcacacaaggaagctaatcattgatcttgtccttttatccttttgggtgccacattgctaacttctgtgcaattactcttcttttcggtattcgctagatttcaggcgcccgaaaatgtttcgatagtatctaataatgtcgcgcttcattgataatagtatcgcaacaagggactaattatctgcttcaataattatcagcacttaagtagctggttagtagattcacttgctgtccttcacctccttttttgtgctaatttcggtactaaatgatggcacctttcctctgtgttcttatcttggctccaaaagattgatatatattgatatgatatgactaaaccacatcatcaaccgatgttgattgtacagttgcaacatcaaaaaaaatgctggaccattagcttattgatgatggtggcaacccaactgttgcttttgcttttaagctgagttttggttgggttcatatgcgcctaatcttatcggttggaggcagcttagctgctctaatttggtgagaaatattggctgtgatggcatatttgttgggcaacttgagtagtgaccgatgagaaagctgcagagagaggggcatatatgataatgatatatctctgggttaagaacgttgtcgcctaacaccatgtgggaggtatcagtttggtcggctgcaaaaatgcttttgccatgtctgtcttatcctctggtgatagatccactggcttataaatataaataaggcatttgtaagcttgtttaagatggcataagcaaaggtttgtgtgtgtcagagtcactaggcctagctagctccatcagttttggctctgggatggtgctggggcagcttgcactgtggtccaagattgccagttcagtaatccttgttttttttcaatggtttaatcttgcctctcttttttttctttttgttgcattcggaatgcagatgttaattatggtttggtagtgtatattaatattattatattggtgatttttgccttgatagttttgaaaagtttgccattctcttctcttctttggtgaatatgtgtggtgtaatctgatacataaaagggattttttttttggtgaatcttatgagggaatgtacctgttcttgtgcagatgaagcatcctgtgggtcaccaagatggatagggaagagcctctcttgcgtatgcatcaagagaaaaggagcctatgagagaatatgcatgaaccttacaccagtgcaggtatgggcttgcgagatatctttactgtgcaaagatttgcaatgcttttatgccaatgtgcacagacagggcctttttctgctgtcagaaaaggatttatctgcagatcaaatcaatcaatagataagcgggcctgcttttgagtaaagatcacatcgcttaatcgcagactcgcagtgaccactcaaaagggattgtttaagctttggctttaagttattgtttttctttattcatggatattagtttttttttcaatttcagtatgtggtctgaccactgacatcagaaaatttacatttcagaacttcctttgaaactttatctcttcatatatatcactaatacagatagttaaaacaatcatctcttccaatttacaggaagagaggcttcagaggctgaggcaccgtatgaaggtttattttgatccttctagacgagatcatcaggtaaatcttgtactagcaataagccaataaatgaattcatacaatatgttacatttccctctgtctaactgcagtgtagatgtagacttgctatcacacactatccaatgctgtagctgtagataattattttggcactgaacatgatcagcagataaaatcatgcataacaatcagtgaactcctcagttttggtattgatgacactgatttgactagagtaccacagagttacatggtagtaacatgtactcgtatactttgatgtaagtttctttgtattgatatcacctgaatcctgataaatagcaaattatgatgataggaagcattgaaagctctttggcatgcaacatatcctgaccaagaactacaaggtttgatttctgaacagtggaaggacatgggatggcaaggaagagacccatcaactgacttcaggtactccaaactaaaacttgccacctgacagattagctccaaaaatatgttcagctggtgtgaagttaagtgaaaatgcactacatggtgcagaggcgcaggattcatatctctggagaatcttctattcttcgcgaagacattctctgtaagcaattcttcatcattgctttcattatctgaaacactgtagactgaagatcgccctcttgtttaatactgatcttctttggttggttaatccctgtaggcctcatttcagaggctgctaaagaaacaatgtggcaatcgagctacttgggagtacccatttgcagttgctggtgtaaatatcacattcatgatcatgcagatgctggatctccaatctagtaagcactgacccaattctgccagtaaatccagtctgtggaccgcagttgtactaattagacaataatattgtatgcagctaagccaagaacgtttgttcgagctgtttttatccaaatgctgtcaggtagggccagttaagtaaatacctttcctgcatcatacaatataccaacattttgaaacgaatttgtccttgctttgttcccccagaggatgagtgggcatttgatctcctctactgcgtcgcgttcgttgttatggacaagcagtggctcgacaagaacgcctcctacatggacttcaatgtaattttcctgtcaatgtacatgccatattttctccgtaactcatcagattgcattgttttgaccgatcttgcgattctgttgtgattcaggagatactgaagtcgacacggacacagctggagagggagcttctgctggatgatgtgatgcggatcgaagacatgccgtcatacagcctgctctgctagtagtggccatactggttgaacaatcatgattgagtcaatggttctgacctctgagtgtatagccccctcccttttgttgattccagggaagggaatttttgatggcatgtagagcaatggcctcctattgtcatgctgaacttgtcccactgtaaacaactcatctgggcatcaccacaatgaattagaattgctagcatccaatgtcaaagctggtgttaatctgtcatattttaccccatggatgtaacaacagaatcaacgagtgggtaaaatcaacttgcaacctctggtgaatggtgttcaatgaatcctcatttccttacttaacttgtcaaacttttccgatatgatgtcagccttgtcaacaatcctctgttcatgaacagaaaatcagctactatgaaattgccaaatgctgatcagttctgacatgctatgaaattgtcgtttattcttccaatgccgacgtcagctgtcgtcgccggccaccgtgctggagccggggatcttggaaagccgcgcccgcttcatcaccttcctcagcctgtccacgtcctgccacctcccggcctcggcgtacatgttggaaagcaccacgtagacgccatggttgccgggatccagcttgagcatctcctgcaccgccctctcggcgacgtcgatgtcgccgtggttcttgcaggcgttcagcagggctccccagatcaccgtgtcggcgtcgcaggtcgtcatgccacggatcatctcctcggcttccgtgaggaggccgctccggccgaggaggtcgaccatgcagccgtagtgctggatggtcggcgccaccgcgaagtccttctccatggacgcgaacacgcggcgggcctcgtcgagacgccccgtgcagccgtaggccgacaggacgccgacgagcgtggcaccgttcggcggcacgccgtcccgcctcatccggtggaacgtagcaagggcgacctcgccgtggccgtggtgcgccagcccggtgatcagggcgttccacgtcgccgtttgccgctcgggcatccggtcaaacaccgccgtcgcctcctccatggcgccggtcttggcgtacatgtcgaccagcgccgtcccgaggatggcccccaccacgggcgccgtcacccgcctcgacttcatgagctcgtgcacgcgccgccccatctcgagcccgcgcgaccccgaccgcgcgcacgacgacagcacggacgccagcgctgcgccgtggggctcgatcccgtcgccgaccatctcctcgaacgaccgcatggcgtcctcgtgcatcccgttttgcgcgtacccggacaccatggtggtgcacaccaccgcgctccgctcgggcaatccgtcgaacaccctgcgcgcgagggggacgaggcccgcgagcgagtacgcccggacgaggccgttggcgacgtaggcgtcgcgctccagcccgtgcctgacggcgagcgcgtggagctgctcggaggcgcggagggggaggcgggcggatgccttgaggaggaaagtgaaggtgtgcctgccgggagagtacgagccgccgccgccgccgctgccgcggcggaggagggagaagaagcggagggcggaggccgggtcgggggaggaggcgagggcgcggagcgtgatgttgagcatgaaggagtttggggcgcaggggagggaggcgaggaggcggagcacggctcccggaggggagagcgcggcgtgggcggcgaggaggcgggacgccgcgaaggcgtcgtcggcgaggcggccggagacgagcatggccgcgtggacggcggcgagcgcgcgcggggtcgcgcagcggtcggccaggagggacaggttcggccggcgccggatgccgccgcgggcgcccacggcggcggcggcggcggcggccattggcgtcgcgtgcgtcgccacactgtacacggaatcctcctctctgcgtcgccctcttcccaaaaaaatacgtatatagggcgtgtttagattaaaaaaattttcgttaaagttccaacttttccgactccgtcacatcaaatgtttggatatatgcatagaacattaaatgtggatgaaaaaaaccaattacacagtttacatataaattgcgagacgaatcttttgagcttaattacgctatgatttgacaatgtgatgctacaataaatatttgctaatgacagattaattaggcttaatgaatttgtctcggagtttacatgcagaatctgtaatttgttttgttattagtctacgtttaatacttcaagtgtatgaccgtatacttaaaaaaaaattggcacacgaactaaacacaaccatagtatcagattttaaacaacaagtaatatgattttatgaatttagatagatcatgaatattaggcatccatttataactgatggattttactgtaattttgtaaaacgtccatataaatccatttaatttgtgttcaaattgataaaatccttcatctcctagaggaagccagcaaatctagttgggtaggaggcagtatggaggttaaggcgttcctaaggtgtcgacttgatgtccttgagactgtaaagtgtcgctttaggatatactccaagttatctctgaggctctaaggcatcgcaccaaggtaagacagcttgaggcgacacctgggagtctcgcgctctatatcgctagtgaaaaaattagctttcgtgaaaagaagtttaagtgaaaacgagcccatgcactataggaaacatagagaggggcatctagcaaagcaatatgacatttggtgactttgctccctccccttcacatctgacagtagcgctctttgcatctggcaacgacgtacccatctctttcgatggtggagactctcccctcaacgagtactatctcctctcccccttcatcatctgctgagctactcctttctgttcttatttctatgctcttctcttcctcaatgctcatttcttgggccctccgttgctctggtgctctccctcgctgctcttggcttcccccctctccctaactactcttggcttcctagttcctcccgcttccttaactatttgcttcatgtgcatttgatgtagtacatagaatactgttgatgttattggttattaaaatgctaaattattatacccatctaacacttaaaatactcattatatcccaaaataaacaaatttagtactggatgtgacatattatagtactatgggtgtaacatgttataatactatgaatctggataggaggtttttcaaagacaattcatagtattaggatgtgttacatcccatactagattagtttattttgaaacagagagggtatgtactactatcagggctcaacaatttgcagcaacaaggtatataaagtgttgttaaaatgtagttatattacactatatttttgtggtcatattatattattaccattataggctgctttcggctgggctagctgccatagcggctgcggctacagctgttgtgaatggctgtagctaacagccgttttaaactatcacagtcgctgcggtagcaggagcaagtgcctccgaacaaagccttacctccgaacagacttgccaaaccactctccaagccgtattttaacaaaagtaggaaaaaatgccctccaacagcctctctaactgcctctccaagttatccaactggccaaaatacgcctctccctggccaaatctggccagcctctagctagccaccccagcttgccaaaggtgggccccaccctttttcaccgctccatcccaatttcgcagaaaatcaacgctccctgcactcgtcgtcggtcagccacctaccctcgccatccaccgtcgcgtggacgtcaccgcctcccctcgccgttagtcagccgcctgcccttgccgtccgccattgcgtggacgtcgccgccgcagcaaagggagaggggtggggaggagcttgggaatgtctcgccgtcgccgctcatgacttcagtcgatcattcccatctctgaaatatagagagggtgttgatgtccctgtcttgctttcatcacctgcttcaacccatcgaaaatcccccaaaaccaagatccccaattgctcgaaagagaagagagaaagaaacaagaagttgcttgaaagagaaaacgagaggcgcaaacaagaagggccactgccgccccgtcatcgccgtgcacggccaccgccaaccgccgcccgtcgctgcacacaaactacatctgccgcaagcaaaaacaggcttagggaatagggggagcaaggtgaggaagaaagaagtggtatagaggctgacgcgtaggtcccgctgtcatagactctgaatagagaggatgaatggagagatggttggagatgctctaaggatgaattgactagccaaattaaatggagagttaactaaatagatatttggcgtccgatttaaagagactgttggagatgctctaaggcgtgtagggccatcttacctcgccttaacgcctttacaaccattggaagcaggatttactgaaataattgttttccagtactatgcatgatgtcggtttcaggtgtttgcaaacagaaatgtagggttagtagacagtaaacaaaataagtaacaactttcgcaacaacaattttattattcctctttgctaaaaaagagctacaaaaccgtcgacggatggcacaataatgcaacaatatgcccacatttacaaatttatttattttgccaccattccggattttccatttattatttgcattgttcttacatatgctaggtagctcgccatcaaagcactcctgacattgtctttgcgtaccttcttcagatctcactaaacgacttgatagtccggaaaccatgattctcagggagcggtgcatttcccgggcgaatggagattattacctcaaaacctgaaaaagaaaatgtcgggaaagaaaaatataatatgaaatcttgacccaaggaaacgaatgatagcttgaaatgatcacatgattaggaatggcacccagagaggtcgactggttaaagctaaagcatcttatccaccaaataaaagcatgaacattcccatgaatatttgaccagaactagtcattacctgcactttttgcagcaacagcttcttggaagacatcggtgataaataagatctgagcaggactgtccaccccaagtgattgcgaaatctcaaagtagctccttgtttctcttttgttactgcggtttatgcgagatggaatcataatttcactaccatttttcagtatatgcagagaaatagaaatggaacaagaaatcatacccggttgtggtgtcaaagaaaccacagaggtattgtcgcagatcaccataggccgtattgccaaataatagcctttgcgcctcccggctgccacttgagtatatgtagacctatttgcaggtatattatttgttatcatgtcatctaatactaatacacctttttttgtattttttgcaatggatgattcaaaaatttgaaattgatattgtttagcactatctagggtcaacgttcttgacccaagttggcagctagtaataactatagtaaaccatgaaaacatattaggagccatgaaaagtttaaagttcacacttccacacgaatttgactaaagagataccttcatgccactagcatgccagtgctttagcgcctcggggacatcatcgaaaacaactccttgcagttctttactttcaaaaccagtcctccatatgtggccctggaatttgcattaaaaatgctgaaatccatcaaagaaacaggaatatgcttgcagcaccgaaaaagaatgtggactaatctacctggagttgtttcaacgacgtaatcttcctgtctgctttaatcatcgattcaacattagcaactaatgcattgataacctcttctttgtcagcatcgtcaggtggaattggaacagacccaacaattccatttttcaggtcttcttcaacctgaataatgaatgctaatatgttatatcttgcataaaacagagatgggcacattcacgtggcctagtggtaaaactcatggttctggtggtgaggactccagccactttccaccatggtggtaaaacagttaactacgtccacaaataggaagttgaggaaccaaaattggtatggtaacttagatcaaatctaacaattcaaaacaaaataattttcacagggctaatcaaatagtatgacttaaataccatcgacaaatacttagatggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20664 - DNA, 1193 bp, Oryza sativa
gagttcgaacgctctgactttctgacgccgtggcaggcatgcaggtgcagcttcggggcttcggcggcggctgttttgtgaggtcagatgagcgagaacagctgcccaccgcgatctctgcccggtgtcgtgttgctctcaccggaattgaataggagtagctcggtgacgcgcgcgtacgtacgcgcgccagccaccaccaactggaacccatcaccccggcccgcgccggaaaaagaccgagcgccgcatgcaactcaacgcgcaaccaccgagcgccagagagagaggcttctcgattccactacccgcgatggcccaagcgaaccgcccggcgcccgtcagcgcggcagcttagggtgtgtttggttcacggtcatgcataaacgggatatgaccatctatattttatattttgttggatatgacgatccagttttttgtttggtttgtatagatatgacaatccaattttttatttgattggagggatatagcatggatggaaaaagccaaaagttagtgcgacccatttgtcatatatatttttttatcaaaatataatcatctgagatcttgttttaaagatttaattgtaacaaatataatggtgtaatcaatcataaattagataaacggtttaggagaaaaagtcatttggagcttacttaacagaaaatcaaaccaaccacagccaatcagaacaggacacatcacccagaccaaaactggatggcttcatccagccaaatcggccggatgcactcatccagcatatagagagaatattccctattctgggccgccccattcatcctgccctccaaccaaacaacacaaaaaatcaagcggccatctcccatccagattcatccacccaaccaaacacactggtgtggccgccactgcagtctgtagtaataaacgcaccaaagtaccaaacgctggacccacgcaacgctagtgtgcagggtaaacacacacaggtcgagaaaacggactactcctaaatgtgtgcaccgcacagtggtcgaccgatcgatcgatcccgagtcccgacgttttttttgtgctcggtggagcactccggggagcgaggggacatgaatggcacccactagccattcattcaacccgagccaactgggaacaccacgcggcgagtccaccgcgacgacacacacgtactgata

SEQ ID NO: 20665 - DNA, 390 bp, Oryza sativa
agctaaaagttgttatatttggagacggatgtagtaatacataatcattctcctttgcttttcaccctattccactaaaaaccgctaaaaaacggttagaaaaaaccaaccgagagaagaggtatatatgggagaagagaaatttttcaaccatgttcgcccgatccgtccagagataaataatggagaagagagataaaataaaccatcttcatcagatttcatcccgttacaacactactccctttgtcccataaaaatcaacttctagttacgaacctggacgtaacgtgaagttggtttttatagtacggaggaagtatttaccaaatcttgtcatgttgacttgtgtttataaaagggagtacttatttcgaacatatgaagtct

SEQ ID NO: 20666 - DNA, 1095 bp, Oryza sativa
tcagaaccccagagtccgcacatcctcaaatacaaagcacttccctagttagatgtaggttacacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcacatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacggggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccacctggcgggcactttcagtgtctatcagaatgccacgggcaagatctgcggtgtctggcgacgagttccacgtgattacaagcgcatcctgcgcgacgatcgtctccatgttgtcctcctttggggcaacaaacagcaggccgagttggctctggc

SEQ ID NO: 20667 - DNA, 393 bp, Oryza sativa
attgccctctaatcaatgaactttcaaagcactaaactgatagtaaagtttatttaaaagtttgaatcaaaacttttaaagttcttgtttgtgtttcaaaattttaagttgagagtttcacttggaatgttcaatgctggattaaccatttaatatttggaaatattcagattgagtctgcttaaaataactgaatcttctgtgttgacctcagatgtccagaaactaattgatgactgtgagctccgatatgaacaagtatccttgtcaagtgatgatgacagtggttcttcttaccggtctctggaagcttttcaggttgaggaggaaaggggcttctcgtatctccttgacatgcttataaactctggtatgatagtcgctgactcacag

SEQ ID NO: 20668 - DNA, 390 bp, Oryza sativa
tttagctgatgtggcgcctacatggctggtttgactaggtctacgtcccacgtggcaccgatgtagcaattatatattagaaaaataataaaactatgggcccacctgtcagctaaaaaaataatttaaaatgttggggcccacatgtcaggaaaaaaggtggggcccacatatcaatacatctctccttctctctatttctctcccttccagctcttcctctcagcgtcgtcaaatatcggcggcgcgggaggcactgcagacgacggtgaccggcagcggccgggcggtgtggaggagggaggaggcggaggaggagaaggagggatgggtgccgatgcggccgagcagcggtgccgatgtggaggagctcggccgagcgacggccag

SEQ ID NO: 20669 - DNA, 922 bp, Oryza sativa
tcatcattgcaactgaactcccccatgtcgcactttagatccgcccctgcgtgattgtatagtcacatggtgcttgggctccggttttaatatctgctatatgttgatgctcatgcaacctataggattctataattgcattattttgattctttgaagttatatagaattgtatgtagatacgacgagtcagttctaagattactggctagacttggctgaactggttctttgtgaactttagtggttgcatatatgcttgttgatattgtctatgctgctatgagtgacaaggcctatccaatcatgtcttacctcatcctctaatctgattacccctaaatttgggtctatactgtatgtgtgcgttgtacttaccaagaacttttgttttgtaagtttttcctgcatgaaaaaaatattccctaactgtacaatgcatttctgcgcaagtattcatgctcttttcagtcattcatattcattagattttgaaaagtactgatgtttctttgcttttgttttcaggagatgcctcgctatgatgatcattatggaagcacacgcttgtatgttggtagactgtcttcgcgcactcgttctcgtgacctaaaatatcttttcggcagatatggaaggtaagaacagaacaatgggcattaagagagcttatttctctgaagtataatggatttttctggtaaaattatgataagtcactttcatttggtgtaagtgtaaaacactagtgctgcgctaacgcttgcttaacagttgacattacaacttgttggtacgttcaaatttcaccaaacaaatcaagctgtttcctattaaaattgtgacctttccaaaatgtggtgcaaatcttcggttgtgctcagcataggccagtaaagcaccatatccttcctaccctttc

SEQ ID NO: 20670 - DNA, 500 bp, Oryza sativa
tccaatggccaacaatagccgaagcccaagggacaacgccagcccgagccctagggatggaaatggtgatggtggtagccgtggcggctcacgctcgcccagagcaagcgagtcccctgaagcttgaaatttaatcccagtctctggcgttcatcttgtggatggtcgatgctatggttgtaatagttatatttccggtttaagacgagatcaaggagtcttaacacctgaaaggatttggtgcccttggggctatgctatattgctattggtgtgtaatggatcgatgaactttctattagcctgcattgtttttgcggtctggtatcaccctgagattgcaacttttgttgctttggtcgctgaacaacgttgacgacagttctctttcatctttgttgctaaatgttcctggagacagttctctttcatcttgttgctaaatgttgctggtgtagcgctcagaagctgccttgaagtttgcatatcatgttccctcg

SEQ ID NO: 20671 - DNA, 435 bp, Oryza sativa
ccaccacattctgcggattgtaggtggtgtacatggacttcatttcctcacccttgaggaaataggaggcgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgcc

SEQ ID NO: 20672 - DNA, 503 bp, Oryza sativa
cattgatcacctaggatagaacagaattaacaacgtgcactgacgagtttggatccattagcagatgatttctgtagggtggtgccaaatggcgtgtttcctcacctcactgacggatttgtcgccgagttgggatggattgacgaaatcagtcacaccgaactcttttcctgcaaaaagtagaggtttcttcagttgtgagaaaatgcaaagattcttcttcactgcgtgttatacacaggaaaaataatttggacttgccaacttcctctttgttaggattcaaatcaacaccgataatcttcgttgctccacacatttttgccccttgcactacctggaaaaaaaagtcaaaatatttgcagcggtcgtcaactcatcatgtatccgagtaagaaattacactgcttcacctctagcttaccgccaatccgacggatcccagcccgaagacaaccaccgacgaaccgggttgcactttggccaacctccatgctgctcct

SEQ ID NO: 20673 - DNA, 309 bp, Oryza sativa
attttggcggcacggcggggttgaccttgaagacctggttgacgtcgacgacggtgtactggctgaagctggtgacggccaccgtgcgctgaacgggttccctttgccgtcccagaacctggttgtgccgtcgcgccgcatcccggggcccatggtgaacggcacggcggtgcaatggtttgtccactccgccgggcagctggcgcacgagtcgcactgccccatgaacgtcggcaccaccgtgtcccccgccgcgagcccctccacgttctcccccacgctctccaccacccttaaaaaaaacaaaca

SEQ ID NO: 20674 - DNA, 274 bp, Oryza sativa
gcagcttgggttgttcacatgcaatttaacaacaaccgaaggatgcttagaaaggttgctcgcttacctcgggttaatagacatgcattctgggaggaccttgtgtcatatgggggattaatactcgacgggttcttgctccctcaggttatcttaaacgcatgcttaggctccaaagtgaaggcactttccccgggattttacattggaagcaccatgattcgtgcgctacctcatgtgtatgatgtgttcagggctaagcattttgtgccca

SEQ ID NO: 20675 - DNA, 525 bp, Oryza sativa
cactttcccccgtgttttgtgcacagtacactgcccgccctgccgctcgatcgatctggcctttccgccggaccgccgcgcggcgccccgaccgtcgtgcggccgcaggaggatgcaggcacccttcctttcgccgcttttctcctctggaagaagggctctcccatagacaacggctaagaattacaaggctgcttctttcgggagtagtttttctgttaattttacaagggaaataggtgagatttctgaggtgtaaaaagagaattagtagtgctgtggctggggaagatgaccaagatcagctgcttctctgctcttctcgccggcaagaggaagttatcaaaggttggtggattatattcttaggagacccagttctttgatgaattttgggttaagtttttgtttcttatcagctctgaacatggcaggttacgagcaagattggttacggcaagaagtctgggggcaatgagttccataaggtgaaaccggtggagttcatggaggggacggacaccg

SEQ ID NO: 20676 - DNA, 32709 bp, Oryza sativa
attgactagtacagaagcaccaaaacatcccctacaagactttggcctaaaaaaatgacttcaagactacaaatagtaggtgcctaacaatgtttggaagcattcgctgcttcactcaacatctcaaccaccatgatattatagcacatagcacatgcatttgcactgttccattcagccaaacatgccggtgtcaaagcttagttttttgaaagttcagtgaccaagcttctcggtatagtctaatgcatcaaacgatggttggttcacccagaggctaaaaatggttgagagcatgatgtaagatgttgagcatgtgaacgagaacttgtactgtcaagcgatgatacttcagagtatgcattactttcatgcaagaggggaacattgccaatcaactttgctgaaaaaaatgagacagctaactgaaatcctatgtagacacataaagaaatactactaatatatattgcaagcaaaatcccagtccatgaatgacttgaagttgtatgtactaactcttttgaattccctcatcaagttggtcttttcagttgatcattactgaatgaaacaatttgatcataaggaataaatattcatcagcatcgatcctgtagtattaccaatacgccacacgaacaattttgcataatcaatattcaattaaaatcatgcataccctcctctattcccacaagatggttggagcaaagctattagcttgaactattcaaatatgtgatcgctagatacagctttcgatgcaattatgcaagtcggaccatttattcgcccaccgaatgttctcaacttgcagtagtagcatgttataaatataaaccatatcatgttattggtctagctaagcaatagtgcgcaaaaaagaggttgagctagctataatatgatagtgcagattatagatcttatgttaaaagcatactcacatgtccatcctacatcccaggttcttctttgagaactgtgtcatttttcagactgaactgctgatttaagactggcaagatagcttttttttttcttctatttgaagaggcagttttcatatgacaaataaatgtcaccaattatcaacagaaaagggtgtgtaaccttaccaagtcacaccttagcaagtaaactctatgtgtaaacctcctaatttttcgtaatgacaaaattcaggtggggaagctctcccccggtgatttagtcaaaaaaaaaaaaacaccttagcaagtaatccagtgggaacacagcaacgcacctttttttgtttttgtttgaggaagtaggcctcgcctcacacagtcacacctattcagaacttcatgtcagtactgtcatttaacttgagaatagaacacagaacaggcaatacatgaatggaacccataagttcctcacacttgtgaatttgtgatggacattcaaagcaaaaacagaaacattatggagggaaaattcaagatcttcaccctcagtcacctgccctgcattccttggcaagatacatcgtcaatgttcaaacctcgacaccaaaaacctccaaatcggtccgagtcaagtatcactcggttgaccactagcagcctcgtaacgtttgcctcatttcatcaggtggcatcaaacattcgattatcaatcagaagcaggagaatcaaacgaaataataagcaggtagtacatcaacgaagagaactccttttccaacctgttaatgggcctgactgggcctgaaaggctagaatcggaggcccaataaactgccacgaaatcctagccgtccaaatcaaatcagtggctaggattgcttgacgcagctctcgtgcccttttatacttgcaactgcgagggattctcgcctcctccgccgccacacctccacctctcctcttccttcccctcgccgccgccgccttctcgtcgacgcagccatgtcggcggcgcagcagcagaagcacgaggtggaccgggcgacggtggccggagccgtggccgcgctgttcaagtggatgcgcgcgcgcgcggcggaggctccaccgaacctcctcgccgacgagcgcgacgacctcctgctcctccagctctccctccgccgcatcccgccctcaccgacgaccaagccgcgcctccttccgctcccccaccccgtcatcgtccccgcgagtcggcctccatctgcgtcatctccgacgaccgccccaagtcccgctccccggccgcctccgacctgctcgacgcgtccaggtcccaccacctccccgtctccgaggtcatcccgctctccgccctccgcaccgactaccgcccgtacgagtcccgccgccgcctcgccgcctcccacgacctcttcatcgccgaccgcgccgtcctcccgctgctcccgcgcgtcctcggcaaggccttctactccaccaagaaggcccccgtcgccgtcgacttcgcccgcaccgggtggctggagcaggtccgcaaggtgatgaactcgacttttctctacctgcggacgggcacctgctctgggatcaaggttgggaggctggacatgaaggaagaggacaccgtggagaatgtgatggcggcggtggaggcggccgtggagaatgtgcccaagaagtgggcgaatgtgaggtctctccatttgaaggctgtggattcagttgcattaccaatttaccaggctgtgccggagttgggcatgaagatcgaggtccggtttgcacaattggagggagaagtcggttccggggaggttatcgatgcttcggaagctggagctgcactgaagggtgtcggcaagaagaaggcgaagaaggcattgaaacatgtggaagaagagaatgctggtgaggaagctgcacaggagagtggcaagaggaagaggggtaagaagcaactagctgaggatttgatggagcaagacatccaagatgtgagtgagaaaaggaagaaggtgaaggagggcacccctgctgccgaaacgccgaagattagcaagaagggtaaggagaagagcaagcgtgcattggacaaggagggggaggatgcaagtgtggaggaagccagtaacaagaaaaagaagggcaagaaagaggtggtgagtgatgttggggagaagaacagcaaggtgaagaaatcaaatggtgataaggagaagagaaggaccagattaagggtataggttttattctctatctcctgagagatgcttgtgatattggttgatcgacagtgtcgtgatgttcatcgtgttgattagctgggctaatctgatagtttatctgctggcagaagaactatgccactgtcaagtttttggtagccttgtagtactttataagatctccaatctaccgcagaatgttctacttttgtgtgcactagaggtgtcttcaaaagttgtatcttttgtttttgttagcttactagcctgactgcctgagccttcaggttaaagatagtatggtaaaactgtttctggcttcatgtggttcgcatcaattttgtgatcatctaagaatatgtctcagttgttgtcttccctgaattactcatctagcatatgctgtacacttggaacccagtttcaataggagctgggctgggccatttgtactctcttactttgcatgacttgtgaggcgatggaatggaattgaattgctgcatgctgtttaccttctcagtgtttatcatcccttgtggcttgtagatcttcaagcaaagagcagaagtgaaactaagacaaataagacatgtataaatggagattagatttttcccacatcatctgttgtgttgtaagttccaaattgtttttcatgtcaagtggttgattacaagacatgaaaactgccaacataggcagtttattttgctccatgggaagcttgaaaagatttgcctgcatggactggtttagatcatttggcaaactagccaccggctggtaagcagtaacctttttttttttgttgttgctgtcaatgctgaaaaacagagtatgataagaaaatctcaaaattttaacttttcaaaatttgataagccagcaagcaaaacattgaagagttggaagctgcagttcctgatgggcaactctgcaaaggttcaaaggctcaaaggttgcatctttggcctttatgttttagctatttaaatgtcaatgctaaaaaaaatagagtatgataagaaaatctcaaaatttcaacttttaaagtttgataagccaacaagcaaaacattgaagagttggaaactgcagttcctgatgggcaactctgcaaaggttcgaaggctcaaaaggttgcatctttggccctggaagagttggaacatcttggaaagccaacttggcaagctcgaactgccctagtctaagagcaaggataataatgggctataagggcacccacaatgattatctataagctctctacaagagatccatgttagcatatttttctacttgaaagaggttaaataaagagaaagagcaaagctaacgaggcaatggattagagagctatagatacctatatagacataccattgaagtggtttactataaatctagtctattgctgagatgtacatattttatagatagcatcttactttaccattgtggatgctctaagcaagctatatgcttatatggaagagagagataggaaaaagtgggtagtgttggctctcatacaagagctagctccacacaacctccaagaaatatgcattaaatttatagagtgagaaagagagagaatggaaaaaataaagttaacctgttgacttattatacaagttaagtaacagtgagctttactattaaacttgttctaagcggcgagccaaccaaccagagcgcgacaagaccacacaacacaagcaaacactggaagcggggtcactgctcattcagataggttcaaagatttccagagaagcttgaccaaaacttttcccggagtatgggcgccgctcccaccggcaccacgcatggcgcgccacggaagccccgctcgagcggaccatccccacgcggcgcccatgcgcctcacccgcgcgtcgtcgcggcgtcacgtagcgcaggcaagccagttcgccgcggattgtcgtgagggcttctttttgacctcgttccctacctccatccatccacgcacgccgccccccacattgggagagacaaaaggcgggacgctgatcgagcttcttctcgggattttagggtatgttcttgctgtgttttccctcccctgtattcgtgataacggtgcgttcttgaggctacttcggtttgcgctccacgtgttcggtgaaatgcctgtgagagaggaggaagattcagtactcatgcctctcctactctcttcttttattctgttgttgttttgataatttgtctggtcttcttgattattttgttagattgcagatgccaaacggccgcaggtctgtgattgtaccagcccaaatattgcattcctagtttctcttaacaaatgccactcgaatgtgatgccaaagagccaatattgacaacaaattaatgttggctcttgccttgtgcaccacagcaatgaatgaatgacagttgtataatagtttgtgagccatatgaccaaatgaagattatagtcatagacatgtaggcaatccatctctcttgataccgtagtgtggatgtatgctgagttgctgacatgtccatgttttgttaggaaggtaaaacaacacgagtgatgctctttgtcattttcatcctggaacacatatggaggactatttttcacgcatcctagaccttgcttggcagttacgacatcaactgacacgattaataggtaccaagcatatagtgcccttgttgattataataaagcagaatatagcctgctaatgtttcattctatattgctgtattttctctgcggaaaggctaaaaaactgtcgacacatttttctttagaaatatatcgatttctgatccattagatcaactgtaagattcgtgctattttggttgacgaaaataaaattgtactgcaaagaatcgaacctaggatttccggtggcttgtccagcggccttgaccaactgatcgagcaaagattttggcttgaattgaaattacatactaattacacttaaattacatactatttacatatataatttagagacttacattgtaaatacactaaaattacatatgtaatttagagacttacatatgtaattttaggacttacattgtaaatacactaaaattacatatgtaatttatgggcttacaatgtaaatacatgccaactattttttggtgaaaaatatggtgccataaatatagctactcccttttctctgtgctaattccgaattaccagctccctgtaaataatggacactttcctttttagtttacacatagagaatttgttggaaatttgattagttcgttagctactagatatggatttaggatgggcaaccagttatgatgaacttgattggctctataagaaacacactctcaatatgaaatttgcatatacttattcggttattcctcttgagttttctttatattttttttacatgctgatactttttttttccatgccagaacatgtgcttgggtatattgattggatcccagaacatcatggattccagttctctccttgttataaaagatcattacctgccaccgaaagatacatccgtggagaggctcccttgctgtctgtcagtaattctacagaagaccagaccccaaatggactatctgaagccattgttgtcagaaaaggcttgtccagtatttgtcaaaggtttagtttttctttctaacttcctaatcagaacgttaataatatacataattatttttattcacattgcaactatttgttctgtctgatcatatggcaggtttcccagttttttgcatgacttcagattgggacaacagttggcattccatttgcgagaactgtgcagtgctgttgcaagtgaaattcatgctaaactagctaggttagttgctgtcttcaaatttccaacttttatgtgttgcatccgttctagtccatgtgatgaatttctgtttgcttgagccaggtgctaaaaaactgctatatgcttgcaggttcttacatcgtttctggacaacattacagggatcttctaaagatataggatggctaaaaagaacaaaaacattgccttgttcagttgatggtacagatcgtttcaaggagcttttgtatggcatcaggtgatcttttgttcatgcctattaaagtaccactgactttatttggagagtactatcttttacggaccctacatgtagaactactcctatctaacaacaatagggaattgagccactgaacatcatttacggaagtaacagatttattcctggtatcaatccatatggaggtccaacattcaattattatcagttcatgcaaagaccaatgatactaaaagaagcttaatgtttcagaaatggcatgcatcatcttcctaacacactggtttacttattcatccctggtgagacattttttttcattttttgcaaatgatgttaaaatgcctagctttatattggttcgctgcccttgtgcaggactttttagtaatcacagtccactttacttcgtcaatacgaaaagaatcttttcgaagatggggcttacttgccatattgcaaggattcatagtgaggtaacagagctcaacaggggtacatgcaaacaattttctcatgtttaccaagctctagattgtagcatttcttctgtttgtccctgtactcacctttcatttcgcccaggcatcagtggagaaaaatgcacgggaactgaaattatacattgaagagctgtactggggttctggtaaacaggtgttgctcctgggccatagcaaaggtggagttgatgcggctgcggcgctttcgttgtactggtctgaactcaagggcaaggttgccggactggcattggttcagagcccatatggtggcaccccaatagcttccgacatccttcgcaaaggccagattgctgataaggagacaaggaggatcatggaactgataatatgcaaactcatcaaggtcctcattatcctggtctctgtgttacctaatcagatcaaaccttatgactgagttattaggcaaatctttcaaaaaaaggactttatgaattgttcatatatcactgttttctcatattcttgtgcatttcatatcatgatcttaacaagtaaacaaatgcagggtgatataagggccttggaggatctcacatatgacaagagaagggacttcatctccaagcacaagctccccgtggacgaactgccgatcatctccttccacaccgaggccagcaccgccccgacgatgctcgtgacattgtcgcgcgtcgcccaagccgagctcctcccatggctcccattgccgcggttcctgtcgtcatcggagtacgccgaatcgttgctcgcctctctgaagctccccgtggtcgtgccggcctcggcggccatggccgtcagcgcgctccacctgaggctgcgctacggcgagaggagcgacggcctggtgacgcggcgggacgccgaggtgcccgggtcggtggtggtgaggccggagaggaggctggaccatgcgtggatggtgcactccacgctgagaaaggatcatgccgaggctgatgccactcagatgtgtgaagccctgatggccatgctcgttgagattgggaggaagaaatgctgctgatcataatcttacagtttcttggttaaattcaagtttgaacttgagtttaaaccaaacttaggatccaatgccataatcatagatgatgttacaaggcagtttacaaatacagaatgatttccactttgaaggaccaatataaaatgctctttatttcccccgaaaaaaaatactacaatatatttcgtgatatgctgtaactgctaccatcatttttactcccattaacttttaacaacttccctttcaatgaaaatcaggtggggctccccggtgaaaattcaaaaaaaaaatatttcgtgatatgctgtacagtttgtttaaaatggacaggtacaatttctgcacttctacattcttgtatgcaaactgcgatgaagatagaagagcaatgcaacatgcaaagctgtaagccgagaatacgcgttctgtcccgctcagttacgccttcacctctagaaagcgtagactcatttgacgtttctccccgatacgtgataaagagggcccactgtcagtgtcacactcctcgtctcctccccttaaaccctcgtcaaaaccgctgcttcagagaatatttccatttctaccccttcctccccttcgcctccctctccgccgccgccgccgccgccgcagccatggcgacgcggcgatgcctcctccgcctcctctcgcgccgcctcctcgcccacacccctcaacccgcgtcgctggcctcgatcgcgacgcgaaccctagcctccttggccaagcccctcgtgccgcaggcatcccgcgtcctcgcctccccccgcctcttcccctcgcgctgccactacgcgtcgaaccgatcctccggcgacgaggaggagggggacgacgacgatcactacgacgaggaggggagcggggatgagtggggggaggaggaggaggaggccgtggcggcgaagccccccagcgggaagacggaggaggagaaggtggcggaggcggcggagatagggtacacggtggttggcccgctcggtgccgacgagaagcccttcaagccctacgagcccgtgttcgccgtcgtccaggtctgctcagtttgtttcccaagctttcgttttgcatttgggcgtggatctagtgggtgattggatgcgttttttttaatccctgcagattggttcgcatcagtttaaggtgagcaatggcgactcgatcttcacggaaaggttgaagttttgcgatgtgaatgataaggtaattgtgcactttgaacgcaaccgatcacatttattatgactgagagtgtgttcgataacttgatctgtaacaagccgcaacttataattgatagggaatagttgaggttatgagatcatgttttaataattaatacggaggtttatcttctttggtcatttaggcgaattgtacccaccagggaagtttcaagttctgatctgattgtaaggcacttgtcatttgaagatttgtaattgcatgcagtgcatgatctgatatttggtatattgaacccaccgtgattcctcagaatttctgctagcactttttattgtttaattatgtttcatttgtgatgggaactctgaacttccatattgatggcttaaatcgtttgttcaatagagtacacaatttttttttggataaacattttccatacataagctgtttaagtcgcttcaaaaatgggtcgaacattgaaatttaagcacgcagagtattttgatgagtttgtggctactcgttttagttgctctagtgccagttctgaaactgttccattattgctggtgccactggttctgtgtacttcttgtacttccattttcatttataactttgttgatgttgtttgtgtgatcacttggtgcagttaattttgaatcgagttctcatgcttgggtcacaatctcaaacagtcattgggaggccaactcttcctgatgctactgttcatgctgtcgttgaggagcatgtaagacacttcttaaactctattactccattttttttttggggagtatgttattcagcctcttcattgaactaaagttcatgaaataactgttaagacttatttgttgaaacaagtttcaagaacatctgctaagtattaggtctgcatttttcaaatcatgctaacatctatatatatttctggtgcatctgaatccatgtttatcaaggaatcattaatatgccttgaaacctccttttgcatgacctaggtttatgagtgattgttgtgtttgaaggctgacaatgctctagtaattgtttattatactaccatcattaaggttggaaatgcgtgctgtagtaggactacacactaaagaactaggtagtgttagaattcacagaaacagcagtgcatatacactctccctttgatatgctaccatcagctgatgattggaacatgcaaaggtatatacatctacatgctttgagcatgttctgaacagtatattggtatcttcaacatatatttgtaatgtgtcagtcgcatcggatgtctactttacgtatattttgtatgtgataatggataacagagttttttttgtcacttctatataccaagagctaattcattggactttgttgttcttattgctacctttcatgattcctctaaacttccaaaatttaactgaaatggaatgcttaatacttgtaacatgatgtacattttgaggttaattctcctacttatgctttggattttcgttttttgtaatgcgtacagaaacattggcatttggttgacaaatgatataccttccccaagcgtgtcttaatcttttcgttaatacacatggctttttttttttacaactagtacaatcggttcacatggtaacatcattacataatttccagctcaaattggattgacattgtttttcaggccctagatgcaaaggttatcatattcaaaaagaaaagaagaaaaaattaccgtcgaacaaagggccatcgtcaggtaattttatatcagctgtttacattattctgtgttctcaaaataaaatatgatattattgatattatcctctgcactatttagttcttactttatgccctgacaatttttaggaattgacaaagctgagaataaccaacattgaaggaatagataagtcagaggccactgctgttgctgcttaaattaagatgaataatgaaggaacatggcttcatgcccaggcagtccttcatactggttttagtgtccaatcaaatcttgatgcggcgtgctgttgcttattgtcagtcactgattgaaagaaccatatctgaaggtcttgtctatgtatccacattttgggaacgggccactcaagctatgccctttctcacaatgccaatgtcttgaccagtttggatattctgatgtggatcacatcttgtagttacagccaaactaactttttgttttctttctccatttactagcgtacctccttgaatgtgttccaatgcatcagtgccatgtataccgttctagccatgaataatgaaactgaaagtttgtggttcccatctatttagaaatctgaactgaaattgtacatgcttatgctaatacaaccagatgcgatgatatataaataatatggaggggtgtcgcctgtgacttgtaaagtgttaacaaaaatcttcaaaacatactgtgacagtttcctgtgcagttcttgcatcagttccagcttcctgaaacatattgcacaagttcttccttcagttccaattcccatgttaactatcccagcttactgaaacatcagatttgctcatgttatagaggaattgaaagtcgatatccatcgatgttatagaggatatcagacttactcatgttcatatttgcagaactgactccacttcgttttagctgctattatatgctctcttttagaagaggatgccacagaagaaaaaccaagtaaatttagtataatgctttgaggatagcaatctaatatcgatcagattactgtctttatcatatcatttttcttaatcgaaacagggttactctgtctgagctatccgttcattgtaccatctagttctgaagttaatctgaacgctagatgcgttgtggttctgaagttgcagtcagtgtggcactaactttagaaacaacttaaaaaaaggttaaagaactcccagtggatgtgttattatcattttgccttctgtcactttcacacaaagtaccatactttagtatgcccatgaaacctacatgaccataagagtttatctacctgtaaataaaaaaaattcatactatcctctcattttctctcgagtcaacacaaccacctttaagggtgaaaacggagcggattcggtcggatagtagtcataccatatcctaaaccatattttttaagcagattcggagcgggtgcggatagcgtacggatgcagagcggatttgtttcggatgtgggaaatgatgcggaatcagttcggaaatggattaaatttatcggatgttataagtgtatgcaatcaatacaacatcgagttagcaatgcaaggaacaataatacaataatcaataaacgacccatcataataattatgtgcttaagtgctaaacaacatgaatacacgatgtccataatataaaaatacagctacgcgagtgtgacataagacggtgaaagcttcggactaagaaatctaggttaatttatgaattagtccattggatgtaccaacttatgttatatgcaataaataaagtggttacatgtgttgataattttggattatccggcaaacggcttatcggataatccgcatccaccggattttagagatattatatcatcatctgtatttgcatcatactatccacatccacatccatatctgccgtatttctaaaaacccataccatatactcgtttcgaacggattcggagcggatcggatcggatattatccgatccgttttcaccccacatcgattctttgtgcatgaattttcttctcaatggcatagactttgcaaggcaataaacatgatgcaaccagcattagcaacaagcaatgctttgttaatctcaaccatgtatctaattgctcatctgctgttcagtaatcttgatttttaataggtatggtgaacttggtgactgctttggtggattggacttctgatttgagccttcttttgggccatttttttttgtggtcgtggttgttcaggcttgcatttgctttagtttacacatgcatatacatgattgcatatttttctgctttatttggagaagaaagctttgcgcatcgatgctgaactataaattgaactgcactaggaagatgattttgctgcctcttcttggctgcctcattctggcaactacagtgcagtatcttaacattttttttgcagctaaattgcctcttatgtagtctgtagtaaatggcaacgacaagtaggctcatattttcaattacatctgttcctggaatgggaccattttctttctaagttctgggtagtttaggctaattaaaaaactcaaacaggtgaataaatggaaattctctgttcattaccaaattttcttttgaatttacttgatattatgttgtgttagacttcacatgtctacttattatataagcggacaagtttggctttttcgaagccgaagatatcaaatattgtgtccacatacgatagcccttttctgatgataacacaaatgcagatcccccaagtttgtttgaatgcatgcaattccagacattcagctatgataaacaatctggctactctgatgttatgcttaaaaacagacaatcaataataaacagggatgtgcactataatactggtggatctccaacctaacatgaagtttcatgaaccatgatctttgaaaatctcacagtgatttggcctgtctttgagactgtttcattaggtgtagcatcaggcatctgcaggaggaggacccagcccaaattggaagccatgttcatctacataagcctccaccaatccaaagttgccacaccaaaaggcaaatgatgcccaaaggcactttgtcaaaggcaaagagccaccattggtgggtgtcaatgctagtcacacataaaaacattaaacacatcccttgagatctaatggaggaactgttctaagcatttactagattggagcatatcctcttcaagtgcatgtgtttttggtttattaaagaaacttgattgtttgtagcctgctttgcatcttcctttttgagtgccttttacccccactttgtgcaatggaaattgatgttagagcttatccaattccttctctgcacttgttgcattcctctcttatctcagcctgtgacacatttctctctttctgaaaaatgtcatgatccttcctaccgatctaccttcttatggaactcaaaaatgtactcagctggaaaataaaatttgcagattctttttagttgagattattgtatcaaatttaagccaaaggctaaaaggaattaaagtatatgctttgggccttttcttgtaaggtctcattcataaaatctcaaccggcctgctgtgactcgcctggaaagtcataacagaatatgctgccatagtgatctgtgctttattcgtgtaaagcttggctcaagaagattctgagactattctaatctcatgatttttgtagcaagtttccattcagacaacattaatgtgttgaattctttttttttttttttgagaagttgagagtacaaatgatggaatatgctgcaagagaaacctatacttttgacacaaaatttggtccataaagacactgaatactttgtatttaagctccatgatcaatgttactgcacaagtagtcgtactaccctcttgatcatacagtcatccactcatcctagaataaaaatcaacagaaacttcctagcatcatctaccgatttggcaatgtctctagactcccttttctcacctttcaacaatccattttaatcattacaaaatctatttataattgatattcaggagaaaagaaaagtcctgtgcattattcagtttaatgtcacaatgaaacatgccaggagagctgggaggacagaagtaacaggcacaccagttgacctaaatgctttagtagtggctcaaggatctagtggacattccaaaagcatatcattggctgcataatggagcacagttcttgtggcacattgaatttggttgagaacagtttctgctgacagctgaaaaactggcaacaagcactattagcagtggcattgcaatgtagcaaacagtcctcccatttctgcagtgcaactgtggatagtggaaggtcagagcttaattagcagataacaagctaacaacataatatatgatctagctagtaaacacctgaaccttttttcctgtccttagctctgaagaattggatgcagatgaggttttagaaaagggctttgctgtatgcatatgcagactcagatatgttgcagtcgtgttatttttgccgcatcacattcaaagtacaaacgtagatgctcaaatagtcaaatagatatgtgcacattcctccctatgaacacacacttataatataagtgttggaggagaatatgggagaaatgcctggtggtcctccggccagctccacaaggtggtgggctagacgatctgagttcgaagtcttatcccttctaattatttggggcctgtttactttgatgtcattttcaaccataccattttttggtaaagttgctaaaaaatatctacatttagtttgttgctaaatttggtcaatacataagaaattatgctaaaattttggcaatattgctatcttgccaaaattttagcattgccaaaacttggtaaggtttattttggctacaatctgaacagactaatattcacctcttcttttagagaatatggacatttttttccttttaacctttggctgtacattttattagatcatcagaaatggtcaggttgtgtaagatatgtgtagttcaccgtgcaaaatattttttccaatcactgatccggtttccactaagactgaagagacaaatgggtgctcatttgctaaaactacccaacaagaaaaacacaatttagagctgatgacgtggcaaatagcagtcttaacagatgttgacgtgtcaatagctcgatagatctgcatcttaatgacagatgctaaactttgccacgttggtaatattcagcacaccatgttctttttaattagcactacgcaagacggctactttcagagaatgatgcaagagaaataaaaaatggatttcatatttggcaaatggggcactaaactatcgccttctcgtcccacttattgtgctagtggagcagtgacgcagctgcaaatgatgaaagaaaaaaaattgccgttcgtgttcataattaacataaattaatttcctaagaacaatgggtgcttcattgaaagatgtcactggaaaagttttcattcagcacatgctttgatcggttgatgcatacgactagtcaaggaatgccttttcataaaaaaaaaggtcggagaaatttcttccgaaaacgatttgatcgattcattgaaaaaaagtaggcatctaaattcaagcagtagattactcaaacttggattctagaggtgataatcactacactcacacaactgtaccaatttaaactaggcttatttcctaagtgatattttctccggccataaatatttactccatccgtttcacaatgtaagatatgtctatattcattaacatcaatataaatgtgagaaatgttagaatgacttacattgtgaaacggaggaagtagtgcttagaataaaatttagttaaacttttaaaattcagagcaccaataacatctcaattgtttagttttaaagcaaaagaaaagatatgcatggagttgcctcggaaatgttgtcataatttttcatcggactggtggcagatgtcctgaccagatttattaagatggaagaaggtttaattgagaagaacactcaaggttgttgttcaaaaacacttccctaccgacacaagtccctcagggtgtaaagtatcataatagtatcatatatttaatagatttgataaatttattttaatataaaattggtggttggatatttaaaagtttgactaacttttgttctgaacatcaaatgtatatacaagaaagtttatgcattgatgatgtgaaatgcaaatattttggaattatacatgagaacatagggactatgcagacaacataatcaagcatgctgtcatgttgcctggctgcccattaagaaactagtgtttttacggtagtctttactgttactgatagtattctaccatcggtaaaaaaacctgccaccactaatattgtcggtaaaaaaattgcttattatgtaaggaaaggagcaagcctagatgcatgggtgagtcgtgatgcctaattctaccaggctccatcaaatattaaagtataatcgtcggacaaatcgacaaagataagaaagagtcatctgtcagccaaacgagaaaaactgatcatctatctaccagacaaaccataaaaggagactgtctctgtgcttggcctcaaatttcaggcaaagcaaaacacctgctaatctgtcagtcaaatgcgaaaatgatatcaccattcgtcacaaaaagtgtggctgtaatcaagcccaaactctctgacagaaagctcgatcagaaatacacaggtatatcctgcaaattatccctctcatttcgctatcagcatttagttcatcccaaccttgctccctggaaaaatggaatatcctgttcagataccttaaaaaagaggcgacacatcacaagatcccttgaatattcagacaacctgcacgagaaagctaagtgcagcaagcaaccagcaatgcagccacattgtctcgggggagagaagggtttcaggttctgatacatcaggatctctaccgaattttaacaggtgattagtattataattattgttcttgttgttgttgttgctgctgcactaagcatgacaccatttggtggatgttttgtctagtgaaaaattcagaaaacctaactcgcatttttgtgcagaaagctggggaagtgaggagctgaccaaccaaaaggcagatgcagatgatgagattgtgctgcactttggacggcgaattcagcagccgtgtggatggatattctgcatgcgatcccgggatcctgtaaagggggatggatgcactttcatgggtatggagtgcagccagcatgctatttctgaatgagatgtagtattgtctttgtttgtttttttttctgttgttacaggaaaataaatagcttagaacttttacgaaaaaaaaacgtagtagtacgtaaaagtaaagtaagggaaaattggaaccatgccattataattttgtaaaatttaagatatgacttatgtttttttggatgagtataaaggttttattatgtgacattctgatttatcatgagtctctaagctatttactacactcaattctcttttaccattttttcctgctaccaatcatctatctcaaaaaaatgacaacctaaaatgcgtgaagtcaaaccttaaatcatcaatagatgtcaaacatcaagatttgaaattaattgggatatttaatgctttccttttcttttataaataaacagcttgagaaaataatgataaaacacgtgcataggagactgtccaaaacatatccatttgagaacagagttagtgtgtgtttagtaaatttggtaacacacgcagataatgtttttttggtttatgaaacacaatacaatttgcatggtattaatcaagatgcttttgtgcacacagcagtacagcacaccgatagccaatattcatgtgtgaaaatcatgtccatatatttgtctcaaaagtacattcatagtattgtaagtttatttgagttttcaaatgttttgaatatttattagttgttaaaactgtattttaaaaccgtaccatagtccaagttgatatatttttatgatcatcggaaatatgccacatctcaagacagtaacataaaaaattgtagccctgttcttttcggactattaactggattattaaaataaactatttaccccatgttttaaagacaatgttttcaaaggaaaaactttctctatagtattacatagaccacttgttttgtactattaatgaaggttatttttgaaaattttaaatttttatataattaaatagacaatttgtgatagtaatgtgctcaataaatcaaacaggtgtatagaaaaagaaaaaaagccatgcaaaatagaattccagtacaaccataccgtctaaacaaaaggagaaactcgacttaaaaaacttaaaaaacaagaatattatagaagaacctaatatcaaataaatagaacgagtgagacttccaatctggatcggctagccatcatatctacctctactctcaagggaaggaaaataacgccacaatggtgcagcatctttagttccattaacttgaccactaattcactgtcttaaattactgctgcagttaggcacacatcgtttcacttcacacaagtggcaggagcaaacagtgagagcatgggaagaaaacgagtaaaaaaaattcgattacgttttccaatccgcacttgaattcttagggaaggaaaaaaaagtaagcacaagaaagaaagcacaaagtggctgtgaggaatcccattagcgcaattaggaattaatttaggcggccgaattaaagaaatcaaaagaatttggagaggagaagaagcaccccaaaaaggcgaagcctttgcgcaccatagaaatcaccaggacccatcgcaagagcagcagcctagcggagcaccgagcaagaacaagcagcagcagcagcagcagcagaagcagaagcagtagaagaagaagcttttcttgctttgcttgctttctctctctctaggctccatctcctccctccaccactgcgtctcgaaatatccggctttcttgttgtgcgatttggtgcgaggtggtggtgattgcttcgtcggctgttgatttcttcgaggaattggagctgtgttgggggattcaggggggcttcatggtcgaagggctcggggatggattgaggcgtgggagaagaggagcttagcttcctcttcttcttcggtgatcgggtttggggttcttggaatcgcgaggaggcgggacatggcgggagattgggcttgtcacagactcaggtatggattgcattctcctctcgaatttggtttctttccggctgccctccgcgcagcccctgccccggcgaggctggccggcggcgactgccaccccgccgccggtgatgtgcgtgcaagaattgcgcttcaatggcgaatttccttgtgttgtctcgattttgaccatcacgtttacatggttaaaaatggtagtagtctttaaaaaaaatggaagattcaggtgttcatcgttagctcttgatagcaatgcgtctgatttttttttctttttttgggtcagtctttgagacttaggattgttggattgggggagatttgtcatatatgagtactttgtgggtgctacgaattgttttcgcgccattttttcttctggtttttgggagagcgtgattagcacggaaggtagtttgttggatttgattagttacgtcggaaaggttaaatattagctgcttatgtcgactacgatgttgaaatgtctgagatttttctgtactgttgtttcaatcaagaaggcacccaaactggcaattccaagtaaaaaaaaactatgttttataacctactaggttcgtctaatttatgcatgattgatcatttcttgcgttaataatatgggcatgattttctgttgatgttttgttttcgctcgtatgttaatcctttagatatggactttcagatgtttccttgtagtattagttttgatttgacccctatctgtatgtggtcttttaatagtaaaatctaaccatataaatgtgcagatatttggagtaaaattcttctatttacatttctttcaacgactgttatctgaatttttttgcgtgcagtttgattttatactctcttttgcaagtaacgttaataatttttttaatcttaatagttttttgtgtcagtttaaagccttaagctggtttgtaagtaccaatgatttagaattttagatacttttactttcgattgactgttacgtagcaggatcatactgcagaatgctcatctgtgagctttctataggctctttactctctcttttaacatctgctatgctgtattgcaaactagctattcattatgtttcctgaataatgaaaatgtgtgtctgccggtctgcccctgtttggataagaaaatttcaagtactggcatataaaggaaaatggactatttcaggcaaatattcatttttgcttgttatgagacttatattattttactttagatacctttactatcaacaagtggtggttgattcatatcctacccttttttgtgtgtagagctgtaaatgcttaaccatgagcattgtagtatgtacatgagttagttccttgtagaactcaaattatcgtcaaatcatcatactaaagtatccgtacaagattcattgtacaaaacctttttttttggtaaaatttttttcgataatgttttggtaaaatttgcatcctatcaacaagcaacatgaaaccatgcatatacatatatgtagagttgtaaatgatcctttttttttatatcctcaaaaagaccaaaacgcacgcatatgtccagcacaaacatttgtagcaacatataaatctttatgaggttgatctttgtgcctaataatgccttttgatgagagtgttctctaaagcatctaagatactaatatttttctcaatttggattgtcgtgaccaattggactgaagttctcaccacatgtttgcagggcctgctgatcaatgcaaatagacttgaaagaacattatattctcgtgatcttatcaagtgaagccatatctaatgaaagcttgttatatttgttgctttcttgatgagatttgttgcttatgaccacttgtgtcctctaatcatccaaagcaaaaaaaatcattcagccggtctttacctctccaggaattaacacctgtgacaagttattccttgttttagggcaaatctcctttggcaattgcaccttcctgtcgatcgattatcctgagcatattcctcttattgagagaacccttcagctgggcaaatctcctttggcaaaatacctatctatagtctgtctattcgggcaaatctcctttggcatttagcttagattgcttccgggcaaatctcctttggcactacctttagcttcagattgctctttgggcaaatctcctttggcactaggtactctactactatccgcattagatatttggatcaaatatcctctggaagttagtggtattacatcattatttcctgcaactatatatcgtggtaattctcctttggcattagcactgtacacacattggttctaccacaatatcgatctcagtgaaagactgaacaccaggaagtccagaacgattcaaggtaatttgtcctcttttatggtgtatattttttatgtgagccgtcattttctataatatttattcacttacaaaagctttcctattttgactcaattttcagaaataatttttggctggtggccgttgtattttagcatcttggacaggaagctttcagattctgattgttcagtctggaagattgttttgttatttatcaactctatacatcagtgcgcctatcctaagaaggtgagcatgtagttaatagtatatttcctttaaatatttctgtgtctattccattatctaaaaaatatatatttctgtgtctgattccatgtgaaaaatgacaacgtactttgttttagggctcggaaagatggatctatatgcaattgactcggacactgagtcatacgctgaaactagtgacagtgaagaagaccaagaagaatgtgaacttacatactgtggtcatgcccagaacatcttgtccagcttggacgagagcattggaaagatcgataactttctaagttttgaaagaggatttctgcatggagacatagtttgctctgcagctgacccatcaggtcagctgggccgtgtagttggagttgatatgcttgttgacttggaaacgagctctggtgacataataaaacatgtcaacagcaagaaactttcaagagttagatcctttgtctctggtgattgtgtggtgatggggccatggattggacgggtgatcagggcatttgacctggtcactgttgtgttcagtgatggggcaaggtgtgaaatgctcttaagagattctgaggtactgaagcccattcctccaatcctttttgaagatgcaccttatttttactatccaggccaacgtgtgagaattgttcatccttccatttctaagtcgggtacatggttgtgtggatcatggaaagctagtagagatgaaggagtagtgtctcatgtcgacgttgggctggtacatgtgaactggatcacctcagtaacaaatgtttggggaggtcaatcatcaagtcctccaaactttcaggacccaaagaagctcactttgctttcatgcttcccttatgccaattggcagttgggtgactggtgcactctttcggattgcgagggaagtctctgggaaaattctgacaaatcttgcttcatgagtatgacctggaagtccagctccgacactcaaacggctatcggaacttatggttcagattattctcaaacatatgttgttgcaaagacaaagagtagtgttgatgttttatggcaagatggaagtacatctcttggtttagaacctcaaagtttggttcctgtgagtactcttggtgatcatgatttttggcctgggcaatttatccttgagaaattgacagttgaggataatggtagatgccagcggactgggatagtgacaagtgtggatgcacttgaacggactgtaaaggtaaaatgggctgtttcagttgatagtgacactgtcagttatggagatggactcactgaggagactgtgagtgcttatgagctagtattacacccagatttctccttcttcactggcgaagtcattattagatctgctgtcaacatagaaaattctgaagcaaatcttaccaatggaaccgtggcagttagcagggagagcttggatacctcctctgccttcttatcatgtattggcaatgttcttggatacaatgatgaaggacttgaagtccaatgggctagtggtgcgatatctagggtaagcttaactttgagaaactttcttctcttttttttgttgctttgatttattttatttacagaagtgttgctttactttataccagttttatttccaaactttgatgaaacatggatcggtccctggtcagactaatgataacataacttatcttgtacaaatttcaggttcagcattttgaaattattgcattagataggattctagatgattctctagaatccatgatcgaggagcacactactgatgatttggtagacatggctgagcaggagaaaatgcaccttgaggatactaaggtccgcttctgtctacaaattccattgtacggttattaaacttatgggttgaaatttcatcgatgatttatcattttcattcagagtgcgctggaagaatctgctggagactgtacaggatccttgcgcaaagccactgctttcctcttttccaagacagcatttaattttctgacaaatgtggcttctagtttgtttggtgctcatgattcaacattttccagctcggtaagttctatttctctctagatgatgcaagctaaatttttatagaattctgagacaacggcattgtttcaggtcaatgcagattctcagtatcaaattgtgacgacagcagaactgcagccatctgcagaagatatctctgaagagaaacagaccatggagctgataacacagtttgagaagccaacattagcttcagaaaatgccatgacaaaaggatttgatgttgtgaccgactgttctgatcaccactttgtcaaagaaattggtcacgaaaatgtaatggtttacttagtgcaactttctttctttatttttctagcaaattgcaatgcctattaatattggagtatatgcaattcaatgtcataataattatttctgttcttctaggtcaaaagaggttgggtgaagaagatacaacaggaatggtcaatcttacaaaacgatctgccaggtttgttttcttctctcattgtatagtttattcagttgcaactcttcattaagtcttgttgttaaatttgatattttggcatatgtttattttaattttaatttctgagctagcatggcttaatactgacgatccttatatcccactatttttttacttgatatgacatgtatatacttgtggtcaaagataggaataagttaaaattttctacattccacaggatagcatagcatgtgagaatcccagaaacaatcaatctcggtagcaagtatgcaaggagatgagtggagttataaaggcaaaatttattttagttttatcatgtatgtgacctgttattatttaataaatcattacttgttaatcagtgggaaaaaatttagtcatggcacaagaattttgcaaatgcaaggacaactgtatagactggaaattttctgccgaaaactcagtaactcattctagtttttagttgcaagtaacatcttcgaataatgatggaatatatagtttcttgtacagcagttatatgatgttctttctttctattacacagatggtattcatgttagagtttatgaagaaaggatggacctcctgagggcatgccttgtaggtgcagctggaacaccttatcatgacaatcttttcttctttgatattttctttcctcctgattatcctcatgagccacctgtaagttcttcatttttcattgctcttacctacatcttctattccagattttcttgctgctgaacagtaaataaccatgttcaattttttcccccagtctgttcactaccattccggtggcctccgtttgaacccaaatttgtatgagtctggcaaagtgtgccttagcctgctcaaaacatgggcaggaactggtagtgaagtgtgggaccctgaaaattcaactgttcttcaactgctgctgtcccttcaagctcttgttctcaatgaaaaaccttacttcaatgaggctggctatgacaaattcatggggaaagcagatggagagaagaactccatcacttacaatgagaacgctttcctgctgtcatgcaagtccatgacgtacattttacacaagccaccaaaggtgcgtctcagctctggaaattctgtacacagcaatttctgaaaaaaagagccattatggtgtccatactgttgttttcttctcctaatttaaatgatactcagaagtcaaatctcctatggattctcagggaaaaagataatttttgaaaatacatttttacacatccatgtttcagaatgattggtatagttcaaagaagtttggaatcttgtgaaaccaaaatctaaacgctgttcagaattaagaatgctatagctttagtttgtaatgcttcatgtgaattactggatctcacaagagtttagtatgtttaatcttatatataaccaagtcagctgtaagagtcacccctttaagaaataagatgtgtatactgatagttctttcttttccttgatctagcatttcgagaattttgtcaaggagcacttcacttgttgcgcgccgcacattctggatgcctgcaaggcttatctcggcggcgatcttgttggacatgctcgtgacagcgcctatatatcggatgacggatgcaagaactcctcaaccggtttcaagataatgctagccaagctcttgccgaagcttgtcaccaccttctctgaagccggcatcccctgcagcccgtgactcatggcattgtgagtttgtgacactggactactgtgtatttgtgacaaaatcgggacaccaatatatgctgtgtatgtactgtatatgtgcaagctttgtgactttgtgtatcccaaaataaaatgctgcctggtttgtatgatacttaacatggtgatgtctgttgtaacttgtaagtgtggttgaggcagctggtgtggttgggtttgtggtcagttactcagttcacgtgtgttttgagcatgtgaagtatgtagatctgcttatctgaaattctaagcagtagctgcctgattgcctgtatagcctgacagagcagctatctgctgtaattgtactactactactgtactgctttgtgaaatacagtacatacatagctgatatatgtaaattggttttctcattttctacagcagtaaatgtgatgtaagatgccaatcatttcatcatgttattctcatctccagctttgtgctgacacaacgaaatctacataacttcctcaattctctgtttaatcgacagtaattttgtggtttgcatcttccatagccttctacccattataaataaacataactttctgggctaatgaagctggtgaaatccagctataattttggccgttaaaaattggggttagtttcatcgtgttcctgaaatgagctgggagagagatccatcgccttagctcgccggagtggcggcgcatggaatcgactcgccgtcgccggtgaggtgaacttgtgctgaagatttgcagagcctccggtatttcggctgccctagctgtggctgcggcgcagccggcacgaacagtgtcgcactcactgtgcgcagccgcagtagttggcctaccgaacagacccactgggccttcaggataggatgaaaacggtccgaaaatttttatatttatgaattcaactatttaatgtaaaattcaatacaacgttgatagaaattagacgattctcgattcagcaaaccgatgaagtcacgcagtgtgatgaaaggatgacagctaaaagcaatcttgtggatatgatatcatctcctttggctgtaccgaaaagaagtcacgtttaaattgatctatgctaccatccatccaccattccaccaactagcttgatttctaaatactcagctttacattctgcttggcaatacgctgttgcttctccaacctctttgccagacagagacgcctcagtgagttaaatactacaaggaggattgataattgagtttaacaaaatgcagctgaaaatgaaactagcactaacaagtagcctcacgagatgaggacacagagatacagctatggtttttcttttgaacaacatctccagtttcatgttagaagtaatatttttcagaggacagagaaggagagacatcaaccaataaacccaagaaatcctctcatttttcagttctcctttttgattgaaaaccagtccgatttttttttcaaactcctgaatctgtatgaaatgaaacagtttgttcaccaaaggcatgcaattccagaatccatctttcttatcttctcacctatccaaatgtcacacacattatatatctgcacattgcagcatttactgcccacaccaaactcccctactgaattccagcaaaccactggttccctgcgctttaaaccaacctttggcctggtttacttcacaaatttttcttcaaactttcaacttttccatctcatcaaaacttttctacacacataaacttctaacttttttcttcaagcttcttattttaacgtggaactaaacgcagcctttgattaatttgtgtggatatgaatttaaattcatattcatttgttcatattctactatacatttagcagaaaactatggatccgtgcagctgtatcccgtcgttttttctgacgtggcacgcatgtggaaggcgtgggacccagttgcctgccgaaacgcatgctgggcccacctgtcagtggcttttacccaaaaaaaaggcctattttttcatatgaacccctcaaaaagtaaactttttcctccatgctcgacacctgccacgtaggatttttttcccctttttgggaattgatttgatcacaacaaatagccttcgtctcccccacgctctcctctctacccaaaccctccctttcctcccccaattctccatttctcctagctcgccggaaaccctaagcgggccacctcgcgccgcggcgggccggcgagcgatcgcattgggcggcggcggcgatggcgacccacgcccccaagtgagtcccccctccctccgccgatctgatcggccgcgcgcgccgctctttgttccattggaatttttgtttttgtttgtgacgtggtcgtggttggttgctgctctgggtgggggcaggggctacctctgcgcggggagctcgtcgttcgatgatcccgacgtggtcgaggtgacgccggcggcggccgcggcaggggggtggagctccggccaccagaagcggaagcggagtcaggtgatgtgggaaggcgcctcctctatctcacctttgtttgtggtgcatgattttattattttttttggtgatgttggaattgggaaccgtaggggggactggggcgcgtgattgctcgatgtgggaaggagggttggtgatcgttttaatggttgcgtgttgattccagttatgccatgacctgttattttggtgtggaattgcactagaattgtgtgggcagatgatctttgattgtgccaggaaatggttgagatggactggcagtggcagtttgatatattgaattttgatcttagatgcgctcaatgttgaatatcaagtggagtttgtgttttttttgtatggtgagaagttgggctgtttttgttagatgattgctgaattatagtttatgattgcagtactgaaatttttagagggtttgattgcattgaaatgcctgataaaccaagcaggagagaagcaatctagactgtctagactttagagtgacaccatgtttcagcctggttcatgatggactagaattcatgttgaaggaaatctagcatgggacatctttggttgggcttttgagtggtagtctagcattctctggcactgcttgagtaaaaatccttgtttgtttcttatctggagagttaggcatgtaaatgtgatgttggcatgtgcaatattttcagttccagagtggatgggcagactgaaagtgcatgccatttgattattctgtctgtctgttaggtcaattgttcaattatttgacatctttacctactacccaatattctggtttagacataatctgacatatgacgttggtagtagagactggaagctgtaagtacatgtcatctgattattccagcttagtctattgggttgtttggttctttgatgtctttctataactctaggattatgttttaacaatcatctaaaacttgtggttaatctagagatgcctcaagtgaaatttgtttgtttaaaggtgtcactgggccttctttttctttctgtaacatatgatattttgtgaccaaaagcccatctccatcaaccatcattgttggaaatcaagatagagttcagactccaaagaacataaagaggccaaatataaagatgaataattagtagtaaccatgtcagtttttattctatgaactcagcattgccgtgacgtttctggctttttcagccaccacgatttcctgtataggatcaattatttcccttcaaaacatttttgtaatatcatgttatgaaatgttaaatggtggggcttgagtttttttttatacgctgaataggttgttcctcatgaagtaattgaactggatgctgatgatgatcctgatggagttgtgattattggtgaaaaatcatcagttgataagaataagcaagctgttggatatcctatagactggctaaagcatgcaaaggtaagttttctcatgtcttctattttcattttcctttttcctataccacgtcagtttgacttattttctgtgggaacaactccagagtagtttggctggtgaaattgctggcccaagttcctacccatcaaaaaatcctgatatattacttggtggcctgaaaatatttcaagagaacccattttacaacaacattgatgactatgcttatgaggcatttgaagaagattatggttatgatgaagatgagtatgatgattacgattatgatagtacactttatgaaagtgaatataacttcactttggcttccaagtttgatggtttggatatcccacctggtgtggaggctcctttaccatggttgcagacgactgcggcagagatggcaaataagaccaaacctgtgaacatgatggatgataaaattgatgaaaaatacagtgcatttaagcaattcgatactgttgatgatcacagtgatcattattattcgaagccagatttaagaaggttcaggtagtgaaaaaggtaaccttttttttgtaccctctgtatattccttttcttgttagttcgatactaagttttcccattgacagccttcaaaagaatgggcaaagcgtattcagcacgagtggaaagttctagaaaaagatttaccaggtagttttgttgctt

SEQ ID NO: 20677 - DNA, 3081 bp, Oryza sativa
tagtaatctatgcagctggtgaactatcggtctggtgggttgcggcttaatccaaacttgtatgcttgcgggaaggtgtgccttagcctgttgaacacctggtctggtagtggatgtgagaggtggagtccttcaaactcaacaatgctacaagtcctggtctcagttcaggctttggtgttgaatgccaaaccttatttcaatgagcctggatatgccatgcatgctaatacacctcatggcgagaagagttcattaacttataatgaagatactttcctgctatcctgcaggacaatgctatattctctgcgaaatccaccaaaggtatggatatgactctgttcttatcctagtacatggagatgattacttattttcataatagtactaaagttgtttgatgaatatctagacatctactgtaaaatctctcttgtttgatgaatatttcatccattaaaggtctctttgcaatctcctctcgaaatatacatatttattgatgtttctcattttcgcactcgtatgttcctttcgtcaatattaattagtaataatttacacagttacactaactattctcaattattttgaagacattaacattgcgatcatctttaccattccttctactagtctttgttattattatagcatccataattaccatgcctaaccaaaatatgtcacaaaaggaaatggagtgattactatgggaagctattgttgtgcttatgtggttgcatgccatggattccccactatgaatagatatacctgtacatcttcttaacaatttatctttttgttgtggttcttttacagtggaaatatgtgttgtttagtttctgttattttggatccaatcttcacatctgcaaatttaatactaatgcattttttttgcagcattttgaggattttatcgccggtcatttccgcaagtatggccagagcatcctgatagcttgcagagcctatctggacggtgcccaagttggatgtcttgttggaaatggtgtgcaggatgtcgatgagggcgacaagagctgctcggcgaggtttaagagcgcgctgaagagattatttgaggaacttctgatggaattcactgtcaagggagcagagtgtgacaaattcctagctgagaaggccaaagccgcggcttctagagctccagcagacaccacattgaggctataagttgatagcctcgcgtggtcgatagacgggagtaataatttcgctattgaaataggatcctcaactcattatgcccccggattctaaccgtttcctggaagtagcctatgtaaatagccttgtagttgccccggtaaacataaacgacatatccgtgtttgtatttaggggctatatatcttttttccccatagcatgagggtgtcgtctacctgcggagccttaatccgctgtgtatgtgattgacgccacaccatcttggccttctgaagaatatcatattgaactcttatcagcagatccctgcttctacgctggaattcagctagaatgctagattatcagttggtttgtgctcgtgcatgcctggctccgttcaatcctactagtatattttatatatatctggtggtggtacggagcatatgggtctgtttggaggagcttctagttgctgcagcttcttctaaaatcaaaagctctcctaaacagtctagcttttggtttagattctaagaagatgttgttgtggaattcagaaaataaactagaagctggaaaatccggttaaaatgattcactgcttttgggggtgcaattcactgctgtgtgatggtatttcagctctaactcatgacagatgccaattaaaatgaatcattcctataccttttctttgtacccatgcggccatgcctttttctgtacacattccaattgcgattctcaaaggttgcacttttcaccctctaaagtgcaaaatataaaccttctaaactagtacgatttgacgatttatagtatggccattttaaaaacaaatttcatctgaatgcaaaatcgaatgtggctcgataatggcttttacaaataaatttgggataaaatttataatgcatttagagacacgctttagggaagtaatgatagtgtattgatggaatcgtgggtatggctgcacctattaaaaaattcaaatcctgaggatcaaaatgtcatattcatacttgatgtgttttaaattggatttaagtagggctagtgaaagaaaaatgccatgttgctcttcatcaccgtcatgatcacttggatgaaaaactaaaaaaaaagggaaaaaagagaaaaaaaattctcatctacccggaggcttaaacccatagtaaaaaaagccggaccggcactcgaaccgtcgtggctgctgggtcaccgggtcagcggtccaaccgccggttcacccgggtcaattgcagaaccggactactaatttctacatatatgttctttcgttagctcattaaaacaagtagcagtgtagcccaatggtaacatgcaagggtttctaacctagccatccaggttcgagtccccacaatagcagtatttttacacatattcttctaatagtaggtattgggccttagaaggtagtgcctttgggccttcgcatggcccatgtctttggcccactaagcgaaccgtcggttcaaaatcagcaggttcaccggttttcgttaaaagccgtccggttcatccggttcaccccggttcaactgtacaaacggtctttgaagcaaaccgaaccggcgaagtccctggttccggtttttcccggtcgaaccgccgggccggtccggttttttgtactatgcttaaaccccacaaagtcaagaggctgatgcgactgttcctcccctccacctctccatttccttcgggaaatcctccccaccaaaacaaaccaagagagaggagcggagatctcacaactccgcctcctcccaaatggcgccgccgcgccgcgatccaaaccctaaccacctcctcctcgttgccgtactcctcctgctggtccctgccacggtgtgatgaactact

SEQ ID NO: 20678 - DNA, 19300 bp, Oryza sativa
atgggcggcacctcctcgtcaagtacaacggccaggcgcaccgcttccgcccccgcctcccccgcttcgccggccgccgcggctccgtcacgttcggcctcgaggggtactactcgtctgcctccggcgagctctgcatggtcggcaccggctccggccgcgccgccgacggcacggcggtgaacctcctctccgccgtgctccgcgtccgctaccccggccgcgccaacctgacgcgccccttcgtcaccggcagcctcgagagcaccgactcccccagcttcttcgagcccgtctctctcgtcacctacgccgaggagggatacgcgtacgcggagagcgcctcgtgcccgccgccgcccaccggtaggctcgacgcgctccaggtgttcgaaggtagtaaattctcatgcgcacacctcagttcgctgttcaaggcgacgttcaggctcgactacaccaacggcagcagcgagtcgaccgcctcatcgctggggcttcaccagaggttcatgttcatcaaccggatgcgatgtgccgacaatggcgcagtgcgagcttatgtggtgttcgcgaatcagacagatgtatcggcatactactttatgcttggtgagaaggccatggtagtggagggtttctgggacgagaagaggagcaggctgtgtctcaaagggtgtcacgttgtgaattcgggaccatcccgtgcggatttggcggtgggcgagtgtgggattgggatgagcttctggtcccccgctgtgtggtcactacaggaacggagctttgctgcaggtttggtctggaacacgagcctgaagagcggtgagggcatagctgcaagctccaacacaatagctccatactttaggggaagtctttcgggtctgaagtataactacaccaaggttgatgaggcaaagaagtattatgagaagtatggcttgaacaagaagagaaagggaaagttccctgatagcaattcatatcgggacttaacattccggttcttcttgcagaaaggagggggctctggatatgcatcaccagtcacaattgggtcaatgctatatgatgggaactctttggttgattcagatcattcctatcatataatgacagagacgaatcataggttacttaatgtcagctatgacattcactatgtcgggaattggtcgctagaaacatttcgccgtcagcatatctctgcagagggtgtttatgatgctaagacaggctccttgtgtatgattgcttgtcgggtggttaatatctcgttggactgtgaaattcttgtaactgctcagttttctcctttggatacaaaagtagcacagcatgtcaaggggacaattagaagcttgaggaagaagactgaccctcttttctttgaaccgctggacattgcttcgtatgggttgtacatagacaaagtggatgagtcgatgtggagaatggacttggaaagcaccatggccctgatctcgatgacactatcctgtttgttcattgctgtgcaactgttccatgtcaagaaggttcctgaagcgcttcctgccatgtcaatcaccatgcttgtagttctctctttgggttacatgatacctcttgtgttgaactttgaggccctcttcaagaacagtaacaaacagacatttccactttcaggtggtggttggcttgaggtgaatgaagtcattgtgcgaatcattaccatggtaacctttctgatgcagttacgacttcttcaattggcatgctctgcacgttccatggatgtaagcaaagatcaatcatgggctgctgagaagaaagtgctttggatatgcttgccactgtacattataggtgcagtcgcagcttgggttgttcacatgcaatttaacaacaaccgaaggatgcttagaaaggttgctcgcttacctcgggttaatagacatgcattctgggaggaccttgtgtcatatgggggattaatactcgacgggttcttgctccctcaggttatcttaaacgcatgcttaggctccaaagtgaaggcactttccccgggattttacattggaagcaccatgattcgtgcgctacctcatgtgtatgatgtgttcagggctaagcattttgtgcccagcttgagaccattttacaggtatgcaaaccctcgcgatgatctcttcagccttgcatgggacattgccataccatgtggagcaatactgctgtcggttcttctgttccttcagcagcggtttggaggcgctttcttcatttgttcgaagaacaggaaggcaagtgaatatgaaatggtttccacagttagctcttaacaagttttcatctgtgcaagagaaatatagagaaggtttctataggctaagaaataggttgcttcttatgtctatgtttgctttacacacttacatacctgccttgttgaagcaaaattacatacaaaagaagctattcaggttgggcattcagcaataatgtttaaaatgctccgttcatttctatgtgctaatagtcagtttacaattacgctgttattattctggtattcagaggcagtcgaggtggatttctgacccatgagaatttacatctgcgtgaagttatggcaaatgctgtttttgggtagtcattgcagatcttgttcagttgtccgggttgcaggccatgtgatgcatagtcgattcggtagctcactgctcaccattgattttgtttgccgttgtccgtacgttgcaatgctcaccattgatttgtttgccgttgtccgtacgttgtaattcaccgtacgagtatgtagtgttttaaagcaacaacatttgttagaagcttgacggttctttaggagcacagaaattaggaggttcagccagcgacgcacacgcagatgcttttggtctttgcatgataatttagtgagagagaagaaatttaccgttagcctccgtgttccttttcttttcatatgttaaagaggcgcacatgcgtatgtaagtcgttttcatattttttttagttaaacctatttaagtttgatcaagtttatagaaaatatatagtgacattttcgatacaaaacaaatcaagatattaaattttagttttaaagaaactaattttggtgttgtagatgttgtcaaatttttttatagatttatttaaatttaaaaagttttgacttgagaaaactcaaaactgattataatatgatgaaacgggagtaatatacatacagacaacggtttcagcatcatctaagccctaattttccctgtggtgaaagctagtatattttttattgggcccaacgcgtagtgggctggcccgaagcctagcccaaactatatcagcccgttagtccatcctatctttgttaattgtaatggtaagtttgtactcgctcccttccaaaataaaaaggatattggatagatgagacacatcttaatactacaaagaatttggatagagtctatcaagattcataatactagtattatatgttccatctattaaaaatctttcatattttaggagtggaagtaataacaattctactcgtttgtgtccgactctccgtcaacgagggcttaggtttttaaaactaaagcatattcaggttgatatatgccttcttttttttgttagtcgactagtgtgaattaatatcatctaatttaggtgaatagttaaacgttataagaaaaatttaaacaacatctgatttgggtggaggtactagaaagaaagaaagaaagaagaaagagagatatatatatcatagaaccgcgcccatctctacgccaatccaacgtgcacgccaccatgtggtgaggcagaaacacagtcgcatcgcatggacatgacaacatccaccacattccattccaacctgaccccgtctgcctcacggcccctggactggaccgcgccgatgcacgcataaacccctcgccctcgcccaacgcgcggttttaccctcttttttttttttcttttggccccgtttcctcccaaacttccccttcctccgcgtcggttgactccgaccggcagccaggccagccagagatatttaaccatttgccacatttagatgtggcaattaactttttgttacttgaccccatatatcataaacacatgtggatccacatgtcattgagataggggtgacaaatagttatttgccaaatctaaaaatgacaaatggttaaaagccccggccacccaacccaaaccccgtcgtctcctctcccgctcgctgtccaatcattcacaagcgaaagcgactagccccacctcactcctcccctcgcgaccgcgtcaatggccgcacccacgccgcacgtcactccactgacgacgacgtcccgtccccgcccggcagccaccaccggaggcctccttgactcggccgtcgccatcgttcgcctcgtcctcctcctcctcctcctccccgcgggtagctttcgctgccacacacacacacacacaaacacaacgacctcgccctcgcgaagacgacggacggactagcactagcgtggcgggggacggggccacgccgtttatagcgcgacgcggacgactcggtggtggtggtgatgatgatgagggtgttgggtttcatgggagatggtggtggtggtgggatgatgacggcgcaggctgcggcggaggcggcggtgggcgcgatcgggtgcgggtacgacctcacgagcgacctccgcctcagccgcgtcaaggcgggcgggaggctggtggacatcgacggggcgagcggcgcggcgagacgggagctggtcctcccctggggagccgtcgtggggggcgtgccggtggggatcgtcgccgacaagggggagcgcacccggttccgctccgacgtcctctccttcgctcaggtaacgacagtgcctcacaggtgttcgatcgggtgatccctttcagttcactcggaattgagcttgagagttttgttgtgttgggtggtttccctgccatggcggttcgcagatggcggagcaggtgaaccagacgatgtcggtggcggggaagatcccgtcgggcgcgttcaacgccatgttcgactaccacgggtgctggcacaaggacgcggccgccacggggagcctctgcttcgacggccgcttcatcgagctctacgccgtcgaggccccccgcgcgcacctcgccctgctcgaccgcgtcaagcgcgacgtcccgcccttctgggaccccgctgctctcgccgagtcagtacgccttcccccgtcgcgcgccgcgcgcccggcgttcgtcgcgtttgctgctaccccagtggccactgactctagtgtactgacatggtcgctgccgaattttctgttcagattcatcgacaagtacgggacgcacgtcatcgccggggtgaagatgggagggaaggatgtggtctgcatcaagcagctcaagggatccaatctcacacagagcgatgtgcagtctcggctcaagaaactctccgacgacaagctcgctcaggattcacctgaaagtttaactgcaagagacgacaagttcttgctgggattaaacgtgagctctctactctaacattatatggcttcaaaattagctttcttaggtggtgtttacatccagggacttaacttaagtctctgtctttagacactaatttagagtattaaatacagactacttacaaaactaattacataaataaaagctaattcacgagacaaattttttaagcctaattaatctataattagagaatgtttactgtagcatcacataggctaatcatggattaattaggctcattagattcgtctcgcaaattagtctaagattatggatgggttttattaatagtctacgtttaatatttataattaattttcaaacatccgatgtgatagggacttaaaagttttagtcccatctaaacagggccttagaagcttcagaattactgtattggactttcataacccatgattcggtttctgaagatacaggcgccattaatgattgtaagtagccttgctaattgctgtgatgttgtgcaggggagtttattattgggtcctggatctgctgcttggcggtcgttcagaccatcagtcgtgtcacacaaagatgtaaggcaatcacacatgtactgacgatgttcattgcgtgatttatcactccaacagcaggaaattaatgagagagccatgattaatttgtttggtcgcatgtcctttcgtttcacaggacatcctcagtatccacatcagaagagggggcgttgataatggccaaggccacagtaattggctttcgacgatcagcggttcaccggacgtcatctctatggcttttgtgccgattacttctctgctcactggtgttcgaggctgcgggttcctgaatcatgcagtgaacctctacctcagatgtaagcactttgttagttactgctggtgacaaacaaaaccatgccagttcaaggatcacatcgtatctcaagtactgacatagctaaattactcaggttacaagtctaattatctgtctgttttctgctggtaaattcagacaaacctccaatagaggaactccatcaatttctggaattccaggtgccacgacaatgggctccagagtttggggagctccctctggctttgggcccgagaaagaagaacagcctgccatctcttcagtttactctcatgggtcctaagcttcatgtcaccactgccaaggtaacaatcaataccggcattctgcattagtgaaattcgtcagtttgattccatgttgtttgtagtagaactcagctcacagtgtgttccgttttgtttcgtgcaggctgattctgggaatcgtccggtgaccggcattcggctgttcctggaaggcaagaagaacaaccggctgggcgttcacctacagcatttgtcagcgacgccgggcacgatcacgatcgccggcgaggtggcgtcggcggaggacgccaccgtgagggagcgcgactacatcgagcccatcaagtcgccgctgctgtcgcacgtgtgcacggcgccggtgcagtacaacggcgcgcggatcgacgactgcgcggcgatcgtgacgagggcgtggctggaggtgcaggagacgtgcctcaagaaggtgctcttcctgcggctgggcttctccggcgtggcatccaccaagatccggcggtcggagtgggatggcccgttcgtcgtgtcacgcaagtcgggctcgctgtcggcattgttcagcgcgcggctgtccgccgccggtgccggtggctccgcgcagatgatgcagcagcagcagccggtgggggagaaggtggaggtgaactccgccatcttccccaagggcccgccggtgcctctcccggtgcagaggatggcgaggtacgtcgacacaacggaggtgatgaggggccccgccgacttgccggggtactgggtggtcaccggcgcgaagctctgcatcgaaggcggcaaagttgcactcaaggtcaagtactcgctgctcatcgcggaggtgctagactaccctgagtgactgttgagaagaactgcacggtgtgtgcatctttttggctcgtttgtgatgctgttgtgtacagtacagtacagtacaggtaaggtcggctcagctcagcgtatacttgtacagattgggcacacgctagtagtcaggtatactatttgtatgtataaaccacagagtagagcagtacactaccagcaggcaattgttttggtttgcacttggattctagcaaaactaggagcatacacagttgttgaaattggtttccttaggcatgcagctcaaaaggttatgtacgattatttctcacctctggtattgccctgagatgggatcatttttactggcaatgttgagaatgtgaagacggtttggtaatttggcatcagcaatcatccttgttcccaccagtataccagaaggccttttacattgtttgcgagttacttagagaaggagctgaaccgttgattaataaaggggcaagataagaaataaaattattgtaattcgatagcaatggaataattaactagtgaaatatgggcatttcatgtgaattgaatacctgctagctccatttatcagttttgttatagagaaaaaaaaacataaatcatagatacttcgttgatttagcgttcaatatgatccgtactgatgaaaaagaaaatcaaagatcgtgtctcatttcttctttaccttcacttcattcttgttctaggatgtaactggttcaatggaaggagagagagaagacaccggcatggttgagggtcgaagaggagacgagatcgtccaatcgatggctagttgcaagcgcatgattagttatttatgtagttcacaaatttgttgaataaggggttgaatcgagatctcctatatgttttttgttctagggtttgaatggtgcacccacaaggagacacggtcgtggaatatttcatctttctaggaataaatcgataaaatgtgtaacttaaatcgatgcaaatcttcggtgatattttaaccaatcatgtttgtgaaacacaatataaatctcttcttgtaaaacaaaatatatatctcaaaagaaataaagggaggagttttgacatgttctttagaatatagagtaatatagagaaaataacgcaaataataaaattttacgctagtaacgtgttcttcgaaacaaaatccaaatatagagaaaatcacgcaaatgagaacattaaagtatacgacataaatctagaaaaaatcacacaaatgagatctactaatctagtactaggcaaatgacttaattggttgattaaaatttagagacaattctaccattttctctcaactagcatatttgtcataaatacttaactagcacataattaattaagttttaatatagagaagcttaattgttactaacatatggctatatgaggaaacttgatttttactctagttattgatacgagctatgctgaaaactacctttatttatttacaaagtgcatgcgcaagatttacttttgaatttacaagataatcatgtgtatttaggcctgcgccactgaatttgtcggagtgtgaaggattcaatactaacctttcatacttcaacctgcatcacacctataaacactctagtcctgcgcgttcttctcaaacttccattatctttactgaggaatacttttggcatttatgtttcccatttaaggtgtttataagacatctgatcatatgtgttagcagtacttttaacaacaaaatatgttatataaataataagcaagaaaatatttgcttaaaggaaaaatagtgagaattcttggagttggtatgattgactatacatttaagaaagcaattagtaatttaaacaatgttgggttttttagagttttctaaagcggatggatttgcagcagatttgaagctagtcatgaaaaactctgttgcgattataacatgatcaagaatttatctgttggagggatgaaaatgaaaaaaaaaatcatgtcattaaggatctcgtgggtaacttaacttgaggttggttagtatttcctgctttcaatgtgtggatggataaatttgaacagaaaaaactttctttcgatgattgttagggttttcaatttccttaaaaataaaacttaataaacagaaaaactttatttcgaggatttttagtgttttcaatttgcttaacaagaaaacttaacgtagacgtagaagatttgtatgagataagagatttgtatgagataagaaccgacctacttatcaatatgaatcatgacaaacatttagctgactatatatacagtggtaggaattactttaaatctatctacaatgtggtgaaacatttaatataaactccgtttgaaaagttatatataatattctttcagttttgtaaacagtaataaccttaacttatatttaacttaactcatatttttatgttttataataaataatgcttacagaattgtggttttatatgtgtggacagttacaagttggttggatgtgtgtctcatagtttatttatatgaggaattgacaaatgtatatttaccataatgtaattattgttaataccgtatgccaagttaagttttcgacctaatttcaattgtatgttgctaaaataaggttattgtgatctttttcttaatatttcttttttagatgtacatgagtagtcactgttgcatataattaatatctttatgcaggattttagtaatgtacttagatggagaagcgatggctaactgttgtaacaaataatggacactttctacttgagttggtgtgttctttataaagtagtagaattagctaggatgatgttttaaagaagtaagttagctaggaggatgtttcaaaggtactaatcaggaataacacattgacatatttgttgttgatggactaaaacgtctatcgaaaggtaggcttcactcacaaggtggaatataaagcaataaaaatgtgttgatttatatagtggtaaaaatgtatttcttaaaaattggatccccaattacacaccctttggggtctatttatagctgtgcaggcttacaaccccaggggctagggttactgttcactcgggaattaacttaactatccttataatagggacatttataggggtaataatcgtcttatggcccatcctacaggcccatgggccctaaagggtccttgttgggccatttgttgggcttccagtgtgaaggccccaccgaggaatttgtccttcttcgccattcgatgccccttgttgcatgcttggtgaagacgcttgtcattggcctagcgaagttacttgccgcttgccttcggcatttgtgcgggtcacatccttcggcgtccgacttcgtgacttgacgggtgtttcaagagtccggtcgaaggttctcatgacatggctccaataatatttttttgcaattagttggaaccctgataatcttggaagcaagtggcgtgtgagtcggttatggtgccaaagtttcaccttgttggcctggcgaagctacttgccgcttgccttcggcatttgtgcgggtcacatccttcggcgtccgacttcgtgacttgacgggtggaaggttctcacggcatggctccaacaatattttttttgtaattagttggaaccctaataatcttggaagcaagtggcgtgtgcgtcggttatggtggcaaagttgcactcaaggtctactcgctgctcatcgcgcaaatggactacccgaagttgagaactgcacggtgtgtgcatcttttttggcttgtttgtgatgttgtgtgcggtacaggtaggggtgaaaacggggcgggtatttcccgaccgcccgcctggccgtattattttgggacaaattcgggtcagaaattcgggtacccgaaactttatacggatatagggttcgaatatgggtttttttggaggatatgagatcgggttcaagagcgcagtatctgacggatacggattatccgggaaaaatacggatattacccgattatatatacggatagtaccagtattatatgttacagccgtacaggcttgaggctagccagcccaaacggccaaccactagccaccaggcgccaccagcccatcaacccactggcccaataggccaatactaagagcaacttcaatagaatggccaaatgggtggcccaactaaattttagcaaatatgaggggaaaatattctccaacagtctctccatcgggtaagccaagccatctggatggcccaatcgcacctctcactggccaaacttagagtctctctgcctggctattcgtgggccccaccactccccctcccgcaccatctctccctctcctagctagagcaagaaggcgtcgacggtgctgctcgtgaacggcgatggcacagaggagagagacactggagccagctgcgaccaccgccgccgtcctcgccgtcccagagccaactgcgaccgccgccgccgtcctcgccatcccagagccagccgcgactgccgtcgccgtccgctgccgtccccgcgtggatttgactgggcggcgtggattcgggagaggaagagtgagaaaaagaggaagagggagagaaagagaaagaggaagaagaatgggtatagagggctaacacatgggtcccgctatcacctgtcatagactcaaaataaagaggatagatggagaggctgttggagtaaacaatgaatttgacttgacaaatgaaatgaaaaattagctaaatagacatctggagagtcgaatttagagagactgttggagatgctctaaccctaagaaataggaaagagctttagggagatcgagagtcagagagagaggtgtgaggccgtgcggcgtgcgcccgtgcgtgaggggatttccgccgccgctgcccgctggcctgccatgcccttgcgcaggctgcgccaacgtcacatgcgccaggcgccaccacgcatccatgccggctgcgccaccctcgccaatacgccggctacgccacctgcgttgttgacctgcatcgtgcagcttgagcccgtaccatctccagtgctcgtcgcgacggcgctcgtcgccacctctgctgcacggcctgcaccggtgcccgtgttgcctctccctccatcctagcaaacttctcgcttcattggccgttaaatcatcaggtagcgaatagtgttgaggctgaaaacaactgatgatttaagtggcgctggtacttgtgaatttgtgatatgtttcctggttggcaaggcttatgttgtgagcgatattatatgacatagtgtactgataagtgatatcaggggcgggcctacaagtctacaacaattcaaggtattcaaattgttagagtgtataaagtgaattgctcgtctttccctatcagcttaggtttttaggtgtaactggctgatgcatgcaacttaatatggtatcagagccagaggtctcgagttagaatcctagcagcccactccaatagtccacgcttgagacttgaattttatcaagaattttggatatatatatatatatatatatatatatatatatatatatatatatatatatatatatatatatatatatatatatatactatgtattttatatgtgtattcaaaaaattaaaaaaaaagacatcaaacagcccatcaagcaaagaaactatccaaccgtgtcctccctcttctttattggcccattagcacaattgattcactccattttacccaaccaaaaactctatatacatgaaattatgctcaattttgtgttatatatgttatatattatatacaactactagtatgtgatattatataaaccaattattatcattttttagtgtagaaatttttttccctctttattttgaatacccaaccttaaaactctgggcccgcccctgagtgatatgcttggcaagactattgttttgagcagtattatggtactatgtattggtgaatggtgacattttggatgatgctatggtactatgtattggtgaatggtgacattttggatgatgcctacttttagctggtggctgtgaggtacatgtttcctaagcccctaatggcttaatataatcgcattatggatatttaggattgttgaatgcttattgtctatgtggtatttatgattgttgcttcgacttgatatccaaacaagtattggtaaccgatagtgtacatatccatttttttgtacgtattcgtcccatatttttacccgatattatccgatcttatatccgtattcgacactatccgtattcaacccgattccgtttataaaatataggttaggatatgagaagggtgagatccgacccaacccaacccgatttcacccctagtacaggtcagttcagctcagtgtatactgtacagattgtggcattgcgcacgcgagtagtcaggaatgctacacaacaggtcagctcagctcagcgtatactgtacagattgcggcattgcgcacgctagaggtcaggtatgctattggatgtatgaactagactatatcagtacactacacagcagacaattgttttggtttgcacttagattctagcaaaactaggagtatatatagttgttgaaattggtttccttaggcatgcagctcaaaaagttttatgtatgattattttcactgcaagtgcaagagatgggatcctttttactggcaatggtgagaactgagaatgtgagacggtttggcagtttggcatcagcaatcatcctcgttcccaacagcatccactgagttatattacttagctgaaataacagtatcttcggtcgtcaaagacatgtttagcgcaccaggaacacaggtggtacatccatcatctctatttttggttaaccatatacaaaaagccagctgcataggcatcctcagttttctctgggttgcaaaggttagacggcctgtgcttcaggtaaagagttaaaacctctctgccgggacaaccaccggctgtggctccacacgcttcctctcagaaagataaggaccccttttaaccgcttcattcaactgtcacaagatgttttccttggtggtcagcacctcactattcacaatccaacagcaagatcagaaaacaatggaatttacgaggatacctttccaatgagttcagaaaggcttggttcatgaagaagatgtgatgatgataatgccttgctgatcgccagacaacaatcatgccgtgcttccatgcctacaaaaatgaaccaacattactcttttttcatttggtaaacagaaaactgtatgtccacgaccacaatagtaaataagagccactactccattgcattgctaagcgcaattctgattagtaactggtgctaagtgctaaaagtggagtaagaagttgcttaagcttgaaaccatgatcaactctaagcagtcagcaactccaaaagcagttgtacaaaagttctccaaatactaaagcaaacatcatactgtatcacccttgggctggaaaactagaaaaggaggcgctaaatttactgcatcagcatcatcgcaattcataagtcttcctaggtacgtaccaagttttgtcatctccattttgggatctgtaacaaggttgattatgtccaactttgaacaaatttccattaggcaccattctctggcaacaaggccagatattactctgtaaccctgcagacatccaaaggcaattagcatagcctcactatcaagggacagcaattcactttctcactcataacgggtcagcaactgggggatagaagtagatattcagtataaaataagttaagagaactgcttggaatacaggagttccacgggaaatagttaagtcccagctgaaatctgggatgcttcctgtgttccaaacaggttctaacttcaacaagcatgtgctgcttacagttatccttatgtctggatcttgttgtaacaccgacagaagaagagcctgtaaaaatatgaagcaagaaccgatataaacaaacctaataagaaaggaaaactataaagtaaagatacatggaatggaaaaaaatataaagttactactaaccgaaggtgtcagttttggactgtttcttgctgtggtatagacaaaacgcttcaggcgttcttccgcttgattatccagttttatttggtcttcctgccgatcaacaccagatatgcttccaaatgcatgcaaagcagcctgaacatataaaacaatctcacattagaggaccgatttctggtaacttgattgaaaagagtggcaatagaataaactaggcaggcaacttaccagctgtttacctctaccctgccgaccaaaggatgcctctaccacatgtctggcagcatttgatgaatctgtgagcaacaaacatgctccagcagatgctgttataccaatagagccaaataaacagtacgcttagttaggatgatgacataagtttctagtaaataccccaccccaataattgatgaatatttcattattgtataacagaagggtaatggacgcataaacttacttgtaccaatcaggcctaaggcctccaatgcactctcagtttcatctgtattttgactttcttccatcttcaataatttgtctatagctagaagcagatttgcaacacctaacatgaacaaatcttgataagaaacttatctgtaattttttttaaaaaaaaatactgtaaatacctgatagcattaacacgaatatgatcctagtaaaagtgccaagaacaatccaataaataggttatcaaatagcattcctcgacacttcacatgaaagatctgttaacaactaatgtacataccatttagtacagtttcattataattcaaagaaacccccacaaaaaaattatgatgcgaagttgtcataaatggaggaaacagtataaatcatagcgattaaaaaactgtggattcgaaaatcttcaatgctcaaaaggaaagattttagcacatctggtagaatagaaattccatagctgcaaagatttttagcacatctggtagaatagaagttggatagctgcaaataaacctgcttacagtttcgatctattgtcgtgaaagcatcagctgaagaaagaagcctcccactaatcaatgttgcccttgaccgtacaatagaatcagccgatgaatcgctatacatgaccaaaaaaaaaatcaaatggatgaaaattgcaagacaaaacatagttacagaagcattaggggaatacttgatcacatcaaccatgagttgaagtaaattagtcttcagcaagaagatattgctgtgagggtgttccacgagctgcattacaacacaatgcattattagctgcaacaacgaaacatatagctacccttagatataacagaatctccaagtcattgatcttgatcaccaaaatggaagggggaaaaaaaggcatccaaagccatattctcctcactgcttctattctgaggattttgctgcagcttaactaggtactccctctgttgatttttataaggcatattttttttattttaaaatgttagtacctcgtagattataaccaatgattagtcaaattacaagtacatttagtataaagatctaatggcattggtctggtttcatccagacattcaacatatgatgaattacaactatcaatgcaacttatgcaaggctcttgcaaatgaagagaaaagaagaatcccaccacactattgacgtaaagccagaaataagccaatttgccataagtactttctttcaattgtaaagctttttcagtaactaaaagcaaaagggcctatctacttagaaaccaagttgatggaaactatcatgtatcaaggaaaactgagggatgcaagccaaagtgccaaacatttagcaagccatgaaagtcaaactggagtactgcacaaaaaatactagtatattgttacctcatagaggacctctagtgcactcagggttttaagcatgtctcttctatcttttatctcatcctcaaataagctgagaagatttgagtcgtaaatggcagtagcagtataggttgacacagcaaagagcttagctatcagtgatagaatgcgaattcgtgcctacaaagaagaggaagcaaggaacattaacacaacttaaacatgtgtattgataaattcagaaaaaaaaaaactttgacaagaacagaatcaagatgtcataccatggacgatgactgagctgccactttgtggagttgcacagacccttgaccatttggtggaaatatgatctcctaaaagccaaagcaaaaattagccacagtgataaccacaatgcactaaaggaatatatactcaacaattcaaaaacatgattatactcacaatgcctttaggaatttgtgctaaacgttttatgccatccagagaaattgctgaaatctcctcatctctacaaaaggcaaacagaattaataacaggtatatctccaagaacacgtgtcatccaaccaacagaacttgctatatgtagtttgtgatgtcgaaaataattacccctcagttaaacaattcatcagaagaggatatagattgtgctgaacaaatgtgtccacaacaacagcactatctccagccttatcaagaagatgtatcacctagtaaagaatttgaaaggaattatgtgaaaacgtttatttcaacgggaattctcagcagtcaaaatatttatatatattcagggacaataggacatacagctttgcaggctagttgtctggtattcttcgagtttgcaagcaatccagcttgaataaatgcctgaattatcaaattgaaaagttgaacttcaggtagacagatgtatatagttatagattacttaaggaataaaaagaaacagaataatgtagttggtcattttggaatatgcttcaaagaagcacaagcaattgaccaaggttaacaggtgtatgtgccaggtttaaaaattaaagagactatttcacacatacaccatagcttggcagaaatgatgctccatatctcgaagaaaatactttgtccaagcatgcggcaatagtttcatccatcccaggtacatcagcctcactctgcaatgcactacaggaccaagacgaaaattaaaacgaccactcgataactaattcattattttgcacaacaaactagtataagcaccatagcatttgtggggactagagatgtaaatagatgacttgaacaggtcggctgtaatttcatgaactcattttgaggaacaagcagtttaccctaacagcttgggcagagggtattgctccaggaactgcctcacggtgtcatcaccatgcgctcctgccacaaaggaagtaatgcagtgagtgcctaaacaaattgtgccttctccaaatgcaaacaagtccaattgaaaattttaatacgcgccacctgagtaattagcaggggaaaaaaaccagtcattcacaaatggactgaagagaggaaccgtatttacagcaacattgcaaaaccagcaagccataatataatccaaccctaacgcatgagttacaaaagttactgaaagcaagcgcgatcaggagtgcggaatcagatgtttgcggtgatatgcaacacctacta

SEQ ID NO: 20679 - DNA, 21617 bp, Oryza sativa
acgaactcgagcactgactgcaaggcaaaggcagaggcagccgctctgctcggaactccgcttgtagtgatctccaccgagtcggttgcgccgcgtgtgctcgccgcgtgcgacggcggcgtggcgtggcgatcgctggcgcgcgtgggccccacacgccggccgtgcctatccaaatccgagagcggcctgagccgtccgatcatcctcctcctcgagcgcacggatctcaaagagtggatgacaaccttgttgggccgagcccaagaatcttttcagtttgacttgggccctctcgaacctcgcactacttcgatgcttggcacaattcggcagagcccaatttcatgtttgttcgtgctcatgacttcaaatatatgcttctgaattttcaaagagaaaacttgtgagatcctgcagagaactgaaagtgcaggtagcgccttacattctcttttcctagcccaacagttgaagcagtcgaggcctcgagggcttcacataattctgcagcctacctattagagcaagtttaatagtatagcccactaccagctataattcatctatagtaaatctaataaccaattcataataatagttgcttactatactattaatatatggtcccacctgtcatatacacattgcgtctcgaagtccgtgctgcagctagctacaaatctgtagcccgctgctcttctctctcatcttttatctcattaaaatatgtttacagctagctaatagtctactattgtacctgctcttacaatgcagcatttttcatctctttagttttggtaaattttcaccgaatttcatgttttctcatgtcattatgtcatatgtatacttgtgatttttcaaaaaataaaacttgtgagagtgatagatatgcagcttatatgcacaatacagtaattgtacgccaatgaccacattcatcggctgatggagatggaacactacagagaactgaaagtgcaggaagcccttacagtcttcttctcctgtagtccaacagtccaagcactcgaagaacagctctatcacattcacaagccctgtgcatccatatccatgcatcatgcatggatacacgatttgcttctctcatatactactagtcaactgcaactagatcaagctggaagcaactttctgcaagactgtgtataacccttgacctgttcccatgtttcctgtctgaatccgactgtgctcaagacagcaacattgcaatcctgtatcttcatttttctctgttggatactgaaagtatgaaacttgatgacaagtgtaacaacagtagacagcaacagtgcaatcctgtatcttcaaaaacaatttcttggatactgaaacttgatgagaagtgtaatagcaatagacagcaacagtgtaatcctgtatctttcaaaaaaaaatcttggatactgaatgtctgaaacttgatgacaagtaataacaatgcaggaagttgaatcttgaatcttcagatagtgtcacagtgcttcctaatttggaaagttctaggttgacagacctctacatatatatggatcactctgggttattcattcattcactcattcataatggatcaatctgctggattcatggctgagggccaacaacttttatgtgcacttgaagtgaagcctgcaatttgcaggtagggtggcaattttaagtcctgaatagcacctgatctggaattgcagttcatgtcttatgtagcctgaagaacacacatgatgtcgacgtggagtactggaaaacacgagtactggtcgttttggtaaaggacaagtgaacaatcacatcttgcaatcaatgataatgtatattatcatatctctacctgctgagaatctgaaaaacttcagagtttaaaaccttcagcacttctactatttgcatacatgtaactaggggcaacttttgtctgttctcccttggatctttggtgacatagtagtattgttctctagcctctagctctaccatccaccaaccaaatgccaactaagatgcagcatgtaataatctggcaaaccaaacatccttctgtaaattcctggtcttcacctatagacattgactatgaaattcaggtgtcttttgctaagctgtaaacctaactgaactcaccaaacatgtgttgatatatactatagtagtgcctgaagtttgtacttttgttcctacatgtgtaaactttcatgtatcgtacaataagctaatcacctaaattaagttgtaagcagggcactttcattctaggattgatatagtaatagtactgaacatgtggtggtgtacttggttctacactgtggctttcctgtagtcaatggatcgatgattagctggaagaaaagcacaaatgagtgcttgctaactctgctctcttggcactctcttctcacataccttttctctctattggccatgtgacttgacagaatatttttgcagtgcatgtgccttgcttccaatccacaacatgatatcgatcagcagcagttagggccaatatccaactcgtgagctgtggcatttttccttttgggaacttggagcgaataaccagcatgatagaacctgcatgaagcagctagtcgatgagaataggactaggtgcctgcctgtattttcagcaaagtgagtgagaaaagcattgcaacacatgcagattcggctgaatgatcagcatagaaagtagtagctgtggttcggctgaacatccgtctagcacctcttccttctcttaatccttttagtatgtttcaatttgcgttttgaggaggttgtggtgaccatcgtttctgctcttgtttgtaatccctccgtgtattcctccactttatcctctagagggcttgtgcacttacgcagctaaaacctgccctgtgtaagacgtttagtttgtagtaatattttttttagggaatacgtaaaaggattgcgcatttttatattaagaggaataaaatttatacaaacggcaaacacagaagtgagagagggggaagaaaagggaaaaagaaaaacaatgacttaagcctattctcactattacagtgtgatgactgaacgactaaacacgctaattagggagcgctggcgacaggagatgggcaagacaccaaagggtggcctcttgcgccatagctgtgacaaccttaggccaggacctggaacggttgttgaacacacgattgtttctttccttacaaatagaccaagcgctaagagtcacaatcgtatcgaaccaacgacgacgctctctcggaactttgagccagcaagaacagcgccactcatggaagaaatcaacaccagaggtaaagtaatatatttaggtgagcatttcatccgcgatgaccattctagaaaaagcatagaaagtagagcaaagcacaactgcacaagagataacttgttcatctcctagcttggttgactgaatgaaatgtgcaaggaagtggaaagcattccattcgatgccaagggaagtatatcaaactgtttttctaataatggaagcttttattgaactcaaaattctgagaacactttcaatctatgcacaacagtgcacacagacaaatgaaactgtttgcaccgatcagatcatgattaattctttcgtagcatctagtgtgcatagtggttgatcatgagtgataatgagaacaacaagatcaagctttcacttatgctaactggaacagggcctagtgtttaacacctaagcaaaattattggcgattgatgcatccaatgatgaaagcggttagcaggccaggtggatcaaggcgactagttaacagtgtccaaatcgaacccagacatgcaatatgttacggaaagtgtaaggtgagatcgcttaaaatgcaggcaaattgtacaggttgatcgatcgagctcacccgggccctgcagcatgtactgaagacgagaaccagatagcccattttcgatcggtaaccaaatcaccaagaagttaaatttaaggagcccaaattcctctccatgaccatcattgacgctctctctagtcgttgatcaaaatcatgctgcactgtcacgggagcagacatgtttttttttaatcgcgaggacaatggattgagttttgtgagattgcattgttaagtgctggaaattaaaaattagattgactttgtatgcataatgtattaatttaaggacagacagatacagctgatacactctgttgcaattaactgatcaactgttagtagttaggacatgggtgcagcctaattctgatttctgaactactagtacaagtacatgcatttggattgggtttctttctgcctgaactctgaagccaaaatgttgatcgttacgtgcccgccatacgtatgccctgcgagggctggatagccgcagcttttcaaaatcttcagccccttttaaatagtccaaaatttcatcaagaatacgagaaagtatagattgaactaaaaaactaacattcagaagatgggaaattatttttcagatttaactaactagctaatcaccattgccaactgctttttaaaacctcgagcgtgacttttgtcagaactctaagatctattccatttattctcataaaaaaaccaaccaaaaaaagtgaacgtttgatcgggacatattttttgaagtgtaagtggtaactcataaacccccaaataaattaaaaataagcgaataaataatttatttcgatctataaataagtttcgtgggttaaccatttataaccttgcatgccccgtcgggccgcgaatcattggacgacgtagcgccgccgctggcggggcgccgatgaatgcggcccggctcgacgtacgtactatcaccaccggccaccggcgcgggcccgaacgactcgacggcggcccggctgctttcgccgatcgccatcatgatcctacacgactctgcatcatcactgcatgcatgcgttgcgttgcatgggccattatgtcgtcgcgatgctgatgatgctgatgccgatcgatcgatcgaacgatctctccaactattttctccgttgatccgttcgcgatatccggagaaataatttggccatccatggcacgcatcatactcgaacgtgtcgtcacaaaaggcgatgacgtgcaccggccatccatccatccacctcctcactctgtccacacgcatcagcaaaaacacggccacgtggaccaatccaatacctaaactgccacgtggcaacagtatgagaaaaaaacattttgtactttcctagttggctctgtgtttagttggatccaaagtttagattttggttaaaattggagatgatgtgactaaaaagttatgtgtatgactggttgatgtgatataaaatgattgaagtttggatctaaacatagcatttatttccttaagaggtggatagaaaattagattagatcaaaatccgcaacgtagtagaacgtacgtgtgcatgcttcactggatcggcaacggatggccggcacggctggtagtgagatggcgtgcagggttcagcgttattccgagattttccaggcctgtgatttgatttgattgggacattatggttgtgtttgttgaaaatcagtgagtttatatacacaccaccagaaaatcaagtgacatgtcactcccatgtggccatgcggcgcgttctgatccgtgagagatcagaacagttcgatcggaatggaagaatcatcgatggtttgtgattggaataatcatcggttaattgcacagcaacatccggcgggtgagatcgtgattgatcctctcctgctgggtcggcacagaactttcggctccatcgtttcacttatatgacatatttacaaacgaaaaataatttgtgaataaaattttatatacgtattgttagtaacctaaaagaaaagtctaaaaaaataaacttcgatgaaaaaaatcctaaaatcaacttcaaatctaaggttgaaaattcaaattttggctgataagtataagcataagcgaaaagatgaggccgtgcgtctaaattaatttcgtgataaaaacggcagcaatatacagtcaccaatgaatattcacccaattatacacggatgtttaagaatagtgaattctttaccatgtagaaaattgtattatactcctcaagaaataaaaaaaattatcccttgctatgtaaaaaataagaaaccggcagccaaatagttatacaatttaaggagctatacaacttttgaaaaaaaaaaacttcaaaatcattcaaatataactatggtatcatgggaaaaatatccattgaaaacttgtatactcactataagtgaatcaacttattagtgattaaaaataatttataggtaaaactttatataaatggttttagtgacttaaaacaaataaaaaaaataaactacaataaaaaaacctaaaattaaccccaaaattgtgttttaaaattttacttatgcttataagttgaaggctaaagtgcaaacgataggcttaaacgatgggcttaatagtgtaaatatactgtaataacttatacatatataacttacacataactaacaaaacatgtttacgaacaggaggtcatgggttctttctcctgctaatttctatcaacggaaatttcgcaaatctatttaaaagtagcatacagtaccctttactatgtgaagaaattattttactccatgcaaaaatttatataaaaaattggataggagtatgaaccggaggcgatctgccaacgcagcacgcataaaaccgaccgccgcagaagcgcgttctatccatgatcatcagtagccgctgcacggcaggtcggcttttataaaagacgacgtcgtctcgtcctcctccatcgccgtgccggacacagccaaaaagcggcctccgcttagctagccgcagctgaaaatctcctcctccatttcgaagcagagcagagcagccgccgagtgtttgattgctgcagtgtgtctcggcaaagcgcgacggcgacaatggcagctcgtgtcgtggtctaggaggagggagcaggagcaggagctgcgtgcgtttcttggtttcttcttgtgcgtcgcctcgcgcattggggacgacgtgaggtgatcgggcgaggaggaaggaggaatggcgcgcgggaaggtggtgttgatggtcgtggtttgtctcgccgtggcggcggcggcggcgtcggcggcgagccggtggggggcacagtcgcggacgcccgggcaagtcggcgaggctgcagctggtcccggctgccccgggcgcgtcgatggccgagcgggcgagggatgacaggcggcggcacgagtacatctccgccaggctcgcggcgtcgcggcggcggcggcgagcggaggagacctcgtcggtgtcgtcggccggggcggtggcggcgtcggcgttcgctatgccgctgtcgtcgggggcgtacaccggcacggggcagtacttcgtgcggttccgcgtgggcaccccggcgcagccgttcgtcctcatcgccgacaccggcagcgacctcacctgggtcaagtgccgcggcgccgcctctcccagtcacgccaccgccaccgcctcgccagcggcggcgccgtctccggcggtggcgccgccacgggtgttccgtcccggcgactccaagacgtggtcgcccatcccgtgctcgtcggagacgtgcaagtcgaccatccccttctccctcgccaactgctccagctccaccgccgcctgctcctacgactaccggtcagtatcctctcctctcctcgccattgccattgccattgccatgattccatctccattgacgcgcgcgtagatctcatctcacaatgcagtgatcctcgtgctcgtggctcgtgcgtgcgtgtgcagcgcagccgtagtaagtgccgggttgttgggtgggtcgggatctcgcttgcgcgccataaatttcgcgggttttttccttcgtctccatctgctgctgcgctgatcgaaaccccattaactgcgcgcagctgaagcaagcaggagtagtcctagttctacagtagcacgacagctcgtacggagcgtggtactctgcaatctgcagtaattttcgcgtgactttttttatggtcttcttggtcggagctgagcccgattttaatgtcacacatttactgagctcatctgctggccgcgcacgaccccgccccgcggcgtggcgtggcgtggcgaaagcgcgcgcgcgccgcgccgggcacgtcgccgcacgatcggctacggctggtcgcgcgttcgcgttcgcgagcgccgatgcgctgtcgcttctcgtccccggaagcgcaagtggggcgagttggcgcgcgacaccgcgcaccgaacagtgggcagtgggcggccgggggcgcgcgccatgtgcgcgccgtacgcagcgcctcgggctctgcacgcgtcgcggagaacggagcaggaaatattcagagaaatgctgcaactgtaaacgcggctgattgactgaagcccgtattgaattgccaacctttgcagtttgctctgaccgtcgtgaacgacctatatatcactgtcgtataatagtgtaacggttaccttaaacccaaagttagccggtgtactaaaccaggcacgttagcagttaattcaacctgtctgactgaccatatccaaattgtggccatgttctgtatgatctctgtatatccaactgagttttttttaatagtttgcagctgttttacactaactgcagtggctgtactagctagtactcctagaataacccaactccaaatatgaaaacggcaaagctactgctcaggagtcaggagtactaccgttctgctctcctttgctggatgcttatcttgaatttttaaggttaaaaggcataataaataactaattataccgacttcatgatgttgatactgccagtcagattcattcaccttactgttctttgtcgacgacagactggtcatcacttggccggcgtagacgatgtgaatgagctgccgagataacgctgcaatctcggctagtcttttccctgtgctttacagttcatgaaaagatatgtcttacctgttccatgattctgatacagatcatgtagaagatgagtaacttacaagccggttctttgtagaaaagccaggtcccaaagtcatatcacgatcagttctaatctatagtaaccaagtgtacattttgggctaaaaatattattactcattagttctaaagtttggcagtttttttttttgtgtgtgtaatttagcgcacgaatcttagcatgtgcatggatcttaactaacggtggctaacgcgttggtggtgggcagttacaacgacaactcggcggcgcgcggcgtggtgggcaccgactcggcgacggtggcgctctccggcgggcgcggcggcggcggcggcggcgaccggaaggcgaagctgcagggggtggtgctggggtgcaccacggcgcacgccggccaggggttcgaggcgtccgacggcgtgctcagcctcggctacagcaacatctcgttcgcgtcgcgcgccgcgtcgcggttcggcggccgcttctcctactgcctcgtagaccacctcgccccgcgcaacgccaccagctacctcaccttcggcgccggcccggacgcggcgtcgtcgtcggcgccggcgccgggctcgcggacgccgctgctgctcgacgccgcgtccgccccttctacgccgtggcggtcgactctgtctccgtcgacggcgtggcgctcgacatcccagccgaggtgtgggacgtcggcagcaacggcggcaccatcatcgactccggcacgagcctgacggtgctcgccacgccggcgtacaaggcggtggtggcggcgctgagcgagcagctcgccgggctgccgcgcgtggccatggacccgttcgactactgctacaactggacggcccgcggcgacggcggcggcgacctcgccgtgccgaagctggcggtgcagttcgccgggtcggcgaggctggagccgccggcgaagagctacgtgatcgacgcggcgcccggcgtgaagtgcatcggggtgcaggagggggcgtggccgggggtgtccgtgatcggcaacatcctgcagcaggagcacctctgggagttcgacctcaacaatcggtggctcaggttcaggcagacgagctgcacccaatgaacagtctattgatgcagatattattcaattattgtaattggtgattttgcgatcgtattaattaaaaagtgttaatgcaacgggttctcaaagaaacaaaaaaaaagaggaggggggggggggggggcaggaatgtgcgtacagcgaatggaaatgttttgcaagcagaaatgacgaatggcattttaggggatgcatgtaaatgatttagagaacttcacaacgtttcatataaacatcagaaaagcaagttagggtattagagaacttcacaacgtttatgaacatcaaggcaaagtattcagaagcaaaatgatgagcggctatcaggcatttgttcacagaactaagaatcaggatggcaaatcttggaaatgctcgcatttgttcagagaattaagaatctggatcgcaaatcaagtgctcgcatttgataaaattagcttgggaaatcaagtacacaatgcggacagatattccatctacaaatagatagataacattctagatttctctttttagctaaatatgcaaaatggcaacttcaccagtcttgatagaactccaagaacactttctcaaacagatcctgatcaggcttctgtctgctccctcaggcgacggattgtgcttctgaccgtgaccgcactggcagtgctggaagagcgtaataacaaagttaggaaacataatagtggacggtgcaccttacaaaacaccacacttacttcatggtgtaggcaccaccagccttgaccttgccacagtccttgcatccccagattccaactgctttcctcttcacagcaaactgtgaatcaggaatagcagtagacatggttagcaagaagcgattatacagaaacaatgcagataaaatagaaaacaaaggtaatacagaacaacacactgattaagagggaaaacattgtagatagtgagcatattgcataatcagaggctgttatttactgtttgattatctagatagttgaaatgaattgcaaagaggaatacttaacctaacctaaaaaactaataactaaatattaagcaagtgatgtagagtagcatggtcagcactacgcaaatttgaaggtatggtgctattcaagttccctctaaccagaggtcatgcaagaaacaaaccacagcagaacaaaaccagatatgattattttgaatattgtgctgcttttaggatagtcatatgacaacaagcatgacacatcataatacagtcaagcaaacccaaagacacttaaagcatcttgctgacaagtaatcattaatatccttggaagaattaccttgccacagaactcgcagaagtacttggagtgctgggaaacctccatcttcttgatctgcttacgcaaactggcaccatacctggtacctgtataacattgatattacaagggcatatgttaacatgagtgatcagacattcatgatgctatgaactaacagtgtgcacagttacaatgtcattaccatatttgccaacgattcctgccttcttggtgcgcttcgtctgcacaaacatcacaaacaagacttaaacagagcacaagcatagttaatggtacagtccacttttacgtatggtgatgattgcagacaaccccactctgtactaaaaatacttggaaagtataacttgtatatacttaaaacacatgacatttccacagtagagcagaaagaacttgtgctaataagaaaccccactctactataagtattatccaaaacagtatattaactgatcatgcagtaccaatggaaacatcggcacatggcagttggcctcaaaggaagcttaacaagctaaagtgtttaatggtgcataatttgaggtaatgatcatgcactttattaatcaacccactccaactaataatttggaaggcagaaattgtcactttaacaacaggaagacggcaacaccagttcatcaggtaataatacagcgggggatctcacagtgatagaattcgtatcaagaactacaagggcgaaatacaacggaagcatcacgcaagtgtttgtaccacgaaatcgttaggtgatcttgtgttggccacgaaaaagcgtcaacagcaagatctcacacgactcccaacgaggacattctaccggcacaaaccaaaacctcctaaaatcaaacaggaacagcaaattcctcctaaaatctaaccggaacgacatattcccattgcgctgaacaaagctacaactaaaccgaaaagggtcaggatgattcaatcagcacagcgagacaacgagttgatacgaaggggaaatccgagtgcacgcgaaggattggagaggacgtaggtacggggagaggagatcgtaccatctagtcgccgaagagttggagtacgaggcaggcggcggcggcggcagtgagagaggcggcggcggcggctgcgagcgaactcgagagggtggcggcgtggtggagctttatataggtgagttttagggtttcggggtcacgttgctgctggcgaagtgacacgttgggctttcgctatgaattccataagcggaggtgggccttccggcctggtagggccttccacagttgggcccttttagtttctcatcggcctagtattacaaggacttgtttggattgtccaaaataccggcccatccaggtctgtaggcctagtcccacataggtggactgggtctagattgagcccacacaaacaaggcctagattaagccgaatgctattggacgaaaatcttcccactattggagttctgtatatgttagttttcttttgtttgattgtgaaatgccctcaggtgatttttcctgaaattttagtacgaatttggtttgtttaataactagaaaaaagccggtgcgttgcaacgggtaaaaactattttaatattattattgttatatggtttagttaagatgaaattcatagtgagaattcgggtctgttcactttgatgccattttcaatcttaccaagttttggtaaagttatcaaaaaaatggctacatttagtttgttgccaaattttggtaattatataagaaatcctgccaaaattttggcaagttaccaaaattttggcaactatgctaaaattttggattgccaaaatttggtaaagtttttttttttttttgcatcaaagtgaacaggcccttcgcttggatgactcctatattttcaaaagtgaacgaaattgaaaactgactcaaatccggatatgtatttccaaaagcgaattaacataaaaaccgacttatacatggatgaggtaccaaagtaccggcaaaaacatctttaatttttatttttaaaaaatactaggaatgacttaaattgtaaaacggaggaagtaatatgggactatgagtaaaatttttaatcggaacggattcgtctaatccccacctatccagactcacacttgtaattgcgccttgcatacgtgtgcgtgcggtgtgttctgctgttgttatctcgaaaaaaaatatatagcgattgaaaaggaaatacttttatcaccaaatcggagaagaacagtaacacttgcttgcaggtccacagcaatagtcaacctagtgcttacttgatgttaactgcaattattaggctccaatcacactcactttattctctccctaatcacacagaaaaacacacacagcacgcgctatctcttgctgtcagacgccgaatggatgaagaacacacatctatcatcccaattagatgtaggcagatcggtcgagcagctagccggttaattcttccagaaagtactgccggctagctatctactctatctatcctgaatttcctgatggattatctatctgcagttctgcatgcgtacataggtagctagctagtgaatggttaatggccaaccttaagatggatggcatttctgctgcatgaatgatggcgccaatcatactacatttcgtcgataattatccttgagctatgtgcacttatgattttctatcatatatattaattaatctagcttagcacttcaatttgaccatatcagctaagatcggttttagatttctctacatactttgagttacatcaaccttagtcctatctataaccctaaaacctaacctaaaattgatcaagaataacaatattatcgaagtttcaaccaattttacctgatatatttattttagcgtaccttttaacttgctacgtattgtgtctgccacttatatgagataattgatcttttcaaatatataagtatgattcaatctcaggccagatcatcatgttggggattgggccttatttggcatatttgacttggtcaacacttttatataaaacacttttatataagtttgtattaaaataatagccaatacattatctttatgctctaaatattgaatcatcgactagttttcataatattgatttattaacttacatgattaattttacagtcgatggaacatactcagggctttgttttgttcaattcatcataaagatcctaacgcactttgttttgttcaattcatcgtaaatattctaacgcgtttatctaatttcatttattgttaggacctacactagagtaaagcaaatcttcaaagaccaccgtgttttgcatcaacaatcagtcagattcaacaaaatatcatcgccgctcatttagatttaagtgtaaacactagggaatccctgattatagggcgtacatttctcttcggaaatactccagcattatagggagtactacagcaatggcaccagcatttgtgctgtgtcatgactaagcaatcagcagaaaaatcaggtaccggcactctgtccgtctaaatgaccaccttctcgattggacaccagatatctgaaccactgaatccatctgcctatcattttcaaatatactcaacgagcagtgccaaccaaatttagatatacagatacgatatcaaacggctgagatcacgatacaaatgctaaacctctgtagcttcaaatccgctaaaaagccttcaaataattgtcatcatgatacagcaaatagtccgaaataaaaagaaaagctaaaactcctcaaaaccgcttaaatttctgactggttaaccaagtgactagctgatataaaaccctccacggtgacaactatcagtttcgcagcataggcaagaaacctgtttcagttaaaaagtgaaattattgttagttttcaaacttttgacttgttatgcaatagggagataggcaaaaaaacaatgatatcaaaatatattttaaccatgcaaagtgcattatgctctgaagacagtatcaacatcaacataaagtcacaaaaacatgaagaaatcccatactgtaggtttctttaataccacaatacccccccaaaaaaaaatggtccctgttccactaggaatgagctgaaacttgactgtctagtcaaccaggacacaacttgactgtcagctaatagatagtaattggcgttttcatcttccaatgctaagctcgcaattcctacatgtatgtatacatcatcgggcaaaaaacccagacctttccacaaacaactggaagcctgaaaccatcccagggatcccagtaaattcctcctgccaccccaattctgttaagttaggatggggccatgatcccgacctggattgggactcctaaacaatgacaaagtatgaaaggaacctagatcaactaaacggcaaagcatatagtgtaacacattagtttataaccctcgagttcgctatatgtcactctacccacatgaacgcttgtgaacagtaaaacactgacaatattagattgatacatgtagaggtcattggaggcaaggttgtgacaaacaggttgatgagaggcccatcaaccaaagcacagcctcgcactatgagaccgctgaattttatcagcaccccgcagagaacctgcaggtatttcgaagctagcagaagagcttcccccattggcatggagcccttacacacaaacataacgatcactcacaccagaacctaacaatgcaccattccatctaattaggcaacaactgttacgaatactgaattcatggacgattgcataagattctgactgaccccacgagctagatgattcaatgaacagtatacaacatgacgggaagcaataggcaataatgcatcactgtaaaagattaaaaccagtgaaactaagtaccttggatgcttttagatgctgctggggtacatgaagacgcggaccttcttgccctgcaccaccatatcgacccaacaaaaacatcagaaatggccaaaactacaatcaggagcggaatggactggatcaaatgatggcgcagacgacggtgagagcgagattcaccatggaggtgggcgggaggttggaccggaacttggcgcggacgacaccggagttgccgtgcgggcgggtgaccttgccccagatgcagcggatggtggagtcgttgctcttcgtcttggccttgtagacgtaggcgatgcgcttcccggcgtaccacccaacctcctccttggtgttcaccccctcgatctgcagcagcgacgtgttctcgtactggttcgacttcgacctgcgcgagcaaatcaacgccaaaccaagatcaacaccactccaccgcggcgatgacggagaaggcggagacgccacgcagggggagagcgagctgtcacctcttgtagccgaggatggtgccgcggacgtacagcctcacgcgctggccttgccgtcccttcatcgccgctgaagaggaggagtacggagcaagcggcggcgacggcggcggcagagagtagggaggcggcggcggcggcggcgagtgaaatcgagcgcgtggcggcgtggtggagcattatataggtgaggcttagggtttcggggtctcgttgctgctaacggagtgacacgttgggcttcgctatgaattccacacgcggagtgggctttccggcctggtaggggtgctagtgttattagtccacatttgggccttttttagtttctcttcggcccaactttagaaggacttatttggatagtccaaaatcccggcccatccaggtctatagacctagccccacgtacgtggactgggtctagattgatgcccacccaaacaaggcctatattgggccgaatgctaagttagtttccatttttgttgcgaaatgcctcaggtgaattttttttatttttttagagaagggtattttatccccttctgaaattttagaatttagtttgctcaatttttcgcgaacgcgtaaaaggattgcacgtcaatatattagaagaaaatagtttttattacacaacgcaaccagccagaccggtttatgccaggggaagagagaaaaagcaaaatagaaaaacaagaaaactgaagcttagaaaactaccgcggctaaacacaactctaaatagtgaaatttggtttgattaatgttggactatgaactcaaatttttaaccggaacggattggtctactcccctcctaaccaggtgtgcatgtggtgtgttctgctgttgttatctcgaaaaaattatatagcgattgaaaaggaaatactcttatcacccattggagaagaacagtactcctaacacttgcaggtccacagcaatagtcaacctagtgcttactttgatgtcaaatgcaattattaggctccaatcacactcactttattctctctctaatcacacagaaaaaatacagcacgcgctatctcttgttgtcagacgccaattgcatggattaagaacacgcatctatcatcccaattagaagtagacagatcgatcgagcagctagccggctaaatcttcctgaaagtactgccactggctagctatctactctatctatcctgaatttcctgatggatttatctttctatctatctgcagttctgcatgtgtgcataggtagctagctagtgaatggctaatggccaaccttaagatggatgcatttctgctgcatgaatgatggcgccaatcatactacagttcgtccatattatccttgagctatgtgcatttctggctttctgccatacttgcagacatgcagcagtactagggaatgttgattatgaacttctgagttctgatcagcgtactgtactatgtttcttggttgctgcagtgttgcaaccccttgtaagggcctagaagaatacagataagcaatcaatcctacgtggctttgtatgctctcttatgacttatgcatgatctcagtctgttgtagaatttgtcaagttcagaacattcagatatatatttgaaattgacgcaaataattctcggacctgatcccaatttcttcatataaatttctctgtgcatatccgaatggcacagcagagagaatcgctgcgcaatctacttactgtgctaggataattacatgagcaccaacttggaaacttggaagaaacatgaaggtttctgaattatgactgaactactactgtaatgcattcattatcctgcagtttccatcttaagtactatagtagcagatgtagacgtccatctgatcaggttagttccatgtaattttcctttttgagagaaaaaagatcggcgtctcaatttgtaagccgtgacgtgttgaaccagtgaaagagcagctagcttggttctcaatttctcagcgcgtccgtactgcatatccaagaaaggctcgacaagctgttccctgaacgtgatcttcagaaaaccatgctattcatatggccaaaaccatgaaagggtatatggatcacatcatcacacgatacgttgggcgataaatcttacagatttatatattttagaacaaacaaacccagggaaactattttgatccctcgagagaatgtcaccttgtttgtttgaatgtcactcaaatggttatgaaaaaaattaaaaaaaagaagaagatgtattaacatgtgatatatcactccacatatatgcaagtttcaacattgcctcgagagatcaaaatccactccctatatatagattgatatgcctgttctttttcctctgagtgggaatggaatggaatggcgacatgttttccgatctcataaatgatacattttttctgcaaaaactttctatatatgatttttttattggaaaatcttcttaaatccattttcaatcttctaatacctaatttatttgtttgtacctttgaatatttatcacaaatcatttagctattgaaaaaaaaacccttaagtaatcttgaacgtttcggacagcttagcacatgccttgcatgcccaaatgtagcatacttgagacgcaatatatccatggaggttgttagctagctagctggaggcaggtcgtcgtcatcagataagacacagacatatatatcgtgtagtgatctggagcagctagctaggaggagtcatagtgatctcctcgttttcttgggccgtttcgtcctcgatcactcctggtcgcatccgctggttgccatgacaagtgtcaagctcgattcggtagctagctatagctcgatctcgatctagcctgattttcggagaaaactgttacaaaaatcggcaccgatacatatattagaagctgaacccgaaagaatatcataagtgatccaaacacgtgacacactataacacgtgctattttaatcgaagagaaacacctatatataatccgagtcttgtgagtatatgtttcggctaaatatcattaataaattctagtatatatatgtcgtggtttgttatgtctggggttgatcaatggctaacaagagtcttccgcaatttggactaacttttataacaaaaacccacacacaagaacggttcagttattcagttctcgttttggggtgcgtgctcggctggatatatagctagctttaacgtccgtgcttgcttgcttgcattccggcgagtcgccgcgcgccgggccggccggccagccggcatgtcgtcgttgtcatccacttgccagcaaatgcgggcagagcaaacagacgcagatcgggtcagcgtaaaatgcagctggatttttactgcggattaattactactgggctggcattctgatcactttgctgcatttggttagtttggatggtgcagataaatcagacatgaactggtggattgtaaaattcggttcacatacatatgaatcgaggagaatttcttgtctttcaaatgggacttctgcttataggacttgttttgtaccctcgagggatgaaaacattctctgtaatcatcatcttattatcatcaacggatgcattggaatctatatcaattaattcaccagaatgataaagagatatgctatactgaccatttattatcaatttgtagccataattaagtatggtttaatttactccatttttagaacgacctactcatgaacagcacattcatgtatctcatatcccgatcatggtctctagcaattaaattccgtcttcttttgtagacaaaccagtcaccttgattatttttttcagtttcaatttgctacttttaattttgtttgaaaacgaaaggcgtagaacctgaaaatgcaaaaggagtcaaactttggaagaaaaaaaatcatctattatataatacgccattttatcccctctcatctcatcatctgcataaataagtggagactcacatcgccatcgccgcctacacactcctcctcctcctcctcgccgataacgatggcaatcgccgccgccgtcgccgccgccatggcggggcctcgccggcgcaggatgctgctcctaatggcgaactacgcggcgctgctggtggggtcggtggcgtcgagcctgctgtcgaggttctacttcacgcacggcgggcggaaccggtgggtggtgacgctggtgcagtcggcggggttcccgctgctggtcgccggcgcgctcgccggcggccggccggcgtcggcgccgcggccgttcacgtggctgtcgcggcggttcctcgccgtctgcctcgtcatcggcgccctgatgggggccaacaacctgctcttcgcgtacagcacgtcgctcctccccgtgtcgacgtcgtcgctgctgctgtcgacgcagctcgcgttcacgctggtgctcgccgtcgtcatcgtccgccacccggtcaccttcgtgaacctcaatgccgtcgtgctgctgacgctcagctcggtgctcctcgcgctccggtcgggggactccggtgagacggcggagggccgcttccgccgcggcggcaggaagagctacctcgtcgggtt

SEQ ID NO: 20680 - DNA, 13799 bp, Oryza sativa
tctccggggggttcgtcctggccgtggaggtgcaggcggtgatgcagacgatggcgtcgctcatcgcggcggtggggctggcggcgtcggccggcgtggcggacgacgtgtccggctgggtggacggcgggtcctcgccggcggtgtactgggcggtggtggcgacgctggtgctgacgtggcaggcgtgcttcatgggcaccgccggcgtgatctacctcacctcgtcgctccacagcggcgtctgcatggccgccgtgctcaccctcaacgtactcggcggcgtcgccgtgttcggcgacccgttcggcgcggagaaggccctcgccaccgcgctctgcgcctggggcttctcctcctacctctacggcgagtacgccaaggccaagaaggtcgccgcggcggcggcggttgcggcggcggaggaggaggagagcgcttccgacggcgagggcagcgtccacaagagcctgacaggtggcggcgcggccggaggacacgtcgagacggcagtttgaagagaacgagccatgtgatgtgatgggctgggccgcgcgcgcggaaacgaagggagggagcgagcggtgcaacaaaaggaaaagaaactgaagcaacaaaaagaaattggcaggatgcgatgccattaggtgtagttgagtcatgcatgttgcatggattaggcttacttgcaagggacaaaaattgttgcatggatcagtagaccgactgtctgtgcttgtaactgatgggttagcttgatttgttcagagggtgatagctgttggtaggaagaggctcccctgacttaaagtctgaggagacatggtcactgacatgtgggcctataaagatgggccccacccgttagggttccatgtctctataactttacgtcagaggagctccgtctctattggtatggctggtgactagttgtgatggagggttcatttataccgaatcgatagtccctccgtcattcttattctagcgtttattttcatgtttaaatccgtgtcagttttgtaaaaacttgtcgttttagcattcacttttcatgtctaaatccacgtcggttttataaatagttgtcgttctagcatttatcttcttatccaaatttgtgtcggttttagttaattttggcatttatttatcacttttgctactgttcagtcaagtgagattctactaaatccgcacgacatcaacttcctcgaagagcccctcaacgtcctcgacaaccaaactctagcaagctttgccagattaattaggctttgggggctagcaacgaagggtgagcaatagaagaacaataacactgtgttcgggaggtgagattggaacctcacatcctgcgcacgcaaaacggagcgacatattttcttatgattaattaatattatttttttaaaaaaaatggattaaaatgtttttaaagaaactttcgtacaaaaaccttttataaaaaacacaccgtttaacagtttgaaaagcgtgcacggagaacacgagggaggtgagttcgggaaggtggggaagaacacagccttagggtggtttgggagagaatgccggggaagtgggaggagatgggcgaaaccatattcataaccgaattcatgttgattttttattctagcatttactttcataaccaaattcgtgttgttgttgttaacacttctcattcaagcatttgttttcatccctaaatccttataggtttcatgtccatattcatgtcggcgttacactgagtcaaatttgattcttgtttgatttttattcccaagagctggatgaacacagcatcgaagccattgatatgcagaatgcaagttgagcaacctcgcaaacctgatgtattatttttaaccagcctagcttctcaccgtcagcaatcagcacgaggattgcacactgtttgacggtgatatgtcagtgctggagatggatcatgatttccatgtaaatgcttgtgcattgcatgattagttcttctagcttgcatgctccgaaacagttttgttgtatcatccattgttgtcgattgatggttcgttatccaggcacagttcttttaattccgttcgtacttttatcctgtgtgttgcatattatgtctctatgatgtgtatggaccattccttatatccttacctttgcaaatcaacagtaggcacctgctcatcaatgatcagataaacaagaaactatggaacattgattgagtcatctaggcctgcagagctcaaagagtcccaagaatgcaattgatagtgaccttggtccatgcttagctcagtatggcttgatgtgtaagtgtaactcatgtcagcaaaacatgtgacatgcccaagtgcaaccaaagggagtaatgttcattacagaaagaatgatgatccaaacagataacatggtacaatagaatgtatactcaagaccgaaacccaacatattttgagccaagcgcacatgagtaaagctgcaaataagaatcccattcaaagtgttccgctgttaggacaaagctttcatgataatacagacccggccgtcccatatgtgtctacaagacgacctgatacaaaacacttcaaaaaaacaaacaccctcagattagaacacaaatatcagacacatcacatcctgtcctcccttctccgtggagcacaagtgacgatctcatcgaccctgagaatcatctccgctgcctcggtagcagacataagaacagcttgcttcgccttaaacgactctgatatccccagcttttccatgtctccaacctgcggaagaagtcttagtatcagctccaacccctagaacaaatgtaaatgcaacttctgatatgcactagcaaacttacgccgccagaaatgacatcaattccagcagtgctctgctctttgtgatgctctgctctgagctgagagatcagatcagcgctatccagaccagcattgtcagcgatgatggttggaatggactgaagagcgcgcgagaaggcttcgatagcatgggacttcttcccaggtgtctttctcgccagtccatctacttctttggccataaccatctcaggccatccaccaccatataacacacgggtgtcgttcactgtttgtgaaagcacacataaggcatcgtgcagggacctctctgcttcatcaagcacatgctcactgcaggtaaaagcacacagtcaacacaagctcaagatggaatatagattaatgtaaagaaaaaagaagtccaactataggcatgagcataccttgctcctctgaggacaatagtacaggcttgccccatttcaaccccagagaaatgaatcagcctgtcctccccaatcataatctcttcaatgaccttgcaatgaccaagtttgacagactccgggttatcaaaagtggaggcgatgtcaccaccagtgacaagagcaagccgctcaatgccctcaaaatcagcatgctcgattgccagtatgccagcatctgcaaagagttcctcagggaagttgtagatcaactgcctgttaacgaaacagttgattccatgacctatgatcttttgcactttttctctcattttttgcttttcagcagcttcaatttcagcaaccttagccattgaatcaacccgtacacgtgctccatatatcttaactttgtcggtgtccatagcagtatttgcaaccaaaatcttggcgttttcaatcctcttcggttggccaagaccgattttcttgtctagaatgaacctacaaaagaaaaaaaatcatgaaattgccacctcaagagcaggacttcagtttgatctgctcatggctgcttccaacatatgatgatttacataatttcaaaatttaattagtctgcaatgaataaatatcatgtactactttattcttgaacctaacagatgtttggggtcaataaaggttggatactgaaggaaattttctccctaaatattgtcaaacacaattctgacatacccttcatccaaaaaggagtcctttagagaccctccagttttcttaagaatttgaattgcttccaagttggtactgccctgcaattcagtagtagcacacacaaatcagaatctgcagtgacttaaatgatggtataatgaaaagtatttaaggcaatatagcggcagaatatgtagtaacagtcacaaatcaaaagttcaaaacaactaactgcaaatatatagtataaagcattaacaatttcagtaccttaagtcttagaacagcatcaactgcaagaccagcaaagtattccttgtcctgggaaagtatttttgaactcaacgttgtcatagcaatgttcatcagatctgatctaaacttatctgcagtaacatggaattaaaagctgaatattagtggtgtgattcaatttatggaagagatgctagagtgctagacaaattatgtactgtgaacacaaacaagcaatcaataaatggtagatcttttgagcaaacttccatgcataaatcccaggaggcaaaacattaaatatataggacatcttcagtttaaatcaataaaccacatgcgtaaggaaatgtaactagcctgaatcttccttgttatccatggccctctgtaataaagcatcacgagcacattcagcagccatcctgaaccctgaaattggtgaaacaaatccattggacaggaaataaaaagtttaatctgacccatgtgtacagaaagtgatgctcaatcacacgtctacataacatggatgaacttcttgcaaaaaacttttttgtttattgaagacaacccatgagcaatagaatgtaacagtactacgaacttgctagtgaggaacatatgcattacattgcacatgattctcttgggcacagtcaactctaattatgatctagatgaggacttatgccgtgagaagacaaattaaactccgattaagcatgagtggtctaattgtcaacagtaaatacgtggcatcagtatactggtgatcatgtagaactgaaatatacctgcaatgattgtcattggatgtatcttcatatttaccaacttttcagcttccctcaaaagctcaccagccaaaacaacaacagaagtagttccatcacctacttcgtcatcttgcacttttgagatgtctgaggcccacattaaggaataacttttttttatttttgcattataaagattggccaacaagaagatccaataaattatcaaaaatatgaagtaaaaaacacttcatacatatgaaacagagatttaaaacagtgatattacctaaccggtgtagcaataaaaaagggtcaaattaaaggataccaacaaggaccttagcagctgggttgtcgatatgaagagacttcagaattgtagcaccatcatttgtaacagtcacactgcgtcccctgccagttgattgtaggatcttgtcctgagtatagaacatagaaaggcggttatgtgattacaaatttggcacttgatgagtagattaaaatttgagccaatatcaggggtgatagtttgcaaataaatgaagaaaaccaggatgctttagatttttgagcataccattccttttggccccaacgttgtcttgaccaaatcactgattgccataccaccaacaaaggatgcctaaataagaaacaggttagcatgcaagacttgcctgaaaaagcatttgagtctaaaccattttcgttactgtcagtcagaacattcgccaattccgaatgagaaatttataggatataccagtaaatgtaatactgtggcttcaaaagcaatcagtattagtattaaagcataaccagtaaggcagaaaagcttggtcaccattgggacacagaacaggtatagagtttttggttgtgaaataatcaggaatgagccagagccaagaactagagagcgtttggctgttctataggcagtattttggtgatgcaggacccaaggaaacacatgacataaatggatgtagcgtcatagcatagcactgcagagacaaggatggaggaattgaaagggcaatgatttgaactaaccatcctggcacgctctcccttctcctcggtcgcatcatccttaagcagtctatcaacctggaatatacgtggaaatagagtcaaaacaagtacgcaaacaaaagtgaggtgcagagggaagagagaaaacatgataaattagcttcaatcataaacaaggaggagcagttgaacagggatgtcgatggatcagacgattggatgtgtactgattgccactcgtaaatgctactacgagtgttcttaaattgttgcatctatatgacaatgcacacttaagctcaagttttcagtatcacttaataccagcgagtgatcaggtacctcggacggcagtaactagcattctaataacagttcaaacaagtaatagctccgtcaggtttcacagtgccacattccatatcaagcacaaaaaataaatccaaaaaaacacatagatctaaggaataccacacgactacgggcatcatttcactcaacacaagctaaaaccttcgcaaatctaactgagaaaccatatctccatcgcgcggaaaaggaacttgtgataaagccacaaatcaagaatgctccagccacgaacggacagaaacctaaggctccgcagatggagagcaaggatcagaggagccatagagtagggaagggcggccgtaccatctcgtcggcgaggaggaggagcttcggcaagcggcagttgcggcggcggcggcgacggcggcgacgcgagtgagagatcgagagagtgagggagagatgcggcgcgtgcaggtgcagcggcgagcggtgttttaggtttacaattgggctcgcatttccggctcatcagcccaataaccatccaattgtatgggccgagagctcagcccatttaaacaaatgcgacagtagttgggccagactgtgtgggtctcgttagaatttctcccgagatggtcctgagtctctccctgacctgaacgttttttggtagtaaatggatcaggaggctgcgagtctgcgaccgaccaacgtcgcagtcgtagacgcggcggatggatcttttcgttttatccataaataaatcggccgatcagatcaggtaaaataacatactataaaccaaaaaccaaaggtaaacatattccgtggaaataaataggagagggaaaatcagcgggtcatacacatttgtagccagctataatatagacttcaagacgcaacatgtgtattataggtaagaccagatattaatagtgcattatatgtttacaagtaactattatatgagtaaatttcagaaacatacaactttaatgacaaaactatcagtttgctacaacattagtagcatgtttcagtttgatgtaacaatagcgtgggaaattatcacaaaactgcaacttttacgctatatgctgctacacgtaaaagttattttgtgataactagctgggtggccagcgcaattgcgcggctagcacctacaaaattatttattttaacacataaattttattaaataatcatctcattgtattatgattttaaaatattgatccttattatccccgtgtttctaattttatatatttttaaagtcacactactcgctacctcttatttttttcaccccctttatttttcatcggatctatacaaattatatttatcctccttataatctttaaagtttagacctttttgtttctaaagtttaaaaattggaccttttaacagtttcatagatatgtctggtagtcacgtgtgtgcacttgtgctgtgtgtctgaatttttatgcttttttatcccaaaatttaggtattatttatttatatttgttggtagagttgaatgtttaaagcagtataaaaatactactgccctcgtattttaatagatggcaccgtttacttattgaaaaaatttacataaatacaattgttttatcattaaaagtattttaagcatgagttatatcctaagtatttacgtaaaatgttgaataaaatacatggtcaaatatgtctctaaaaattaaaggtatcatcaattaaaagtaacaggaggactacattattttcaagcgcaacaacattttctttttttaagtcttcgctctcaccactcaccacttcaccggtcagtcagtcatgtttacctctctcatcttcttttccccacttccacttccttgcttcctgattttttccgcctccctctcttctatcatcttttccccacttgcttcctgaaaaatttccctcgttctcccctcccagtggccggcgccagccgccagtcgtcggttgcttgacttttctcggtgtccctccctactccccgtccagcttggcgtgatggaaacgtggaagggctccagcctccagggtcagatccgttctcatgcatcagaggtgtgcggttactgtgtgcgacgaagccccgaggtcccttaggcgcagcatctcctttgctgtccatgcttggagcagtggatctttcaggtaaatagtaatgtgcattcatatcatttgttttgtctcttatgcaaaatatcaagttctcgtcttgcttgttggatgtttgattggattcgcaatgcgaagctcacaggattcctttggggatgtcataaaaaaaattgtgctcacacactccatatccatccaaaatatttgacatcaaaaatatttgacgatgtatggttaatcgagattatttcagtcttaaaacaaataccattgaatgagtagctaataaatttaacaaatatgtaaacatgaatataaaagaagaagatgagcagaacataccaaagggccgttgtgagaggaagaaaccgaactggaaaaggctaaatttgacgataatgatccggcgacaatggcgtcctggacatattttttgctgctgtgttttgcggacacttcggttgtgttgattgctattgacatcttctcttgttgttctggttggtgactccgttctggtgcttagtatttattggggagtcaatcaagattagccaggaatcggtgaaggctggcagagtcggattgtgtgtagggtgtttttattttggaatctactgtcttattgctattattgtcgtaattggtacctattactactgcacatgtcgatccgtgtatgatactatacccgatttatagtgcctgatatgtctgtatacgtgaaaccaagtctaatgttccaaaattttaattaaatctcagccattaaaatataggccatcaacgatcaagcggtcgatattttttctttttcttcgattaacgtggtaatttctagtctctacggtgaacgtggtgccttcttttcgagctgtattaatagtataatagatagatagattttccacgctattgttgcagtaaaacgatagttttatcactaaagttgtatatttctgaaatttactcctattatatagattgttaaattgattatagatgatttgaagctaataattggctatactatttactttaaccttgctctcgggctcagcgcgctgtcgctgtggaccacggatcataaccacgtactagcatcatctgcctgcagcccggaggcagcggcgaacaagcgtttggagcttgacgttttccgtgtccccgccgggagatgcgacgtgacgggcgatctagcagagagagagagagagaggaccagccgctcgtcgttttcgccgcctcggattgtccgtcagagcgccgcccggcgaatcgcgcgcgttgggagtttttgctcgccaatttcatccctccctccccccatgagctccggtgagatccccgaattaatccggctctacatctcaatttctcattcttggtcttctcaactgaagaaccaaactaaagagagatacgcaagagatcacacgcctcgcggccaatccaccgacacgcaagagagatactgaactactgaagtgaatgaaatctcaccgaagcaggagatgatagatcacccgatcggtaagcaagttgcagggattttttgccattttggccgtggacgaggcacggcagtggatggcggctcacagatgacgacggctgccatggagaggagagaagaagaatccaaaacccgtttggtgagcaggggtgccctccaccaaactgtgcctgtgtcacccaacattaatctgcactctacagccgtcccagttatggtactcctagactaatactcctgtatgcactggtcgaactgccatacggagctgcatgatggagtaaccacggagcctcaaagcaccaaacattgcccgtgccctgtccctcaaaaccgagagatttgataatttaacactccacaaaattgaggttcaattatttgataccctatccatttcccttcactcggatagtcccacgtgtcattctcataagtatcaattaaaataaattgataatgaataatatgtcaatttgtcaaatttctactgaatttccgcgtgtcattcgcatgatttcctagtggaacagcagaggttagcttcagtctaaagaagcttgttgtattccctccatttattaaatatacaaaagtagtttatttgagagatggggtacagtagcactataatcatatgagcattgtttgggctctgggcctctgatgacacactgcctgcgagtcttcaaccctgcaaccacagccggaggtcagatctgcatctgctgaagccgtacgaggttgccagcaaatgttcctgcaaaagagctcgccgtcgcaatgcacggccaatagtaaaaaaaacacaggcagtctatgcagaaaaaatgacggaagaatgatacgcagaattgagcgagctaacatcagttttctcctttcttcttcctgagactctgaatgtctctgacagtctaaaactattcacagcccaccaccatcaccacatggcaatggccatggatgtaaaccaccaaatttcaccaaaacaaaaaagagaaaacaattagaaaaaaaaagccgcccctaatcacccagatttacaaaatggaatcgaaggaacagccgaatgaaagtttttcatcatcctttttttgtttgtttttttctcctaaaccaaaagaaggctcatgcttgcatcgccatccatctttgacctatcttcctcctcttcttcttcctcctctactgatcttacgtttctcttttccgcgatttttctccaggctccaacgcgaaattcaccccacttgtgctgctatctctgtgcgtcgcgctccgggttttcgcgatcactcggagtcgctgtccatgctctccatccctttcagtcccctgtatttttgttgctgcagaggagaggaacaaagaaaaacacatagagatattagatttctcgtcagaggcaattgcagattacgcacaacacaaaccgaacggcgagtacagctgttagcaaaaacacaacaagagacaaaaggtctactacttggcacaagtaattcgacgaatcaactaacgatgacccacagttgatgctgattattacatgtcctaatctaacttcagaagtgcaagagaagaaagaaccccacgtaagcagaaacagcaacaagactgcacgagggacccacgtgtcagtgagccacaacgagcgttgcggtgggtcccacctgcagggtgaccgggacagcacgcgttaagaggctaccaacgtgggcccacgtccgctcgtcggcaaaagataataaagtgcagagatgccggttaagcacagtcatcaatgagcacccctcgcgcattcacgggcgtgggccccactcgacataggggacggacggacggacggatcgttttccctttcgctttttttcctgccccttcgctttgatgctttctcaggctttcccggtaattttttattttcaccaaattttacgcaatttcagacgatactgccaaatactagtactatcgatttttaagtagttaggagtattactgaacctatcgatttttaaatacttactaacttgatgcaaatcagagaaagtggatgtggataaaatcgatagaggagtatatgtaccttcttggtggacttcttctcgcggacgatatacttggatctggtcacatccgagagccacattcctgggcagacgaactgcacaaatacagaacaaaaaaatcatgtcagttttctcatcaagaccatcaagcaaaaagatggtgtaaaacacagtttgattaggtagcataatttatccatacgttgacttgcttctcgacaagcttgggcctcttcttgggtcgctggggcagcttggtgcctttcatggccatgaagtcctcctccttctccttgcgcgacagcgtcgtgtagatccgcggcagctcgatcttctgcgccgccgctgtcgccgccttcgacgacgagctgggcccatggtggtcggcggcctggccgtggccgccatggccggtgtggtgctgatacttggagtccgtcttggccagcgccatgaccaccccaccggcctccgccaccctgtgcgccgccggccgctgctgctgcttctccgccttcgtcgccgccgccgactgctcgccggatctgatcatcatcatgccgtcaaattcaagcatagcaacaaaagcaaactcgccactacagcggtggatgctggacacaacaacaaaaacagaaacttttttttgtgtttttatcaatctatctatcttagctctagtggatgcaagagcagccaggtgaaatggtggatgcagatgaaatgagcacagcagagcaccggcaaagcgactgccagatgccaacccacataaagagggaggagatgagaatgagatgagggtgcatgtgtatgtgtgtgtcctatttttatacctatattacatcaacaccttctatatcagctgcctgaagttgatgtcacggttgatcgttcacacacacacacatggcacatcaccacaccacatgaaccaaaagaagccattaatggacatatggattgcaatattgcatacagaaatgaaatgctagatcgacatgaatgggaatgagcccacagattagcaaagaaaagaagaggggaaagtgctctcctcctcgcttgatgatgatcctgacatggacatggtgacagaggctagtagtacaaaaaattgttgcctaaaggatctcgaaaatcaggaaagagaaattctaaaagtcgtttctaaaagcagaagcaaccgagtgattgaccactagtccgatcaaaccagtattgctactacatatttttattttcattgctcttgttgtacaaaaaaaaaagggaaaaaaatggtgtggaaagaaaagaggagaaggtatcttatcatctaaacgcacctcacctcggttgctaaagatggagggggcgtgacagctcagctcaccatccagagtgtgagagagcgggagacccgagccgagccgagcctagagccccactatactagaaccaaaccggaagcgatccgatgccggcgaccgcgaggccacgagcccgagaatacggctcggtccgaggggcaaaaccggaagagtgaaaaattcggggaaaaggaaaaagaggaggaagacgatgagatgatgggccgggccgggccgggctatccaccgaaggatgggtaagtgcgtgtacctgctgttgtgggggagggcggagcggccatggtggtgggcgtc

SEQ ID NO: 20681 - DNA, 10166 bp, Oryza sativa
cagacaagaacaaggtctccccttcagaatggaggatgaaacgaacagcaaaaactctcctttttcgcgagaattcgcgacaggaaaaacagtagaacatccccaaatttgcagagtgcaaaatcgaagaccaaacgaaaccattcagagatctgttcgacacaaaccagcacaccacacaaactcgagaaaacgctgaaaatcgtggatatctgaaacaattaggccactcagggaacgaaaaatcttcagccgtgagctctcatccccatcagcacggagccgacgaagaacaagcacaagaacgaaatcgacaagttactcagaaaccagtcaaagtgaccatgaaatggggaaaaaagcaacgaaattgcaacaagcaaagataagatacagccggaccgaacagggacgaattggcaaaatccagcagtaaaccgaacatagatcaaaggatgccttttgtcaaacaaggaaatcaagacggcacacgaacagaaatccgacggcgagcaagaaaaggaatgaacaaaacttgcctaaatcgggcggcgagagccgaagcgacacaaaccagaagcccaaacgagcagataaaatcacacctttgatctcgcgaaagaacgcagcggcagcagcagatagaacacccagaagcacggcagcaacgaacgcatcaggggattggagattccaggcctcacctcatcatgtccaatgccgatgggggtttcgccgggctcgacgacgcgacgtctcgagcaacggcgacggcctcgccggagccacgcatcaaatcgatggcctccttccctctctacctctcctcgcccctcttcagtttccccccaatcacacgcactctctcccacctctgcgcctcactctacagatcaaacatctcgagccgagaagccgaggagaaattgcgcgaagaaatgagtttcttggtgaatctaacagcgagaccagaagagaagagaagagaagcggagcgagcagcagcaatggcgatggagaggcgagccagacggcccaaggctttatcgtttccactcttccaacaatgccctccattcctcgcacctattctcaattctgccacctctacgactgcacctcgaggctagggtgtagatgtgattagcacaagaaccagtggtgttcgagtaaaatcctccaatggcagggagtgtgattagcaccaaattctctggcctaatgcgaaacctggcccatgccacagtgcgggattagctcagaattccggggggcggtttgcataatcacgcgtcttcttcagttcatccccgtgctccgttctgcaagccacccgagaaaattcctagcgccacccaagctccgagtcatccacacgatcagtcactgacagtgggtcccagctcagctccgagtcacccacacgatccagtcactgaaagtgggtcccagctctgatccgagtcacccttgatccagtcactgacagtgggtcccagctcagatccgagtcacccttgatccattcactgacagtgggtcccagctcagctccgagtcacccacacgatccagtcactgacggtgggtttgtcctcgcagcacctgcgcggacaaaatggacactgccgtgtgggtccagcaactacgtggccccagaaaagcagagtgatatacatctcgtgtgcgatttaggtaggagaagacgtgacgtgggggttggggacggacggccaggattggatagcgtgaggacgtggatgtgcttatccacttccacgtcacggattgatgggtcatgtgagcgcgaagagggaggagagcgtgaggactccccgggtcttgcgtggccggtactacgactacgagacgccggtttccagagtttcttacttttcagttaccaagaaaaattagttttatccaatccaaagatgttttagaacaaagtaatgggattggtaaaattctatacatggatcactgttctatacgaggaatacgggcctgtttagatccatttataatggcaaatggcaaaagttttggtggcaaagttttggcattgcaaaagtactagttggtgtttagatgcatgttaaagttttgtcatttctagcactaaagtgagagagagaaagagagagggagtggtcccaaagcactttttggcacaatttgctactatggactagcaaatgccaaatgccaaactgccaactttcgctactagtgtttagatccaaaatggcaaaaagtgctacaaaatagcaaaacttttgccattttagaggaaaacagagcctacattgatttcctgccttaacttacttagagatccagttcattttgaaatgcataattgaagaaaacaaagaaatataatttttgataattaaatgccatgaatagtgaggccatattggaagtgaatttgaggtgtttggttcaatcatagaaaaatcacatgaatttcaattttgaatgatttagatatgagagggaagataaagagacatgttagcttggacctatgagaagaggaggaatataaggataccggtaggaatttgataacctcggcagagaccaaggcccacttagtgacggtgacggagacgggccctaggggacggtagcgactcactgatcaggcagccatgcgaagaagctcgagagagtttagcaaatcagagtcgaggcagatccaagcgaattgtggtgcagatgacgatgagaaagaaaactagtgtggttggggggaacagctccatgcttcggcgacaacttcagccctccgatcagagatgggacagaggaggcataggcccagccaccagctgtggtgaccaagcaattcactatcaagcgaagaatgaaaaaactaggaggagtataggtcaaggagatcgggagcgatggatatataatggcttgttgttgcctaaagatggcatggatgcatagacgatgacgaaaagctaagcgagaagaggtggggcgcccccaagagacccatcttcctaagggcggcagtagtggggaagtttgtaacggcactaaaccacccgctataatgacatgaaagcttgtgtgagagagatggtaacgtgtaatgtcggttgttgcgttgagcatcgaggggcggtttatatagagagatagaggaaatatggaaggatcaaaatagaagggcggactcaatacaattcaatcatgttttaaataaactctaacactaagaaccagcaacaatataagaatgtatttgggaggttgaggatccatgtagctagaggaaagacaaaattgtatttcttgcattgcaacacaaccattgaattcaatatactcacaagatttcttctaacaatattttctttatatgtcaatcatgtaattgccatctttgtaatgcctaaaaaccgtggcatgggtaagaaagccacgccacggtttgtataccggtctgtttgtattgaaggaacagaaagcacaacaatatccccgcaaaaaaaaagaagaaagcacaacaatacacattattacaagtgatccacactaaacatagtttttttctagataatggatggttatcattgtgtcaaagacacacaaagaccaacaaacacactattataaatggtccatgctaaatgtagtttttattggtaatgaatgaaccacaaatacatcactaaaaaagatccacacaaagtggagtataaataaataagacaagctgctagtattaatatgataaacaaatgccaaaatttcaatccgtgttttataacccaaagttacactccttcagtttttatgatattttccatgcacattggtgcatccatatggggcgaaagacggagttcatatacccatgtgtagccttagggccaaatccagtggtatgaaagtatggaatccccaccgttgcaaaggaagggcatctctctgtattcatcaagtgtggtcgttaatgtgattgccactctttggacctcttcatgtcaccttcggagtttggattacgggcaatttcatgcctaatataatccattcagatttcagaccgacaccggaactaaatctcccgtcacgctgcatcgcaaaaatatcccaaacctaccctcattagcaacgtacgttaggctgtgctacagtaggatcggtttccttgccttacttgtacgaaccccaatttggtgttttcctgggtgcgaaatcaagtcgtaaacaagccagttgacacaccaaatacgcacgtacgctgaccgcagcaatgcaggtgcaggtgcagccacagagccagcgcttgccgtcgctgatgcgcgagttgcgccattgcggacgccgagcggactgcgcggttgtggcatgcagcgggccgcttggagcgcgtggcgtgcgtgggctgctgcggctgctttgctttgctgggttgggcggcaccggcgcggcctgtatcagcgtgagcctgccgcccgccgcgcagcctgctgctccaaacgaattcagatcatgtgtgcagttatagtaagtagtaacgaatgcaactttaacagttgaagcacattataaccgttggattgatggagctaaaggctcagatttgctgtgccttgctattacacattcacaccttgatgatatagtaatcgctacaggagaaattcactacagtaattcatcttttctaatggtctgagggcccgtttagttccccaaatttttttcccaaaaacatcacatcgaatctttggacatatgcatgaagcattaaatatagataaaaagaaaaactaattgcacaattatgggggaaattgtgagacgaatcttttaagcctaaatagtccgtgattagccataagtgctacagtaacccacatgtgctaatgacggcttaattagtctcaaaagattcgtctcgcggtttccaggcgatttctaaaattagttttttcattcgtgtccgaaaaccccttccgacatccgatcaaacgtccgatgtgacacccaaaaattttcttttccccaactaaacacaccctgagctgttggtttttattcatcagctacattgcaattgctaaagttgaaggcatagtaatgactgcacctgaactcaatccactccaagcggtggtgtgattggttctgaacttctgatccggatgtctcagagagctcacagttttggggtaagaaaatattttaggggctagaattccaatatttttaatgaacattttaaggttccgtttggtagagttacaaactccaactccagtggaaacaagctccaatagaaactgaggtgggtatagaaagtgtttggctagatttgtcagctccacgccaccacatctcttgtcgccatttcatcgaccaccttgttgacgtcactgcctccggcggtcagaccacgcgtcaccgacgccactccactcgcgtgccgccagcagtcagcccgcgcctgccaacgccgctccgctcgcgtgccgccgccagtcagcccgcgcgtcgccacctactgccacgcgcaccgcttcacaaccgcgacatgcgcccgccgtcgactccaccgcaacccttcgtcggtcgtcgcctaggtcgggaggaagatggggaggagagagaacgagaggagaggggtttgaagggggtagttcattggcatttttgtgtaaatacattaaaaaaattaaagggtagtgggtcttttggaggtagagtggagctgtggaggagaaaaaaaaacagctccacccccgtaatacaaatttgtggagcaactctactaactccgctccgaaaaatgaagaatctgtaccgtttggcacaactccagctttaggtaagttggagttgagaactagagctgtgccaaacgggacctaaattctctagaagtcgttggcaccactttgttgtcgctacttcgtttggctagtcactctaaacatgtgctaggtggccgaccgcctccgtagtcatgggctagcacacccctggtcgttgtgtccttttcgatcagcaagaggacaatatcaatcatatcttggtcgtatgcccggaagactggcgctcaaggcaattgggtagtcatacagtctgtcaatgcgtgagaacttgttttactagtggctctcaccaaggttcttcgacgaaggttcaacactattgcaactcttgtagcatggacaatttaaaaggaacggaaaataggatgttcaactttcaacagagatcctgggcggaggtagggaaggctatggctgcggaaggcggggcttttggtgtttggctaatgtgttaatgccgacgttaggagtttagggcgtgtttgcttgctgccctcagattcgcgcctggctcaggcgtcgatctcaggcgtccaatttcggtcgcctgcggtcggatcgacctgcctgagcaatggtctccaggcgagggcagcaaccaaacagccccttagctactaggggtcctggtgatcaccaaccaacttctgtagcgagaataggttttcgcagttttgctcttttccgtttcccctttcccgttccccttctctttttttttgtcttttagtgggctcataaataacttttatttctcttaatgcaaagatgtgcttattgaatattccaaaaaaaacatcttgaattttgaatatatttttgctgaatctgtttttttttagctgaatttttttgatcggtgccaagtcctaccgagatactcttgtgtattcaacattttgaaaatttcgatcagaaatgtcctgaactgtgaactactatctggtacgctgtaaactcctagcagcagttgtcctatgcaccatgaccgtcattgactttttctgctaagcaagtggtcttacacctcaggacagtgcatctcagaaacaaaaacgaaaacctatcaattgtggcatagtgcaattgcacctgctcacgcttacactttttcacagtttcacttgacagcaacatgcagaaaatcgaacagcacagaaggccaaaaaacaatcacaacaccaccagagctaagacacagtccagcgcccaagggcacaaaaaaaaaaccaaaaaatagtgggttcgcggcatcaacggcggccgccggcgccgcgcctagtacgtcggcgtgggctcgctttccttggaccacctcgtccgcagcatgaactccagcccgatgacggcgaggaggatgatggcgaggttgaagccgtacccgatcttccacgagttgtccccgccgccgacgtggataccgagcacgatgttgacggcggcgaagaacagcaccagcctgcccgaccagtggtggtaccagttccaatacttccggtacttggagtccgtgttcggccgcaggaagaacgccaaaatctgaaacatttcagaaaatcatcatcatcatcagttcatctgttctgttcatgcagtgaccgtgcttgctttctgcaagaacggagcagagagatgtgatgcgtgcaatgggtgacgacctgaaggatgccgaggacgaggatgaagatgccgaggcccctgtgcgccgggatgtcggcctggatcttgttgtagagggcaactccggcgacgacgccggcgaggccgatgatgaaggcgacgaactggacgccgacgtggaggtagaaccagagagggtccatccgccggaagtagcgcgccaggatggcgccgatcggcatcaggacgccccacgcgaacaggttcagagcaccgtgtgccctcctcagaccgtaggggaacgacccgtccacgaaagctttacctgcagattcatcaactctgctgtaaaaaaaaatgttttcgaaaatgctccctcaagtttcacaactatcggcctcatcttttcgcttatacttatacttaccagccaaaatttaaattttcaacatcaaatttaaaattgattttggggtttttttcattaaagtttatttttcagtctttgtttttaaatcgctaagaaaatatgtataaaagttttattcacaaattatttttcgtttgagcgatacgatggggccgtatatttaggatgcaacacttgattaaatatttatatagttttttaaaagataagtagttaaagtttaaagatgaatatgagtagtatccaataagaggtctagtatttgaagacggagtgtgtaaaagcatcttgttgtgcacataatgccaccaaggaagaatgttgatacggcaacagaaaagtggcgactgacgactgaaacttcaagaatcaaacacctttttcgctaactgacacattgattacagttcaagtgatattgtcagctcattttttatggtatataggatcgactaagatgtcaactgtaatttgttactcctattattcaattttccagttaggtgcaatgtcattcatcaacagatttgctaaccaccgtcagggacttcactctgaacctcacacatagtgcagcgaaaatgtcaagttgtccaaattaaacagagggagagaggagaagatcaagatcaggttgatgagaagcatataatatactccctctgaaaattataagacgttttgacattggtcaaagtcaaactgcttcaagtttgactaagtttatagaaaaaataatattttcaactcaacgtaaatttattatgaaaatatattcaattattgatttaatgaaactaatttagtattataaatattactatatttatgtataaacttagttaaatttaaagtagtttgactttgacacgtcttataacctgaggaatatatacgtaccagtggtgaaatcgaaggtgaaggatgtcttgtcctggtgcttggtgagcttgttgttgacggggatggaggagccgaaggcgaggatgatgtgctggtgggtgagtcggtaggagaactggagctggaacgcgaggtagatcctggcctgctgcaccacgacggtgtggtcgtggttgttggagttggagacgaggaagccgcggttgacgaccaccttgccgctcgtcttgccgcgcagcgcgaactgcttgacgtgcgggaggcccttccgcccgatccacccgaccatggcgctcgagcccaccatgaggccgtcccgggagaaccccatccccacccaccccgtgctgtacatcgtcgacagcaccaccctcagcacgttgttcttgtcttggtgatactgcgcatatatgcattggagtatgtgagagtccgaatttttagaaaatggaagtgatttacattgtcataattgtatgagagtctgaattgagattgttttggaatggtagagtcgaaactaactgtaacacttcaggatttttcttggcaattgtgtggtttggtttgctcgaattcactgttttactgtcactgaaaagttactggcttactgctgcactagcgaatcatacatcaatttcagttgggcagttggcaatgtcctagcaggttaggtacaaactagatccacctgaaatccttgcagatctcagctcattgcaagcacacgcagagtactgaacttagagctagctatgctcgaacagcgctacacaacctcaattatgtgctgagaagaacaggtaagaacaatggcggtgggagaaaccacttacccggagcacgaaattgttccagaccggctggcaattcaggccggagtagttgccgacgagcacgcccggcagctcggtgttgcagctctcctgcgccgccgccgccgccgcgaacgccaccaccagcacggcaaccgccgccgccgacacgcgagccatgctaaccaacctccttccaagacaatggcaatggcgacactagcttagctgtgtgccccgcgcgcggcagcaacgcgagagagagaagctgcccggtttaggaggaggagagagccggttgatgagaggttgcagtcatcagttggtggcgctttggatgagctagtagaggagattttgctggtggcgtgtcgctgcggctggggccccgtggcctctgcgcgcctatgattggtgcagctagcggaggaggtgtgtggttgttggtggtgccggtttgggtgtccctctccttgcgcgcgcgccccgcgccgtctcggtggatggatggatggatcgcctcca

SEQ ID NO: 20682 - DNA, 7324 bp, Oryza sativa
taagctctggtgaaaattaccatatagtcctagctggaatactagctactttgaataaccatgatgagtagtcatttcaaaccaagaatacacctgcagttcctgccacggtggaatcatggatgagctgctgttcctggaaacccgattagtaaattttgaatcgtacgctgttgcacggccccacgtttatgctccttgctaaaacatcaagcattgtgggacaatggataggaagttaaacatcaaatatactgggacggaggtagtatttgtgtagtgatatatcacatattaatatatctactcatttttttaaaaaaaaattataaccatttgaatgatatgtaaataataagtgaacatccttttaagagtttaaaatagttttccctatcaagaataaagtcatgtgattttgaagcaagaggttctgatccgtttgctactgctgcgccgtgaacacgtgacatggattgtagcatattcgtaagagagtttctatgtgggagggaggtgtggtgaatctgtgtacgtgctgtgagattcgggttgcttctgttaggagatgcagaattccaggatttgcagagccgtaaccgttaacaggacaagccggacggtcctttcagggaaaaggaaatctgaaggaccgacatgtcagtagatggtgtcaaaattaggcagtccagatggggccattttattgtgacaagaatattgaatgctgaaaattgtggtacaactaagtttttactgattggagggtgcactgtgattctttgtgcttactaccaatctcaaaaagtgagagaaaaaacagtctagctgcttctatgattttgttgaagctgcctgccggataagcctgagggactcagcgaaatcatccagcagctggtgagcatccgggaactgtgcatcatcgacggcgaggacaagcttgataatgttcatgtagctctggtaatgtactgtcagtgcctgcacatattcaaatgaaatgattgggtgctttcaggtgtgcctatgtaaaagtcgaagcactcatgagtcatgtctctttgacaaaaaaggcttgcaatcacaactggagaattatcattggaaatgtttcactttatgcctgaaacttaatcgctacatgtcatcaccaaattaattaaaaacggtgacttctgaacaattatctatgtttcaagcaaagcaggtgataatatatcaatgacgtgtgaaagctgacgtgcaacctttacaaatgaacttattttctcattaaaaaaaaaacaagtggttacttacatgtggatgcccatatacacttggggcaatgtactcgataggatgcccgtagaactccaccttctctgcaggtccgaccatgctcgagaatgacagagtggtattagcgagcatgccatggcagagagcagctgcagtctacagaagttgccatgtacattacaccaatgaataaacagattaattaactaaagacaagtggcctcagttagcatctccggttaatgatcgacaaaattcagataatagaactgctctactaattatcccagcaaaacataacgtagagaatcaataccttaatgccaaaaagtttgactattaggttgccgctccaataagtgaagattgcttccaacgagctcttcttcctgtcaactgttcttttcccctgacgaatatattcaagaggatcgtggaacatggctatacggaaaggaagtacgatgtaaccaattagatttccccatctcgcaacattgttcttgttggaattcatcatttctgccaatacctgctcaaagcagaaacaaaatatccaaaagttcagtaactatcatgacttgactgctaaaaggaactgaaatacccattcatgaaaattataataagagtggacagatcataatgaatccttttcttacatgtaagccaggtgttttcctgatgttaacaagaagagcagaccgcacacggatgtgctttcgtcgcgtacgcttctcgctgttcgtatcatctgaataagttcagaaaacatgacttcagatgcagctagcagtatatatactacgtacgattagcccatgataactttggaggaagatcactcactttctttgcggaagtaatagcgcgacaatgctgcagaagtcactccaactaacacatcattcacagtctgaaaaaacaccaggaggaatgacatttcgtatgatgtttcagagttaagctgacatatgcagttcagcaagaactaagaacccaagaatagggagaagatggtcttacacacttcatggcattcttgacgagcttgacgtcgtcgaggctgagcgtgcagtggacgaaccgcttgcgccggaactcgacgccctccgtccccatgagcggcgtgcgcgcgtcgcggaggaacagcgacgtcgcgacgaagcaggcgacgtcgacgagcgtgtgcaaggcgagcacgaggtaggaccaggcccacgcggcgagcgccacgatccccgccgagagcggcggtcgccggcgtgcgtacactggcccgtcccgccgcgccggcgccggcggcagcgccggcagcctcgccgggtcggcggcgctgcgcgtgcacgcgatgaggagggacagcagcgagatgccgtcgccgagggagtggtgcatcctgacggcgacggtggcggccgcctcggaggtcgggaagtcgaggacgtggagctcccagagcgggcgggagtggtccatcggctgcgtggacagcgtggacatgtagtcctcgatgacctggtcggggctggctgacgtggcggtggggtccagctcggggaagatgaggtggtcgtccaggttcactgtcgtccggacccaccgtggcttcgcccgcttgctcgcctcatccgacacctgcagaaatgcacttcttaaagtgttttttttttaactgtacgctgaatgcgacaggttcagaaaaaagacgatggatacaatggatcaagcattaccgacagtgttacactatgaaagctaatttaaaaatggcaaagcgtttgccttttttttaaaaaagagagaaaacactacgaacacgtactatgcaactaggcatagcaacgctgttccaaaggatttattcgaaagcaattgatcacgtagtagtggggtttacaaaatcgtatcattatcatgattattacatatggtaatccttatagtttttttcaaaacatggtatatttcgtggtaattgtacggttttcgcggtagctatatgattacaatgataaccattaaattacggggtgacggtaatcccacctaacatggttcggtgaaacctaactacttaccactggcagttaacgatttgcaatacgatctggaggcctctagccaacacactacagatgtttgtttcacctggctcgcaatccatacacggggttaacgaagaaaagcgagccgtccccgtgcgtacagtgacggactgacggtacttaattctgacgttgatttgcttcaaatcccgcacgtcgcggaattatgatccacatgtccggtatctgctttcagctggaaaacgtggacgatccatcgcgatgaaagccagcttctcggatgattctctccacattttcatgccaaacggctgctcccggtcataaacacagtagctgatgagtagcgatagtctaggacggctgctctgtatctgccaccgcattaataggagggcatgggtgcagtatcaaaccagctacttcgcgatccaaaccataaatcaggcaataacagcccggttaactaacacaaaagagatttgacggggagtaaaggtgatggtgattcacactgattcgtggcttcgcgcactatctctcgccgggattaatgctcgctgagccaatggattggtcggttcaagcatcagatgacttcgagaaagctagcaagagcattgtacacacagcacagccacttcctacttttgtcccagcttgtttttggccggagtcacggccgccgtgcgtatcctcggaagcagccattctagcccagacaaccgcaagaaagtgagccggcgaggcgccaggagcgtccatccaccggaaaaatgaagcagaaatcaatgcttccacgcggccccagaatttttttttcaagtaggaacaacgtgcgcgtgtcagcgtcgacaccggcggtctcaactccatgtgcgcccgagatgcgggatgcttcagcaaatttaattttgccaccaaacgagcgcatttttttgggtgcaagttggcgatcgaggacgagatgagaaatcgatgcaaagggatcatggagcggtgggtttagttacctggacgctgcagaagcgggggtggcggacgagggtggcctccagcccggcgcgcgccgccgcgacgtccacccgggcgccgagcccgatcaccgccacgatgtagcagttgaagttggtctcccggaacagccgccccgccgggctcatcggcaccggcaccgcggcctccacgtccctctccctctccgcctccgacgccgccgccgatgccatcacgctctcctcctcctcctcctcctgccgcgccttgctctccctctccctgccgggcgagccacgcgagtcacgcgacgacgtgtctatcgagagcacccgcttccgcagcgaggagggggagggggtaggggtaggggaggtggtggtggtggagtgggtggaagtactcgagctggcaggatcggcgtcgagcgaggatccatcggcgcttgtacggcggtggcaagtgtggaatgtggacgcggtcgggggcggcttgacggtggggacagcgacggcggcgtttgggggcttgccttgcggactccggcgtccggccgggggaggaccgggaccgggggttgcgtgcgggttcgcgatttgctgcgtcgtcgctttgctattctatataggcgacgcgaagcgacgtggcgcgaactacccgaccgtgcctgcctgcctttggggttcggactctggacagtggaggttagttggctgggctcggcgtttcgggtagtcgtcgttcttgattggttggttgggctcggcgtttcggctagtcgccgtcctaattggtcacggaacccggaggagttacgactcacggagtcacatgtagggactacggagtactacctccgtccaaaaataattacaaccataaatatccgtgtttagcgttttgaccatccgtcttatttaaaaaatttataaaaaatattaaaaaaattagtcacacataaaatagtattcatgttttatcatctaataacaataaaaatactaatcataatctttttttcaaataagacgaacggtcaaacgttgaacataaataatactaaaattacatttattttaggacggagggattagtagtactgctccacgactccactgtactacagcctacagggctgtgttcgggagggggcctcccggcaaaacaaagcacctagaagtattattgtatgatttattaagtatttactaatttttttaaaaaaatggattaatatgatattttaagcaactttcgtatattttttttgtgcaaaaaacgtaccgtttagcagtttaaaaaaacatgtgcgtgaaaaataagggagtgaggttgggaaagggaggtaacgaacggagcctaatggtaggtataatagcagactattagttagctataaatatattttaataagataaaatatgagagagaagagcagcgggctacaatctgtagccagctgcagcacggacttcaagacgcaatgtgtgtatgacaggtaggaccatatattaatagtatagtaagcaactattatatgaattggctttagattaattgaagctagtagtgggctgtactattaaacttgttctaaattaagagcagatacaataacaatctataagctagctataaacatatctaaagtagataaaagaggagagagaatagcagcgggttacagatttgtagccagctatagcacggactcccagacaagtgtgtatgacaggtgggaccggatattaatagtgtagtatgtaactattgtatgaattgactatagatgacttagagctagtagttggctataatattaaacttgctctaagagctaggctaataatacggccgacttattggctttaaggttttgtagcattctcacagtctacctatataatagttagctctttacaattaatactgggtccacttatctctcacaaagttttttggttcttgtgttcaagccggctgtaagtttatagcccgcttctcccctctctcctctcttttctcctttacctcactatttagtcggcttgcatcctcctattatacttgctctaaatggggtgaatgtgtgaccgattaactgtcaaagaaggcattatttgacttggcaaaaagaaaattctatttgatatctctatataaaaaaagcaggttttgatttgatttgattcgattcgattcgacatggttgtgtttgtttcttttttctccccgtccagtcatcgtcttcgttgattgagagagcgattcttgacgagaaaatgggctttcaaacttccagacccttgggcctaaatacgtactagtagttgttaaacgaggcccagtcgtgtacatcgggcctaatgctgacccaaaactgttctcttttcccggaaagaataagttcaccagaggtccctcaacttaacagcgagatttgttgagatccctaaactacaaaaccataaacgtatacccctaaactcacacaaaacattcaaaggatgtcccatggcagtatatgtgggtagtttcgctgacatgacatcctagtcagcaaattttttataaaaaagtacgtggggcccacatgtcaattacacatcgtcctcttctcctctttattttcttctcctcctcttctctttcccttcttcttcactgagtgagcgcgatgggcgggcggtgggcgagaaagacaacgggtctgcgcggcagctgagcggcggacgacggcgacaagtgagcgcggtcggcggacaaagcggcgatgggcgggcggcgggcagagcggatggcgccccatgccccatggcgtggtggcggagatatcggccgatccggagtccaggagcacagaaagcgtgtaggactcatcgacgacagggccgagcgggacgttggggtctgagacggagagcgcgaggatgacgacagggacgcgagagagggtgtacttggcgaggggaact

SEQ ID NO: 20683 - DNA, 3049 bp, Oryza sativa
ttccgctctttcacccccgcccatcgccgctctgcccgcatcccagcgccgctccgcccgtcgctgttccgcccgcctccattctgcccacaggccgcgcccgccgccgcttcgctggtgcgtggacccgccgcccgcccatcgcccatcgtactcacttagtgaagaagaagagaaagagaagatgaggagaagaaaagaaagagaagagaagaggacgatgtgtaactgacatgtgggccctacatactttttatttttttttttgctgactaggatgccacgtcagcgaaaccatccacatatactgccatgagacctcttttgaacggtttgtgtgagtttagggtacacatttatggttttgttgtttagggaccttgaaaaatctcgctgttaagttgatggatctccgctgaacttattcctttcccggaacggaagacggcctgtcccttagttgggctaagtctggggcagtgctcatgggccgctgaactgatccaaccaggccgaatttgcctgtactctgctgtacagcactctacaagtgaaaccgcgacgacgtagagcgactgccgcctactggcacagaggatcagaggagcgtagcaacgtgcaatcccgctccaaggtggataaatgcttcggccaaatctcaccattttgcaccgtgcatctcacgtggcacgtgaccggagtaacgaagcggagcactggtacaactacgctgtagctgtagcaccaaacggctagaacgaacgaggccgggtttcaaatttgaaacgcgaggtgcgccgcgcgggccccacagagcgtcgacggcgaggtgaccgcccacccgcggccccggtagtcagtccggcagacggacggtccagatcgcccggtgggtcctcctctcgcccttggggaactacaggcgctccagtggctccactagccacaatggatgctagggcaagttttataatagatgtggtggtcacctccaattttatccacatcatctatccaaaaattaaaattaacttatgtagatgcattgtatttaatacactagtcccaatacacttgccaccaatcagccatcttattttctcttctttattgaaatttgtgtgaaggttgtcccttagagcaggttcaataggcttatgtcagccgacgataggaataaacaatttagtttttggctaaggtggagcagagagaacggaaggagagagaaaagctggcgcttaattagtcgcgagctccagcacatagttccatgcatgcatggctgccctgccaatcgcaagagctgatcagattagaagattataaaataatcttttagaggaatgtgctaatgtagctacttgttttacaagctaatctctttccattattttttgttgacatggaacttttggagccggtagccagctatactattaaacttgctcttagagcaaggtcaatagtatagcaactactggctctaaaacatctatagctaatctaatagctcattcatacaatagttaactataaaaatatactacatcattaatacacggtcccacctctcatacacatataacattttggagtccgtgttgcagccggctacaaatctgtagcccgctttcttctctctcttctcttttcttctcgatatatggttacagccggtttataacctgctattgtacctgctcttacatgaggggtggctcctcccctttctcttcttttctctcctccacatcattatttaagcatacatgtcactttggagtttgtgcttagaaccttatagtacttgcccttatcgcaagtgtaggatgggcccttctgcaccggagcggtcttttaacacatactccctacgtcccgaaaaaaggcaaaccgtgagttcccgtgccaacgtttgactgtccgtcttatatgaaatttttttataattaatattttcattattgttagatgataaaacatgattaatattttatgcgtgacttatctttttaattttttccatatttttttcaaataagacggatggtcaaatattgggcacggaaaccagggtttgtctttttttgggacggagggagtaattaattaagtattagctattttttttaaaaaaaggattaatttgattttttaagtaactttcgtatagaaaatttttgtaaaaaacacaccgtttagtagtttaaaaaacgtgcgcgaggaaaacgaggaagatgagttggtaatatggggttgcaaaacagccaaatgtccttttgccccccaaaacacgagcgaaatatttgtgccgccgtgagaggagagcccaccgactacggtagctagctcgtcgttcgccggatggtctggacgtctggtccctgcccgttagttctggtgctatgctgcgctttgccatcctgtgcagctaccaattcgaaatcaaacccatggtgaaacctgtgattacgcagttaccccctttggtttttggttattacgagaagcatgatcgtttcgtttgcagcgatcaacagataaaatctttatatatctgtttttaacatgattttttaaaattactggacaataaattataataaaaacctaaaattaatttcaaaattaagtttttgaatttatttttttacaacggcttataagttattataaaaagcaagcaatggagtgtaagatataaagacatgattatcattaaaaattgttgaccggttctatagcggtatcatggataatcacttatcgcttgataaccgatggtatttggataaattttactaaaaactgatgcaggtagcgcgcatgtatttcaagttcaaattttaggacattacactacaccaagcaagggcccgggtgtaagaagtgtaagatacaaaaaggatcattcgaaattaccaaactggccctccatcttccacacgctcaaactggcccgtttcttctggatttttcacattttggtccttttaaaaaacttatttcgcaagtagatccctataaaaacttatcccaaaaatgg

SEQ ID NO: 20684 - DNA, 851 bp, Oryza sativa
taggaactcacaggaaccaaccccgtaaaaaatatactcacaacggacaaaatatgtggcatggggaattttccaaagctccaccgaaaaacttctctcctcgaaaacacaatcttgcaagcggaatttggaggttttaatatcgccgaacccggcaaagcgggagagcatcggatgtaactttttctgtagatgtccgtgcatatattatttgcctgattccgagtccgtatgagaaagttatgcctattttaatagatggcatattttgtccgtttcggtagagttttggaaaattctacatgtcacatattttgtccgtttgagtttattttttatacggttggttcctatgttctcctaagtgtgaaaaaaatatcaaaaaaatgaaataaaaataaaaaaattacatctctatgtactgtttaatttatatatgtcatttcatgtggttatattttgaattagattaagtaatttcatatagtggtagagtgcattatgtttaacatgctgatcaaagggttttactaaaggagttatggtctaattttagtgaaggtgcaaagtagactaagtggtatgctagatattttcagacttagctaagtggtagttcgagtttaaattttttttgtggttggttgtatcgtgatcctgagtgtgaaaaaacatccgaaaaaataaaataaaaatgacaccgttgcaactctatacagagaaacaggaatggaggcggcggcgccagccatgctggcgccctcctccctggggcggcaccagcctggcgccctcatcctgccacgtcggttcgcgtgcgccacggtggcaggaggacggcgccaggcagg

SEQ ID NO: 20685 - DNA, 22160 bp, Oryza sativa
agcccgtttcttccccacgaagcctttttccaaagtccaaatcaccaaaccgtcgcggcgcaccaccatacacagcccgaggccgcgcagctctcgaccccgacgcggctcggcagtcggcatcgccaaccctcatctccccccctcctctccaccgacctcgatctcgcccctccccccacgcgcgcgatctcgcccagatctcgctgagccgccgccgccgccgcagcagcagcggccatggagaacctgatctcgctcgtcaacaagctgcagcgggcctgcaccgccctcggcgaccacggcgaggagagcgccctccccaccctctgggactcgctgccggccatcgccgtcgtcggaggccaggttcccgtcgtttcccccctacccgtttttatctcgctcggatctggcccctcgcgcctcagctgcgtcgatctggatctcgcgagttgctggtagggcagaaaggattagtagccgatgcggtctagctacgattggatctacgattgctgtgctcgccgaagactagatttggacgcttacatgaaatcgataggttttgtagcaactgaagctactaaactagttgatggaaccatccagctcgatggaattttgtgcggagttgcgcctgttagaaatggtttaagcttatttctgtaccagaatgggtgtacttcggtaacctgacgtttgaactttcctgatacgtttgatagagttcgggtaaatcctcggtgctggagagcgttgttgggaaggatttcctaccaagaggctcaggtatggcggttccaatagcaagtgcttgtataattcagtgttattgctcctgttttatctgatttggaatttttggatttggtttccaggcattgtcacccgtcgtcccttggtgctgcagcttcataggatcgacggagacagagaatatgcagagttcatgcaccttcccaggaagagattcactgatttcggtactccatctaccttttccttcatttttggtcatatcattctgtgattaaaattgcgagattgcatgtttatggagatcatatattcaaactgaactagattgccaatgttggatgatagtcaaacatatatgattacacctgtaattgttggtggaaacagtctttcaagtgctaaacatatattcaactgcatgatggttaatgatgatagtcgtattcttgcagctcttgtgaggaaggagatagctgatgaaactgacagagaaactggtcgttcaaagcaaatatcatcggtccctattcatttaagcatatattctccaaatggtaagataacaataatataaaatgtcagttcgatgtagttgctttatcacagtcaaattggttcattttgattattgtttgctgagatggatatgtggcttaaaagctgttccttttgtctgttgcttacttagtgagatctctgtcattgataagatgaccataccttatttgtctttatatgtgcatgcctgtttatgatttatctggtttctagtatctatttttgttagcgtcttaactcccactcttttgcagttgtgaacctgactcttatcgatcttcctgggcttactaaagttgctgttggtcagtattacccattgtcatttgtgagctattttcttttgtttgttctttttaaagaggtccatttcctgatttaccacttgctatatgctttccagagggtcagcctgacagtattgttcaggacattgaaaacatggttcgctcgttcatagaaaaggtatattttttgctgtaaccttttaatatttgtccactgccattgctgactatgcttgccttatttcggtaccatagctttgtatgcacatatacagtaatttattctatgcatatttgtttcgacattcttatgatttcagccatgtgttagcatatttggaatatgttttttgtatcatgcattatgcttgtagtgtgtgagctatgcttatcttgtcatgtatcatgtctgtaatgttgcaaaagcttatatgtatatcgaccctttttggtttgtttcagcccaattgtatcattctggctgtttctccagccaatcaggatcttgcaacttctgatgcaattaagatttcacgggaagttgaccccaaaggtatgcctttgttgtaagccatttggataaaggatggcaatcatgttttttgagatgtggtttgtcttgtaatgttcaggtgaaaggacgtttggtgtgcttacaaaaattgatctaatggacaagggcaccgatgctgttgatgtaagttttttcccagctaaaattaattgctaaaaactttattatcgatacattttgtccccggagatgtcaacatggattattgttcccttgcttttgggaccttttaaatctcctatgttgaatattcttctgttctatctgttggaagatatacagttgtagaaaatgaaggttatgtttgttctttgagctgtattttcttacggttcttttctgcagatattggaaggcagatcataccggctccaacaacaatggattggtgtcgtcaatcgatctcagcaggatatcaacaagaatgtggacatgattgctgctaggcgcagagagcgtgaatatttttcaactacgccagaatacaagcaccttgctcataggatgggatcagaacatttagcaaagagtctctcgaaggtatgcctttcatttcgtttctaatgtagaatacctgtaactctgtttggtatattgactcttaaatgttttggtgtatatgtagcatttggagactgttattaagtcaagaatcccagggctccaatctctcattacaaagacaattgccgaactggagacagaacttaatcgacttgggaagcccattgctacagatgctggagtaagattagggcttttttattctttaattagatactggtttattgagcctaattctgcatcccctttttatgctaattgctaatgtagtgcccattttttttgtgtatgttcttgatcattgtgctaatggacataattggtttgtacatatttggccatgcagggaaagctgtacacgatcatggaaatatgccgcatgtttgatggtatctacaaagaacatctggatggagtgtatgtttcaaacttaatgtttctgttgctaaatgttctcttagaagttttattgtagctacgtgtgtgcttcctgaattccgagataaaataacattttatcctaaaataacattttcccctctctgatctgtataagccttctaaaatttgtgtggccctaatttgataagctctcctttggtgttagtcttgtgtgtttactccaacgtaagcatacagcctattttaggttcttggcaaagtaacctgttaatttgtcttgtatttttaaacaataaatttctatcaaatgtaataaagatttcaataagcttgcttgggcgtacatgcacctagaatctccagttgtttttctttcagaagaaagggatcgtcgaatttaaccctaaaacctaattacatgatagcacttacaaagttattgctaataaagatttgcatattttcttgctgctgaagtatgcaatttaacacaatttaacttgtagattgttatatgcaattagcatcattctcccttgtgtgcttgttcttttgtgaattgaatgttgctttccctgatgcttacccacaaaaattctaatgtccaggcgtcctggtggtgagaaaatctatcatgtctttgacaatcagtttcctgtagccattaaacggttgcagtttgacaaacaactggcaatggaaaatgtgaaaaagctcataacggaggctgatggataccaacctcatttaatagctccagagcaaggatatcgacggctcatagagtcttgtcttgttagtatcagaggtcctgctgaggcagctgtggatgcggtatgctatctattaatttgatctattttttagtcttaacaaaatagcttgagcgtttctaacttttcgtgtcatatattgttgaagaatgtgcactacaacattatcgtatgtttgttgtactgacaggtccatgcgatactcaaggaattagtgcacaaggccatcaatgaaacacatgtaagtcttcgcactgttgcacaatgttttctgtaacttatactggggaatatgtgcattctgatggtacatgaggtatactgattgtactaggagtttaggaggtaatcaattaatactgttgaaatttttgccttctgttgtttcaatattttgtctttctaataaaatctgaacctggaacttttttgctcgacttaagatgagaagcagcatgataattaatttgcatgcttgtcaaattgtcattactccacttgtaattgtgtaagcgtcctaaaagatgtgagtgagttctctgcaggagctgaagcagttccccactcttcgtgtggaagtaggcaatgcggcttttgagtcattggacagaatgagggatgaaagcaagaaaaacacattaaagcttgttgatatggaatgcagctacttaaccgtagatttcttcaggaaacttccccaggatgttgagaagggtggaaatccaagccactctatttttgatagatataatgattcttatcttagacgaattggtaagtcatcaaccattcttccttgtatatattcaatgtatactgttactgctttgcaatgatggccatttgttgaagttgagaagtggtttatcatattgttgcaaccttgtgtaatattgcccactaatttagtttaatgatgaatatacatgccatcaaggctttgcttggctgccttttaacttattttacctgtattttctgctgaaccttgctacaattcatactcaacaggaacaacggttctggcatatattaacatggtatgttcaaccttgaggaactctattccgaaatctattgtctactgtcaagtgcgggaggcaaagcgctcactgctcgatcacttctttactgaattgggagcaagagaggtgagttcttctttcttaaagcttaataaagcataacataagtttttgggccctgttttacattttttttggtgtgccttttaaagtccaacagaattgatctaactagtaatactgccttttaaatgttatgcagattaaacaactttctaagcttcttgatgaagaccccgccgtcatggaacggaggactaatcttgcgaagaggctggagctatatcggagtgctcaagcagaaattgatgcggttgcatggtccaaatagtcctgatcatctacttatcatactcatgtttctcctttactcccagttggtgatcctcccctatcttggggcatatatagctgattttaccccgttctaggtcattcatagatcaacgcagctgtgaggtgtcatttggtttgtgcttttgttccttgtgcttgaggatctaggagacaccaggctgctgtactttttgtattacgaccaagttcatatatcgtgtttaatttttgtcacagcccattctttcgttccgtttacatatatcgtcttcaatttgttactagtccattctttcgctccctttattttcagcttgtttaatttgtattatttgtatgtgtctttagtccatgtagatgtttatccgagttttcagagttctaacatagcatggaggattaaatataaatgaaaaaaataactaattgtatacattgtgtaaattgcgagacgaatcttttaagcctaattgctccatgatttgataacgtggtgctaatgacattgtgtgtaaatttgtctcgcagtgtgcaaatgaaatatgtaatttgttttgttattagtctatgtttaatacattaaatgtgtgtccgtatatccgatgtgacacacccaaacttatccgatgtgacaccaaaactttacactcatagatctaagcacccccatactacagaggaaactcaatcaagtatggtgaagatgagtgtagtggaaactgaaccaagaaaaggtgacgctgccaccggtgttgttgcttttatcgtaaggaaaaaacaattacagtagacacattttttctatgattggttgctcgaatctccagttcaaaacacacgcagagaacctaacagttaagtttgtccaggttgcactgacgatttcactgctagtacgaaacggacaaacaacaattgaaaattgcatgcgtattgtagtgtttcatgtctttccctggtaatacttgttcaccaatctttctgaatactccccgaatgtaagagttccattcggtgggatcaactgccagaagttaaaacatagattactatatcagaaaaaggcacgcaggagcactgaatgcaagtttctgattaggaacaaacctcttgatgatacggaatttcacttggaaacttgagcttttcatccctacaaaatatttcacaataaaaagaaaatgtcagcaaacccacattaatcagacctaggctttgaaaatctacgtgccgaattcgtaacggcaagcatattactattgattattgagtattgaccgtataaatgaacaaacccacataacacataatgatgagggaaaaccagtactcttcatgtgggctaacattatgtgttgaaattggttgggagctttggcaagtggcaagtcactagtaggatgaggggcaggaaactcaaaagttctccatgtgagagaatatgtgaacactacaatttggtcaagaaaactgcacataccaatctggttgcatgaacatcgcgaaggtcgaacgatcaacattcgaggcgttttcactgctgggggcctagagacaacagtaaaagtataaattactttacaactgcaggaactaggaacactgattacccatgactacaaatttatagtacaataccttcacacagtgtggagttgcacatagacgacctcttgatagtatttcagtggtttctccaacttggtaagccaattcattctcctcaaatgtaaccttatgcagtaaaatttcaattagtgcagaccacataaccctctcctgtataatatgctaatgcaattcacaggcaattattcaactaacaatgattaaacattgtttcaaatgcctggctacatttccaaatctgcaagcaccgatcaatttcaatgtagagatgactgcgtacaacctaaattacaaagcatcatcttgatgataagtctatagtgattaacaggaaattaccttaacaactttatcatcacgagtccttatatacaatccagcagcactatcaggacaggggatctccattgaatttttcgtaaacaaggcacatgtaagtcctgcatgtaggatgcataatcagaattgaaaaaaatatataaattaaaacaaacgttttttaaacgctaaagcctcatagatgatagtagtaggaaacaaaacggagatcagatttatggttatcaatatatgtataatacagtaaggttatgggttcagaatttcaccacatgctcatttgaccacaacaaactttcatgttcaggagttatcgtgcaactgataatattcaaccatagggataacatgtattacctgttaaagatccatggtcagtatgccatccacaccacgatgaaacagaaccaccttcctcttgtttactgaaataagagacatgcaagcatcaatccttacaactaaaaggctagaacattgaaaaatcttgaatccaaaaaaaatatattgattgttacaaaggtaagaaaagttagaaagctttgatctacatggacaacacatgtaaaatgccttataatatgcgcgatgatatcgcgtgtcaatggtgtgtaatacttgataggcaccatcttgctgtttagtggaatcgcgtgacattgatcttgtttatccattcctaagtcttattaactccaaaatacaagaaggtcataaaggaatcactgcctagagatgcaattcatgcatgttttttcttgtcagaaatactgtgtatacatcatatttacctaaattgccgggggtagtaatacagaaggcggcccttgtgacaccttgagctggcaattgtctgctcaaggctttcaccatcatatggtcccactccttgctgcattactgacaaacaaacagaagttggtccaattcaccaatggaataccaaacttaaagaccaaagtacagagttgacaattataatcaatccaaaggttaaattgtggagattttttacttagccaaacagatgtggtttgtccctggacatttttaaaggaaatatcaggtaagcctatagaattatatagtacataccatagcgatcacaatgatgagccaacatcaagccaacttccaacatcagctttccaagagctttaaatgctacaaatgaaagaaatgttgtaaaaatggttggattctagcatggaaatacataataagttctacaaaaatcaaaaccacttaaaaatatatttcagcatgtaatgatcatgaggcactgaaaatgaacattaaccattcagtatcttacatttagcaccttgagatacaagacagccagtaaggtaaatggagtacaacctttggtacatttattcaatacagatatcctgacttataacatataaacatgtgctatgggcctatggcaagtcctccattttaatggctaaaataagtaggaatgggttattaaaatagtgataaaaggtaacaaatatgtactgttatactgagaaatagccctcaagtcagtcaatatacatacatatggtcagtcagtcatacctatttcgagctcaggaagatgactggctggccatatatttgttcggcaataagatgggtacctgctggttcaatattacattaaaaacacctataataagggtcatatttggtctttatgagtatatgatacaactcttttgcactagcaatacaataggtcattttgagtgatacaaatgatcgaccatagtaagataattaaactttaattaactcaaatcatactaaattcgttggagttagaataataaaggttgccaaattgttcagttttctccagtgctaaattgtaacagtaaactgagttaaattatttatgtatgaaaaaacgaaccttctcacaagtacatcatcagtggttggagcatccaaaattgggttggcataaaaggagcctttgaatgtgtctgtgatacagatcttttcaataaagtgcaatatctcacatatggtaagatgtataattagataaaagtgcaaaagtgcttaccgagtttccctgactcaagtttctctttcccatgactccatccaaagttaaacctaagaggcaaaggagcaaactcatcattgctgtgtactcactctagactgtcaaaatggatagaagttgaagtacaattcaggtgttgatcctaactaggagctcccaattggaggacataataggctacatcaaattcgtgattaagaacataagtacagaaccaaatggcaccaccatgcagttctgttttcacctgctgtctgggtcttcaagttctttcttcacatcttcaggaaggtttgcaaatctaaaaaaaaatggaagcaagcaacaagagatttcactacaaatatcaagcaaatgttgaaactgaaatgtgcctcctatgaacaacacaaagatgagactaagagaagaacatactttggtgccaggcgcagcaacgttttccttagcacgggaaaaccaggcacctgcaaaaagacggctacaaaattcagttcaggaactcgaaattttctctgcaggccaggaacgcagcgcgcatcagttttcaacgcgtcacactcacgtcagcaatggagatgatcccgagcccgttgggcccgagcccttcctcgatcttcccgctcaggtccctatccctctcctgcatcagcagcagagaaaacggcgtcgcaactctgatggaatcaagaaccatacgacgctatgcagcgggttcctctcttaccttgaggtcggagaaggggatggagaccgtgcgcacggacggcggcggcggcgaagtctgcatggcggcgaggcagcggcaccgcaccggacgacgggacgagagccgcccgagcgcgagagcgagtggtcgtcgtcttcctcctcctcgggtggttggtgcccagcctggctgcgtctgcttccgcacgagacgaccaatctccatctcccccgtcacttatctcggcgtcggattcgtctgggactcgaatgccgggaggagtgtaacaactacttttttttgagaccgagacgtcagtgtgtgtagcgtcgcagtcgcagcctcgcaggtgagaggattcacgcatccgcgccggcgattccgcggtggcgcggcgctaggcacggctgctccggcatttcggaagagttgaaaagccggttgatctcgcgcggtttcctgtagatttgatctcgtcgcgatgcagcggtgccgaaaaatttgatgtgggatagtgttttcaattagcaaatttaaattctaatatactagtactgtgaacacgactcttcttgtttgaagtatactacatttaaattcaaatatacttgcttcttattttaagtatactaactagtaggattgactgggaggtcgcaaagaatattggcacactacaccacacgcagttcacttgacgcacgacacagaagtccagtacaaagtcatccaatcgaatgagatccctgtagttcccattttacacgcaaggtatcacgaatcagataatggaagccaactactacctccaccacaaaatgttgctacgtagtaaaaaacaacactttagcacgcgcaagatcactatcctaaaatactgcaagccaacagttttgaacttttgatacgatgatttggttcacaatagcgatgttatgtttgtatagatcaaagggcatctggttcatggaaagctatagaaggttgcatttgacagtcaccatgacaatcagacagaaattacagataaagagttaacaccgcatggaaatatcatttcaacgcaaatgagtgattggcatgcgttgtacaagatgcaaccagatagtctgtgcagtaaaacaaaagctaaactcctcaaaatcgcttaaatttctctggccggtaaaccaagtgactagctgatataaaacctccacgatgccaactaccagttttgcagaataggcaagaaacctgtttcagttaaaagtgaaattactgttagttttcaaacttttgacttgttatgcaaaagggagataagcacaaaaaaaaaaacacaatgatagcaaaatatattataccaaacggactgcattatgctctgaagacattatcaactatcaacacaaagtcacaaaattatgaagaaatcccacacggtaggtttctatcataccacaataccgagagatggttgtgttccaagttgtgttccactagtcaaccaggacaccactggatcagataatgcagatagccgccaataaatagtcattaacgttttcaacttccaatgctaagactcaccaatttctacatttatgcataataagggatttgatccatcatcaggtaaaaaatccagagcaaaccgatctcagggatctcaggcaattcctcctgccaccccaattcctttttagtcaggatggggctatcatcctaaactggattgggacccctaaacaaggacaaagtatgaaggacacctagatcaattaaacggcaaagcatatagtgtaacacattagtttacaaccctcgagatcactatgtcactcgggctcgcatgaatactagttaacagtaggaaactgacatattagattaacagatattgaggtcattggaggcaaggctgtgaggaacaggttgatgagagacccatcaaccaaagcatagcctcgtactatgagaccgctgaattttatctagggccccaacttccgagcaccccgcagagaacctgcaggtatttcgaagctagcaaaagagcttcccccattggcatggagcccttagacacaaacataatgatcactcacaccaaaacctaacaatgcaccattccatctaatcaggcaacaactgtcacaaatacagaatccagggaacaattgcacaagattctgaccaaccccacgagctcgatgattcaatgaacaataaacataaccagaagcaatagtcaataatacatcaccacattgtaaaagcttgaaacaattggaactaagtacagcactctaccttagatgctgctagggtacatgaagacgcggaccttcttgccctgcaccaccaaaacaatccagcataaaacatcagaaatggacaacgaaactacatacgactggaccaaaacaggaagggatcaatggatagcgcggacgacggagagagcgagatttaccatggaggtgggcgggaggttggaccggaacttggcgcggacgacgccggagttgccgtgcgggcgggtgaccttgccccagatgcagcggatggtggagtcgttgctcttcgtcttggccttgtagacgtaggcgatgcgcttcccggcgtaccacccaacctcctccttggtgttcaccccctcgatctgcagcagcgacgtgttctcgtactggttcgacttcgacctacgcgtgaaaatcaacgccaaaccaagatcaacaccactccaccgcggcgatgacggagaaggcagataccccgccacgcaggggggggggggtgagagcgagcggtcacctcttgtagccgaggatggtgccgcggacgtacagcctcacgcgctggccttgccgtcccttcatcgtcgccggcggccgccgaggagggtggagatggcgatggcggcggcggcgggaaccgaggaggaggggaagtgacggcgcaggggaatgagatgagatgagccctagggcatgtggggttttaaaagtttcttgtggtagattggacggccgagattgcgtctagatggacggcggatgtgcatcgagatccccgtcggagaaggcccaagatgaaaggcccatctaatatatgggcctacaaacaaagtggacctatagtcctttttttgcgagggaaaatgggcctgttaacatagagcctcatctttttcttatgtttatcagccaaattttaaatttagagttaattttagggttttgtcattaaggtttattttccatcctttgcttttaaatcactaagaacacatatataaaagtttcacagattattttttgtttgcaaatatgtcgttcatgattgggctgaataatctctttataaccatctcagtttttttcgacggcttcaattatgtgatataaaatttcatctgcagaatattaaaaaaacatgacataatttttctgaaaacaaaaaaaatcaatatatgctttacactattgaataatattgaattattatgcatgaaaaaataattttaaagtagtatttgaagactgagagagtatatacgtgatattgtagtatggaattacgcactgcgtacgtgttgacgcttctgttcattgtctggatggtggtgtgttgatgtcgagctcgcatgtgtgttgacgagactttgcaagtgtaggtctcggcagattgagatgtttggttttcttatgctttgatggcgtagctgtgacataaataatcagactctgggtgtaaaaaataacagataaaaaaataaaatgatgtggactaatacctataatacctattgctgacttggacaaagattagcttcgattcagactttcagaggcaaatcatttgctcgcaaatttctctacttctgtacgtatttttattgcagtcatgacaacgaccacagggggataaaagaaaacagattaacgttcttgttcagacaaagttactgtgtgaacagaataaaaatatacactagtaaattatcactcgattaagtttctcatacagctagcgtcagtgttacgaccagactaactactgtgaattttttttttcaacgcttacgtgtgtgcagataacaatacctaatggtaatcacaggcttctcagatagaacaaagatagctgatgcttgaactggtcatgctgactagctacctcgatcctctgaactctgaagtctgaaatgtcatggattcagaagatactgcccagcttgcccatgatagagctagcttttgcttgctttgaattatgaagaggtcaatgttgcctaaccacaatatgccaacatgagttttagagtattatccgttggcatcaatagcttcacccatcatgattcatggcagtgtgacgaaggtaatcaacactgttttgctgatgagtgacagctaagctgtgtaacgtctcacctcgatcgacaacactccgtctgaatattccgatcacaacaaatatgtcaatgtcgaggacaagtttggtagaaggaagctggtaggcagcaacatccagatcagccgatcgaatttcgatttcaattcaaaaggttgtttttagagaattcacaaagagttgatgtgctacaactgcaagtctgcaacatatgaatcaatctcctcttgcttgctaaaatagcgtgacaagaaataaaaacctgttctttatcaagcaaggatgcatcttataaaacaaggggattatttacacatggatatgaacatatcatgctcatcataagttgcacaattgataactctctgcatacactgctgcgccatggcggagccgacagagttcgtcttctcaagaagccaagaggaatcaagagaaggaaaaaaaaacaaagagagtagaaatcaccaattcaattcaccatgtcactaattaaaaacttgctagctaatgtactcgagctatatgtaattttatcagggctccaaaaatgttacagctactgtactgtgcatgcagaattttttcgcagttgcagttcttgcttaatttgctagttctccggtatggccacgagccgcggcgcccacgcgtccctggcgccaccgccgccgtgaccgtggccgtggccgccgcggagcccggcgttgagctccaccatcttggccttcctctcgacagcgcaccgctcctccagcctcgccatcagctccgccgcgtccttcctcttcatcaccaccttcacccgcatgccgtcgccgccgtcgacggccggctccacgtggcaccccggccacgccatcctcatctcctcctcctcccccggcgtgtctatcaccggaaccacgtgcctcgacgacgccgccgccgccgccttgctgctcctgacagcggcggtggccggcgacttcttcctcctcttcttgactcccgaggtggccaccgccgtggcctcctggcacggacatggcagctgcaagctgttgcccatgcgactactactagatgcttctctctgtgtagctaagcttcgagtggagaatcaatggcgatgtgtgagctttgagtggcacctggatggagaattggagaaagtgtgcgttatatagcggtgaagaggagagcttgacttgttcagtaggagaagcgagcgtaagtgatggggtatcaaattatagactaaaattaggcaaatttttgcactaaaaaagaattctgatagtagcctattatgtacgtcatgcgtgtaacctcgatcgatggactagtcagccggtcaggtacgctaatgactgttgactagcttgtcaacggtctttggctcgtataagttgcaatagtaaaaatatttttccaagcatactgcagcgagtatgtacttccttcgtcccaaaatgtaatcatttttagttataaatctggacaactgtgtatccagattcataactaaaaattgctatattttaggacggaggtagtacgtataatgaatgtatccgcaaatacattttgtgcaatgacatttaactttgaaactaaatgcgagtatgcctgtgtttagttcacgttgaaaatagaagtttggttgaaattggaacaatgtaacagaaaagttggaagtttacgtgtgtaggaaagttttgatgtaattaaaaagttgaaagtttgaagaaaaactttggatctaaacacggcctatgtacaaagtgtatccacaaatatggtatgcaacagtatagctttgatttttaaaaggactgagcaaccgggggaatctttttgtcaaataattaaaaataaaatattatcatgttgagaaccaaaataaagggatcatatggttaaactaatacatcctactacaataccattacactagcaagtgcatatcattactttgaaattaaactctcctgttgctagtggcctcgcgggaccttccaacaaaaggagctcctggcaaccagcctcctagccaagattaaagaggaagccaaaacatgtgttttggtgggtgagaagaaccttggcaactggctcattatgtggttagctcggtccaaaggctctgagcttgtaacttttttcatttttttttgggttttgtacaatttactccatctctatttaatgaaattggcggcttgccagtttgttcaaaaaaaaaaagtcctcgttaaaaaaagttcttacagagaaattctcaataaaattgtttacatctaacaggtatatacatctcataattgaagcagcaccattttacaaggtcaatcttgttacccgttctatatattcttttgtgtttcgttgctcaatccagaataattattggtcgtcatgcacgcagtcactaatggactgtacttttttttttcataacggcattgccaatttagaacaaggcatatcaaatatgaatttcttttgcctcaggtgtcgtcagtaatatcttctagtcagactaataatgcgtgacttcgctccaattataaaacagttaataacaaccaaacatgtcacacgaggattgagtttcttttcaataaaggaagcgaatcaatgaaatgaaacagagcttctgcttttgtttaagaaaaaaagtttaactgattaattatggctgcagatcgattcttgaactactcaatgacaacacttcaaaaactttaaaaacatttacaattcatgcagcagcattgtggtaggttcatggatggaagagaaacacgaagatccattatgtacttacacataataaatagatgtttttaacagaatcccctcacatttatttaacaaaaaccagacattgctcttataatcacaggatttgcatctcttcacaagaagaaacagggaaaaaatatacgcgtccgcaaaatttcccttttatcatacttatataaacaaaagggcccccttttcttgtaaattatttacaggccctttattttacctttttatagctaaaaaatgcatggccctactatcttcgcatcatcaatgctgtatcaaaattgcagaaatgttctctcggcctatgcaactacgggttggaccagaccttcacttgagacagcaatgtcctctgtgccattggtttcaccttcatcatccttcgacaggtaattgtctacggctgctgcagcttggcgcccctctgtgatggcccaaacaaccagtgattgcccacgtctgcagtctccagcagcaaatacaccttccacattggtcgcaaagtttccaaattgagctttgaagtttgacctcatgtcttgttctagacccagcttgttagcaacagtctgtagaaggatatgcagttaggcactatgtgttggttggtctctaaacagatagctatgtcacaattgtgtaatgctattcttgtcataactataagagaaagggaggaaaactaaccgcttcgggacccaggaatcccatagctaagaggacaagatcggcctcaataatttcttctgatccttcaacttccttgaattggaaccttccgttcacctttccccattcaacacgtattacctcaagggccttcacatttccattctcatctccgataaatcgcttcgtcaggactttgtaacttcttggatcttttccaaacttgctagttgcttcctggtgcccataatcaacacggaagatcctgggccactgaaggcaatagtagaaacacaacagagtaatgttagtggaatttcaggcaaccgtagtggcgcaatgcttacattctaaacatacaaagattttcactaaaaaaagaatataaagatgctgttgttttatatgatgagggaactaacctggggccaggggttgtcaggtgccctctttcttggtggctctggcaaaagttcaagatttacaaggttggtgcaaccatgcctaatggatgtcccaatgcaatctgtgcctgtgtctccaccaccaatgacaaccacctttctcccttgggctgatatgtagttaccatcctccaagttgctgtcaagtaaacttttggtattggcatgaagaaattccatagcgaaatggatgcctgccaactcccgtccaggaatagggagatctctgctcaaggataatgctctaaacattagccaagtttcaaaggcatgaatgatatagactgtgttgcttagactttaaaaactggtgccaagaaagatgtaaactagagttacaaactcttctttttttcgtttttgtattaactcactttggctttgtagctccacaggccaaaataatggcatcattctcagagcggagcttttcaacggagtataaagggtcacttccaacatgggcattcacaatgaattgaaccccctccttagccatcaactcgacacgtcgctgaacaatgccctctttgtcagccttcatatttggaaccccatacatcatcagtcctccaatacggtcagcacgttcaaagacagtcacgaaatggcccattttgttcagttggtctgcagcagctagaccagctgggccactgccaacaatagcaactctctttctgcaaaaaaatgaagtagctttaggtgcagctattgttacatgcttcaactcatataagaaagcaagtacaaagttgtgccgaacacacaccctgttctccgaagtggaggccgtggtaccatccatccctcttcaaatcctttgtctatgatggcgcactctatgctttttatggatactggattgtctataatgccaagtacgcacgaaccctcacaaggagcaggacaaactcgtccagtaaactcagggaaattgtttgtctcaagtagccgatccaaggcttcatgccatctattctgatgaaccaattcattgaattcaggaatcttatttccaagaggacaaccagcaccagaaccctcctgcaaaagttggatataagaaaaatacaggaaccataccaagaaaatttcacaaatcttaacaagtgaaaagacaatctgatgatgcaaagagaaaaagccacatcatgtagtaaataatggccatagaatcgataaaaggacaaaaactgaagaataaatctcagctgtccgatggaagagtggcaaggaagttactagatattccaagtccacctctgaacctgccaatatgtcacaaccatggcacctttttatttttaagcctaaaaaatatttttttcttaggcgtataattttggaggttttgagttttgaatattggtaaattatttttataccttgtgtacaattaaaacctcgtatacgtgaagaaccttgaaagttttgagttttactattgaaactagcatggtgtcccgcgcagattgcgcggctagcatcattatattttctctcatataatagcatatatgttttctcaatatattatccaaatatattaaaatgacaacataattttagattttgcaataactttacgaaactactaatgtgtaatattcatattgtattttatatacgtgttagttattaattatttttaatatcaaattttagttatttgtaaaatatatatattcctatatggactctagactcatcttttaatatatttttttaattccaaattttctgtaaattgtatttctatatagactctaggctcttcttccaatattatttatttttatttctgaatttttattatttctaattgtatttctatgtggactctaaacttatctttcaatattctttaatttttaatttcgaatttcagttacttctaaattgtattcctatattgactttaaactcttctttccatgtttttcttaatctcgaattttagttatttgtaaattgtatttttatacagactctaaactctacttttaattttattatgtttattctgaattttagttagttttaaattcctatatggactctatactctacttctaatattccttattttttaattccgaatttattttttttcttaattgtatttctatatggactatatactctacttctaatattcattatttttaattccgattttctattattttctaattgtatttctatatggactctatactctacttctaatattccttatttttaattccgaatatcagttatttcctaattgtatttctatatggactctagtctcctcttctaatattccttattttttaattccgaatttcaactaattttaaattatatttctatatggactctagtctccttttctaatattccttattttttaattccgaatttgagttatttcctaattgtatttctatatggactctatactctacttcgaatattccttctttttaattccgaatttcagttatttcctaattgtatttctatatggactctagtctcctcttctaatattccttatttttaattccgaatttcaactatttctaaattgtatttctatatggactctagtctcctcttctaatattccttattttttaattccaaatttcagctatttctaaattgtatttctatatggactctgtcttttctttttctccgattaatgtgagaatttctaggccatgagagcgaacgtggaggcttctttttctattcctttaataatataatagatagattatattctttacacacttttttaaacattgcataaagtacactcgattgtcggttttgtttagcacacaaattaaccatctcagtttttttttcaacgaacacactttctaaagtaaagtaaatatttatgaatttagtttacctaaaaattaaataaaatagaaaaaaataccaaattttatagggtaactaactaagcataccctaccattgccaacttaccaaaatatcataacgcagtaatgataaaacaagtcagaccaaaaaaattaacatttacataatattttttaataagatgaatgattaaatattatgttaaaagttaacagtgtcatctattaaaaagggaagtatattttgttactacaaataatatgtaaagatattcagtatagaggatggttaaattcgtgcgaatgcacgactatatgcactaatatatatggacaagaaatcaagagcatcaaggacattcatataaaacttttttgccgggtgacattcatataaaactactgtactgaaaagcatcattgtattttatgaaaaaaaactgcttaatacaaaagggaaaaaaactgagtatcacctgatgacagaaaggagtgccacaatccatgcaccgagcagattgcgtctttagcagtggcccaggaaccaattcaattgcaacttcattccaatcttttacacgctcatttggatctctgtaagaagtaccctctcgctcatattttatgaaacctcggtactttacagcatttgaaactcgtgatggtcggcttgatggctcttcgttcattactttctgcatatcaaagactttaagtcagactagaaagcttagcttacagaattccaataataactattttaagaaggacatcataaatttccaccagtcaagttaaatatccccgatatagagaatgagaaataatcctgcttaaaccttatttacct

SEQ ID NO: 20686 - DNA, 7044 bp, Oryza sativa
tcttcttttagtttatccaaaacccgtttgtaatccttggatgtacttttattaattttgggaggagaggatcaaaattcaagagtaatctctggcccaatcactttgtgtatgaagtctgtgctgttgtatcatcattctcaatgttgtgatgtcatcctcttcaactacagcatacaagtcaactagctcatagttgcaacggctactgaacttcccatccacatcataaacataagcaatacctccactcatgccagctgcaaagttcctaccagtttttccaagaataacagctgtacctcctgtcatgtactcacatccatgatcgccaatcccttcaactactgcttgagctcctgaattgcggacacaaaacctttctgccgccataccattgaaatatgcctctccctttgtagcaccatataaagccacattaccaatcacaatattgtcttgtggattaaatcgactatttcttggtggatacacaacaatctttccaccagatagtcccttaccaacataatcgttgctgtctccctcaagctcaagagtgatcccaggacagagaaaagcaccaaaactttggccagcacttccattcagcttaatatggatggtatctgatggcaatccatgaatgtgataccgttttgtgacttcatggctgagcatagtaccaacagctcggttaatgttccgtactggtgtctcaatgaaaacacgaacaccttttcgaagggcagctgttgaggaggctatgagtttgttatctaatgccatgtcgaggccatgatcttgcttctcaacacaatattgaacagccccagggctaatttcagcagctggtttcagcagccgtgagagatcaatgttttcaagtttctcgttgccctccagtactttgggatcgatctcaagcatgtccgatcgcccaaccatttcattaacagtgcggaagccaagctgtgccatgatttctcgtacctcttcagcaagcatgaagaagtagtttatgacatgttctggcttcccagcaaactttgcgcggagcactggatcttgtgtagcaataccagcagggcaagtgttggtatggcacttcctcatcataatgcagccaagtgtgattaatggcgctgtgctgaatccaaattcttctgctccaagtaaacaagcaacagcaacatctctaccagttttcatctgtccatctgtctgaagaacagctcggccacggagaccattggccacaagagtctggtgtgtttcagctaatccaagctcccaaggaagtccagcatttttaatccctgtccatctggaggctccagtgcctccatcatgtccagagatcagaacatggtctgcatgtcctttcaccacaccactagcgacaattcctacaccagcttcagagactagtttgacgctgattctggcacctgggtttgcattctacagtagaaagaagcgatatagcattagccaaccaaactgtaaagtgcaacatgcattattcaattaaaaggttctctaatatgaaacattacaacaaaaaaatgccaattaataaggaagtaaatgtgtaagtggcaaactggagtcttgcactaaatagttataagccaccatcatgagactttttacaaatgagactataccttaaggtcatggataagttgtgcgagatcctcaatagaatatatatcgtggtgaggaggtgggctaatgagccctacaccagctgtagaatttctagtgactgcaatatcaccaatgaccttgtggcctggtagctcaccaccttcaccaggtttagcaccctatacagttagaggaacaagacataaatttctactgcctgatgaaatagccagaccagtggtcatggacatattgcaggaagtaactcgtttagttttacaaaaaaccaatctggtcaaatacctgagccatttttatctgcacctcaactgcattagtcaaataatagatggaaactccaaatcttccgctggcaacttgcttgattgcacttattcttggattctttgatccatcaggaagaggcaccatacggcaaggttgttcccctccctcacctttttagatgtcccaattaacatataaaatggagtcagttagcaaattcactacagtagtaagttgatattctaaataaatagctgtgcacaaataagtcataaaaaggtttacataagatgctctgcagataggaagtgcaatattagagaagaatgaacaaaagttgataaataacttgcatcagcctagctgctgtgctcaaataagcaaacaacaggcatttcccatttgtttttgtgtagcatatgaaaatagttcagaaggaatttaaaataaaggttcatatcaaattgcgactagcctgaaatcggagaacaaacaaagactatgatctaagctactggattgaatccaagtgatatatgcctactatcaattaacaaaaaagaaagccttatacgcctgtcaaaggatcccctgatttattcacttacgtttttcttagggaatgcgcataagctttgtgcatcatttgtattaagattgaaaggaacaaagttctcacaacaccatctacccaaagcaaatggttcgactggaaaggtaaaaaaaccaattgcctgtttacctttagctatagtagcgtataagccctgttggcccaaaatataacatttcctgatcttgttaacctttctgggaaagcaaggatgaaagcccaagtaaggtgctatgcaagagtggcccatcccccaccaccaaatggaggcccagccattgggcgaattttgggtcatatggtgttacaactctacgcttatgtggttaccctcccactatgtaatgatacgcagttcaatcgacaccgtcaaaaattggtctggcaactaatggggggatattatacttctatttccaatatcaagggtaatttggctactataaagcttaacctgtgccacggaagaaggtcagtgtttgagttgttaactggcctttgctcccattcttaatagttatataaccttcacgttccaggcacatataattaagaactttaagcataattcaagtgatttgggaataacaatgttaaaaggatctaaaagagccaactagtttttagatgttactttttagctcaaagtttttgcaagttatcatgggaaatcaagaagcttagaactatatcaagcaaacatgcaacacaaagcacacatgacatttaaagtaactgactcagcaaaagttcaggtccgtatatgatgcgagatacctgtgttagattttcctccaagggtgttcatagcctcagccagggaagtatgagcttccaaggaaatggatccataactcattgctccagtacagaaccgcttcactatctcctttgcaggttctacctcgtccaaggaaatttggtttggaatttctctaaatttcagcatgccacgcagagtacatgccttattcagctcgtaaatgcgcctagaatattctttgtatgcttccctgctgttaatccgtgctgcttcttgtaattttgcaatggaaaaaggatcattaaggtgtacttctccatttttcctccaatggtaatccccagggttgggaagagcatttgcatctgcacttccaggaggtaaagttcttgatgggaatgcaatctcatggagacgaagagcatcttgtgcaagcatttcaaaggttgcaccttcaactctactaggagtaccttcaaaacacttgctgaccacttccgaagcaagaccaagggcctcaaaaatctgagcacctttgtaagatgccagagtggatattcccatcttcgcaagaactttcatcattccatagtttgaagcataaaaatatttctcgataagttgttcttgtgtataaggtttcccatcattaggaggaatcctcccatcaatttgcaaccgccatattgcttctatagctaaataagggcatatagcatcagcaccaaatccaataagggtggaaaaatggtgcacttcgcgaggttcagcagattcaactaacaatcctatgcgtgtcctctcaagatgtgagacaaggtgctgatggacagctccaactgccaatagggaactgacagctacacgctctgaagaaaaacctgtatggaaacttctagttaaagcaaatgttttaatccaaatgctacagatgacggatcaagttaattttgagaattaaacattgaaatgcagagcacatatcatggtgacaagcttgggaaagctgagcttggatgcaaaaaaaaaaaaaagaagaaaagctgagctatgttgacacatgatccaagaggagcaagaaaaactaagtacgacctaacctaagatgaaactaagatgttgactgttaacatgttgttacgaaaatatacttattcatgatctgtatagaaaaaaatcttgatatctttcataccacaataacacaatattgaattcagctcaaaagtaaagattttggggagaatattgatttcatactaacactattgctcatgaatctatatctagatgatgataaattcatggatcataaaattcatgcttagtgagtctggtgtaactgaatcttactgacctctatcagagagaactagaatagtgtagccctcatgaatagcttcacgtgcttgagcacaaattttatctaaagtctgtttaaacccatcctgccattctttttaggataagttatgtcaagcaccttgctgcgccaaccccggtagttcatctttttaatagcctccatttcatttgtattcagtaaaggactcttaagcgtgaggcgatggcactgccgctctgttgtttcagacaagtcaccttcaggaccaatcatgcactccatagatgtgacaattttctcccggatcgggtcaatcggtgggtttgtaacttgtgcaaacatctgcttgaagtattcaaaagtcagcttctctctgtttgacatcacagctagaggagtatcatttcccattgatccaagagcttcttgtccatctttggccatcggtagcatcagcatttcaagggcttctcttgtatacctgaatccaaccaaataggtaatttttcaacaaggaggatgagaagaaacatactaagattgggctgttgcttacccaaaagccttcagcggagtcagaattccgcagatacccatatctgctttgttctcctttgtaatctgcagcaaagtgtgaaaaatccataaaatacctcaccattacatggtaaattactaaccaacaggacactccaaaagttagcaagataattaacttactggaagtgcacccgaaatgctcggtgcaattctctctgcttcatttacagattctatgatatctgtgagttgtatcctttgtcttttcagccactctccatatggacgaactttggagtactctttcttcaattcatcatcattcacaacacaatggttctcaaaatcaactaaaagcatcattccagggtttagcctaccctttcttgaaacatcttgaggaggaacatcgaccacaccaacttcactagccataattacacggccactgtaggtcacataaaaccggcctggcctcaaaccattacgatcaagggttgcaccaaggtagcggccatcagtaactgtgcgtgaagaccaggtcagaattgatacttatctatcataatgcatgcatcaatattaagaagagagtttagttttatcttgttacatgagattagagctggtccatcccaaggctccataagtgctgaaaagaactcatacaaagcttttctctcagggtccatgttaacatcgttttgccacgcctcagggatcatcatcatgacagcctctggcgcacttcttccagattgtatgagaagctcaagaacattgtcgattgcacctgaattcacaagataattcaataaataactttgcaaagatggccatacttccatttgacaggtgaaaagggatatggaatcccaaatatacacatttatttctcttaatacaaaaatgtgcgtctcacgtattcccaatatatatatgtatacatacacacacacacacacattgtttcagagacagagctagcagcaaactactgcttttatttttatcatgtgtaaattatgataaaggaatggaacctgaatccgaagatgtagcatccactatcggcagaagtttcaacatttcatcccttgttagacctagtccctcgcacttcaagagaccctcacgtgccttcatcctaccaaacatggaaataggacaaaagtgcaagtaagcatataaatataagctccatggtccataggcatgtgaagattcttgctcacaagaaaatgatgagagatgtgtttagtgaaattaccagttcttgttccctctaagggtattgatctcgccattatgccccaaaacacgcattggttgcgctcgatcccaactagggaaggtgttcgtggaaaatcttgagtggatctgtttgcatgcataacttttaaactataccttgttcatcttttgcacaactacatataaatgatatgcaatatggtttcatatgaatacccagtaggccagtactatctatccttgaatcctgctccatatgctatcatccatgtaaaacagtttcagaacctaagctacctcaagccaaataaagtttgttcaaaccacctaattaggatacacattctgaaaaagcagtacctaatagcagaactacacaaggattctgaagtgtcttttttgttgggcatcagctgacacagtttcagtttctacagcttcagccaaaggcatcacgaaacaggagggaaatagcatattaatattaataaaagaaaagaggatatttgatgcctgcttagaagcattatatatcctcacaaaaatcttgctgctagtaatcctattttctgactatgatcatggatt

SEQ ID NO: 20687 - DNA, 3028 bp, Oryza sativa
  unsure (1)..(3028): unsure at all n locations
nnnnnnnnnnnnnnnnnnnnnnnnnnnnnnnnnnnnnnnnnnnnnnnnnnnnnnnnatctgggaaatgctttggtacgggtataatgtttgcttatgcaattacactatgtcatgacgatgatattagagtagtatttggtagtttaacgtggtgtctagattacgggatatcattatttggggttatatgctgcggatgagaggtgggccgctgatggtgacagctcagtacgggtattcctccgtgcctgtatatagtcctaagttaattccctagggagggtattcctccgtatttagccccggttgtatggtcatgactggctgtcgtaaggaacttagcagtcagaggtggcttctcgaagtaccacgagggcatcggatagagggtattagctagtgtatcagttaactagaatgtatttatattatgtatactagaagtataggaatagattatctttctcttttctttccacttagcttagataatatattatgagaatgagtagctaatgcttgtgtgtcactctacccttggattatctgaaccccttcttagaatatgattatcacaagtaatatataaattattagtcaagttctctctacatgatcttctcatgggataaaataaatacgatacctttggaatactctcaggtgaaatgccacaatggtatatccgtgcgttagcggataaactctataaccgtaatataccaggagtatttctacgccattgctgggaattatatttctagtaatgtcattaagaaataccaacagtggatacacaatataatctaacagtaaaaaccagccgattgtgaattagatcgtgaaactaataaatattataaagtatatatgataactcgaagaattacgtaaacaagattagagtgtcataaagatggaagcgctaatcccgataacgcaaaccaccataacaagttttacctctagttgaagatcggaatcgatgcagctcaacccaaaagcaagaactcgtcgaaataaaacgaaagtaaaaaaggttggcgatgcgccgagagtgttattgaactgttgttgtttgattacatgggttcgggtcatatttatacccaaaatacataagatgtccttgccggacacaactcttatctctaacaaactctaagatacataagtctttatagcagacttttgcccaaacatatctctaagaaaattacacaaaatgtactaattaatagatacagttgcctatccgagagcttatctccattgtggcaatccttgtgaagcacgctgatcgattctagaagcagttccataactgatctcgctataatcggctatatcggtagtatcagttatatcggctgccctctgtccgatccatctcagccgatacagactacagctgatgccttcgcagccaatttagactctgttcttcgaatctaattctttgccgaatccacattgactccaatgctggacctggtttgtatcttaccaaatttggtcgtcaacaagaagacgacgacctcatgagtgtcaggagttgggaaagccttgccgcacgccggacgccatccgatgatctcctttgccggaaaaactccttgcaccaccatctccttgagattttcctccgtaacgtcggagggcgcccattgactctcgaagctttctctctcttccgccatggatgcaaaaggaatgaagagatctggagcgagggctgcgacgattggtggggagattgatgtggtggttgcgcggaggaatttcgcggaaggaaaatggttcggaggaggcggattgagatgtgattgcaaaccctagttttcaccggcgtgggtctgttacatcagcgtgaaatggggaaagaagcagcagttgtggcgaggaagacgaaggggtttccttcgatgtgatttttatcgctgggtatcggaaagcgctgatgggcctgggcctaaacagtgttttcagcccaaatatatttccggtgtggctaattgtggtcttttaggacttaggcatatttttgcttaggctaaattgcccacaataatagagcccaataccgttaaattcctttctatgcagttcgataattctttgaaatttctacgatgcatatatggaggtgcccaacagtaaaaacgtcatgttatttttgttgacctttttataaggccacaaaactgttagggtttaatcaggacaaccagtttccaaagctgttattcctttgcgcatttatatgcttaatttctctgaatacaggcttaagttacagcttaggctggataaacttaatagtcggtattaattaagcggttgataaatcctttaagagttttactcggattatttatcacgaaagctattttaagctccaaaatagatcatagatcgtttttccattctgatctttatatatctttatggtgagcttattaggttaaagcagtcggctgaatctttggataaaaatcgcatatgttttgctatttgattacttcggtaatattatctataaaaccactcggctggttattgaactataccttgactatatatttagttttgtttaactaatcacatagttaggggctacacctaattaggtgcatctagtcgatgcacctgattttttattttttagccctccatagccttcagttcaagcactcggaataacaagacagagatagtcgaagtactcagattttcgttcaatggtttcagaggagattatttcatcgactgtgaaggtctctgggactactgtgtagattatggataccccatacccacacggtatgtatatccgactaggtataggggtaccatatacagatagaatgtcttaagtaaaggactcggttgttttattaacttgtgtctcaagcaaacgcccgaggatcctagtctgttaagattgtaatttatctttacttgcatattccgttaggaatatgggctgtatcttgtaacaccgactcctccccttatataaggagg

SEQ ID NO: 20688 - DNA, 609 bp, Oryza sativa
tacggcggcataaaggccagccgtgcaagcggaaacaccagtcggcggcggcgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggggacaccagtcggcggcgacgaaggcaagccggtcggtgaagacgtagacgcccaacaacggcggcataaaggccagccgtgcaggcgaggacatcggtcggcggcgacgaaggcaagccggtcggtgaagacgtagacgcccaacaacggcggcataaaggccagccgtgcagcgaggacatcggtcggcggcgacgaaggcaagctcggtgcggtgaa

SEQ ID NO: 20689 - DNA, 418 bp, Oryza sativa
tttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccag

SEQ ID NO: 20690 - DNA, 12007 bp, Oryza sativa
tttaaagccttaccaaatcaaatatttgagagtagaaacttatggaattatcaaaatgtgatagagtagcaattgcaaataacatgtttgatttcttgtcatcctaaaagttgctaatactaaaattcgatagagttaaaaatggtaacagtttatattaaccacgtataaatatgaatacattattgaagcatgatgtatataaggtatattaaaaataaccatataatttataattaagaacaagaaaatacgataatttaaaattcatgaatggtcaaaactgagataacaccgatcaaaagcgataaataaaatagtactccctccgtttcacaatataagactttctagcattgcccacaatataagacacatatatatatatgtctagattcattaacatgtaaataaatatgggcaaatgctagaaagtctttcacattttggtccttttaaaaaacttatttcgcaaatagacccctagaaaaacttatcccaaaaatggtcctttttggggcgccagagtggacgacggcgctagccactctggcgccgtccccctgccgacgtggcggggcgatgctgaggtggctagggagtgcgccagagtggctggcgccccccccccaaaattttttatttttgttttatttgtttgatatttttttcacgcttagggacacacaagaaccaaccatagaaaaattgaactcaaatggacgtaatatgtgacctgtagaatttttcctctcctctcctctctccgaactagtgcaaaggagagatgtgcaacttttttatttttattttattttttgatatttttttcacacttaggaactcacaggaatcaactatgtaaaaaataaactcaaacggacgaaatatgtggcatgtggaattttccaaagttttaccgaaaaacttctctcctcgaaaacacaatcttgcaagcggaatttggagtttttaatatcgccgaacccggcaaagcgggggagaatcagatgtaacattttctgtagatgtccgtgcatatattatttgcctgattccgagtccgtatgagaaagttacgcctattttaatagatgacatattttgtccgtttcggtagagttttggaaaattctacaagtcacatattttatccgtttgagtttattttttatacggttggttcctatgttctcctaagtgtgaaaaaatatcaaaaaaatgaaataaaaataaaaaaattgcatttctatgtactgtttaacttatatatgtcatttcatgtggttatattttgaattagattaagtaatttcatatagtggtagagtgcattatgtttaacatgctgatcaaagggttttactaaaggaattatggtctaattttagtgaaggtgcaaagtagactaagtggtatgctagctattttcagacttagctaagtggtagttcgagtttaaatttttttgtggttggttgtatcgtgatcctaagtgtgaaaaaacatccgaaaaaataaaataaaaatgacaccgttgcaactccatacagaaaaacaggaatggaggcggcggcgccagcatggctggcgccctcctcctgccacgtcggttcgcgtgcgctacggtggcaagaggacggcgccagcctctctggcgccgtcctgttggatgacggcggcagccactctggcgcccaaaaaaggatcatttctgggataagttttttcaggggtctatttacgaaataagttttttaaaaggaccaaaatgtgaaaaatccaggaagtaaggagtatatataagaaaaaactgtgtaacttttcatgggcagagaggagaggaagtaacgataatttatttatttactaaaggatcccttgcaaggtcgtcccctgactctgaaaaagtcacgccgggctaatcgccattccccaagggcaatcccgtactttcctccaccctacccccgccaggccgccaccaccagcccaaagcatggctcctgtacctctacggcgatacgtcaccaatccccttcacaaaaaaaataataataccagaaaaataaataaataaaaataataaaccaggaaaaataccaccaagaatcaacgggagacgagacgaggagatagagtgcgataagagagagagagagagccgagtcgccgtaggaggagggctagagagagaaaggtggtagtagagtagtagtagatttgaggaggtgagagagagagagagagtcatctctcttctttgtatcccccgtcgccaacttctcctaccaacttctctctctctttttttctcctcctcctcttcttcttggtggccgctcgccgccgccgacgccgacgccgccggcgggtctcgtcgtcggtacgtgttactacgggggccggtctgtggcccctaccctccgtcgccgtcgtcttttcttgttcgcgtgtgcgtttatttctcggccagaggttggcggcttccggcggttcttggattccggcaggattgatcggcgtggtgtttcttggcccccccgcgaattccggcggcattctgatggcgtgcttcttctctcttctttttttctcttgctggttgttttgttgagttcgtgtggggtggtaggattggaaggtggcggtggttggggggtctttgggtggtgagggaagggggtgaattctctgtgttcttgggggttgttgttgttatcatctgagcctcttaggattggttgggtggcggaaggttggttgttgccacctgccctgttcgtgtttgcgattgatttgtactacacagtgggtgcttctcctatgtgcaaatcagataattccgcggtaacaaagtcagcgtaggattatgttggtgatgatgatgactagtgtgcctgaaaattccatctttgcagtagtccttggcttgataatacagatagattctttgcagagttcgtgcacttcactgtcacaacaaagaaatcttttttcctcaagagttaaattctagtaggattcgttggattctgtaggccctggagtgtgcttgctaggtctgtgctaactgttagtggtgactggtgacaagtacatcaccttgatttcttcttttttttttcactcactatttttagggcgtttatttggttactcctttcgccgagtttcagttaaagctgacctgtgcctccacgtgacgttagtggggcttttgtcagatgatacagctctgttgaggatcgtgctggacattgctgcactgtcagcatccttgttcctttgctgtctatttgagccctcaatttccagtgcctgtagtactcttcactgtctccatggaagttgtaggcctgttgaatgttgatgtcttattgtcaacagttttgttcccagagattgataactcacatgagtttatcagtttttgtagtacgattggctcctttagattccattttattgattagtaacttaatgctaataagtaaaaagatatgagtgtgatcttccacatttgtttgttagtgcattaacccgccactaggtttgccagtcgcatctatgtgctactatcacaaaacattttttttttgtctattgatgtgaagaacaaatagtcaatattattctgtatatatttggcaatatggttaagattaccattcatagggaagaaatagatatggccaataagagaagtgtaacgtaattccagttcgagaaatggtggcagtaccaaatgccgaattagcggctgtaccaaatgatcaatgcctctggggtttcccttctcttcagctctccccggtttcaccaatgtgttgggcactgaacactgttgttgtttccagcaggctagtattgtctaatgtaatcaaaagctcttgcattaattgcgacacacttatttctctcacgatgtctccatatttgaacctaaaacctttttttatacaaccttatagtactcgcttttataattggtttagaaaatcttatatttctaactatattgcaggtggcattgaaatatggttagcttgaggaggcgccggcttttggggctttgttctggtatgagactcactgcaatgtcatgatttgtttcctgatatgtttacgtaatttttcagaggaactctgttgtgaaaatgtgctactttaattacttacaagttatatacaaagtcatcatagcatgtctttcttggttatgcttatcaattctattatgatctgactcttcaatggaacatgctatacctactctttcagattaaaaaaagcagtactgtgcacccaatttacaaatatcttgtacatgaaatttcttgattttgtttctctattggtataccatctgtagtcagcttccgttgatacaactttgcaactccttgtatacgtgttttatgttgctccccatggtgtataagttagtgggattgggaaattatgtggagaccataggaggaatttgaatagtcaatggaccttacaagaacatgatttggctgcgaactaattgcttccagcaccagaattatctgtgcaaagaatttagacgggagttgccgtagccctgatggtaccatgattagatggagcacgtataatctgttccatattgcatggtgtggaatgaagtactttaaacatttttctgctgactggttagcttactatgagcagtctttgcaaaatttattatggaaatcaataagggaaggctttctatatatgtcgtgcttcctctaccgttcttgtaatttttattcaaagatgtatatcagtgccctttgtgggttaaaaatcaattttgtttaaagagtaagttgcattgcccaccatctgattgtaaacacagcagcttgcactatttgtaagttaacacaccacttccaccttctaagttcacagaaattgggctctctgaaccaggttcagtggttcatgaacattatgtgaggtgggatgcacccaaatgctggtgtagcaatggccagaggccattcattgtcctgttaggatgctgtgccatactgaaggtgatttctttgggggcatgtctgagctggcttattcacccacacaggaggtgaaagtgaattccttgttttgcaatggcataacagaacggtcaagccgattctcaccctccatttggttagctcctgacatcacaggtcatgttggacacacctgggtctttgttcacatggatatatgagccatttcgtggatgtgcccacagaggtctcaatgcaccatttccatctcattgtcggaatgaggcaaacctgtaacaataaacatgcttttacatggtggaagagtgctcaatttgtccaaattacatggtggaagatgatattttaatgtgttaaatgtcacaagctgcggttttacatgaacagatggtgcaaaattgcatattacttatgtttaaataaatttagagggctatcgcaaatgtcagcgtcaagtgttctggtattcttttctgaagctacacgtaactctagaagtatttcagcaagaagggtgtaagttcatactattgtgtaggcacacagaaatgaaacaagggcagatgtagccagattcgtgcaactatacaaatcctaatatagtaagacatcgtaactacaaatatgctgtgtgaatcactgttagaagcacatggcttctggtgaactgttgatttgaccaacaatcgagattacggacaaaatactattggcaaaataagattatttttaagtatgactatatcgttttctcatcgcacttcttcccatgaacccaagcaaggggatcatttatgcaacacatacctccctagacagctagccaatgaatgtattatgcgtacactttgaacgctcatataatttccctttgtgtcaaggaaaaaattggtatcggttgatttttcaaagcctaatgtccaatgaaaattctgtggaagttgcacaccttaacataaagccattcattgtgcacccgttgcccttgttagttttaccccttcatggcaggtccactttgctgcaaaaatgttttgctagttgccaccttgtgttgtgtttgattattggtgagaaccatgctatcacagtttctatttatagttaatggatattacaagttatggtatattcaagcatatcaccaaagtttctgtgacagaactctgacaatcattttcgcaagttaatttaccattgttggtttaatctttactttgatttttaccattttaattgtattttagaatagtgtgaataaaataactgtattttcgcaaggctgtcattgaccataaaattatactaccaaattagcaccttcaaaaagctaatggtatgatttaaggagttcaaatttatacccactacattgataaatccttgtcaacttttactaaaatggagttaccttggcaataatttgtttatgcccattttgacttctccattaataactggattatgggtccactgcgtttttggcgggcaagtaaatgaggaaaattaatgaggccaaatgagtgaatattaattggaaagcactcatgggctcgtggcacatatttgtgaacaaataaagtagtaaaaagccatagtaaaaagttacaagtatttgtgaaggatatcaaaatcgaatgggattctgattttggttttgaacttcgaatatgtcagaaatatattcagttgctctttctctgacaataaatggtacaacctgtggcttttcagaaataacacgtcaggcactgacaagctatttcttaacatagcgctgtaagatagattgtgcttgactgctccttgtgtcaatggactactttgatggtgttctctttttatcatatctactttaccttctagtacttttatctacatggtgggaaaataagtaaaaccaatggattgaataacaagattgctgctcttgtttgttttgttgcagtgccacttttcaacagtagcttcatgtgttatactaattccttttttttcttctgtttcatatggtttgctttatagtgactccttagaaactacattattttctgatgcttctgaacacatgctatttgcactggcaacgatggttttgtttgataaaatgtacctttttgttgcagactaaaaattctgatgtacttctggaatcttcaaatgggtctgattctttaaaggaagagaaaaaccattactatccaggttcatattatttcatagtactctttgtatttccttaaagtatatagtccaggtaaattttatatggcaaatggttgttttataattcggtatcagaaatcttatctaggtacaactctataatagtcccatcaaattaggctgactttgaacttcttgaatcatgatgaaactgaatccattcttggcccaactttctcattgaagcattgaacacaacaggatatattatgttttagcaaccaatagaaaggacgcttctgatccatgaacagacttgcacatgaattgagattaccccgaacgtgatgtcgaggatgaaactgctctcaccaaaaccagatagagttgaattacataactaggtgacctgacctgggatgtttcactagagccttttctttctctaaaagattctaccttttcttttccatgaattccctttttttattcatgtacagaaactcttttgttattttatttcagatttgcattggttaccttcatccttaatgaggtatccaaaggcataagctgaacgtgtcatttttattttgacaaaaatataatttgcttccttttatatttataggcaaggaaatcaagcgcagaaaacgacatagaagaaagcagtatgtggaccaagaaccatgcataatgagaggggtctacttcaaaaacatgaaatggcaagctgctataaaagttgacaagaaacaaatccacttaggtactgtcgggacacaggaggaagcagcccgactatatgataggtattagctggacttttatgcacgattatgatatttctatctttgcatataatatcatgttctgctttgttagtaatatgctgatacttgtatacaatactataaatctaatttactttaatatcatgaagaagtgatatattgatatatgctagaaaatattacaaaggaactagctagtctgcaaagttatcggagtaatagccaaaaatttttagaagcaccttcaccaaaacagtacaatgttgctttatcaaatctgtttgttgtctcaataaactaaggtttttttattatataatgattaaagactgttaacatcctaaaagatcaatattgttccatgcttaaggtggactactcatcattgttggcatacaaccctcaagcctgtatacatacagtataggttgcatcatatgcatattacttcaaacgccacttgcatatctgccgtggccaactgatcataatttattgtgtaggagaagctgatattttgtttgaactgactagatttgacatatcaacacagggctgcttttatgtgtggaagggagccaaactttgaactttctgaggaagagaagaaagaactacagaattacacctggaaggacttcttggatatgactcgagacaccataaccagcaaaagtaagacgagaattttaaaatttcttgtggttgtcacttaatttttccctgctagtagtcaagtacatcaatatatatatcattagtagtagactataacatactttttgttcatctgtttgtcttcagaacaaaggaaagttggattaataaggcgcaataagacggactcgctggtaggacagagtgatggtgatactgagatgatcaatggtggcggctcatcgcactcggaagatggagatgctgagacctcagcatcttaattaagactgccaccagagttcatggacagccagattgggtctttcaacagattcgtttcaatgaagacataatttccatttaggtttttgttctctcaataattaatttcatgtgcataagggccctgatggtctgataaaggttaggctagagaaatcatgccatcccatataaagttggagatggtccattataggaacacatttctctgagcaaatgagcaatcatgtatagaaacaccaattcctgaactgtgtatatctttaccccaaatttctctacatgtaactagattacacatttaataaagaatttatttttcctttcaattactgtatctttcattctttcaaggaagcatgatccgttacatttatccattaaacattatatgccagtttctagatgacattaaaccttttgtttgttcccctcctcgctctctaaaaattgtattgagtacgagaaagcaaaattagcaccatgatttggccattgtcttgttttttacccccaaattatcgtttacaccacaatttcgtaccagcgtccatccctctgttcatacagacgtgtaagtctgaggccaaccacaatttcgtaccagcgtccatccctctgttcatacagacgtgtaagtctgaggccaaccgaataatttatctgtatctctactacttaaaaaaagtatgtagtggtgacggtgaagccaatcctaacggacacatgtcctatgaaaccattggattgggacagcagaccccatcgcacgcgactcgctttcctccgccgcgtggctcacgctcgcgatccaacggaaaatgctacttttgtacgatttttatacgcgatcgttacgcggacggcgcttggcatcttaacgttacgtggtgcatgcgtatgttgcagcccaagcccatacgcatatactcattattttgttttgcctttttttctctgtatccaaataaatataaaccatgccaaacattggctcatacatgaacatttgctgcatcttatcgacttatcctgatttgtgccattggaaatttagaatacttccagctaggggtgatactaccagggtccgaggtgcaaggatcatatatactccctccgttttataatataagacattttgactttttgcttgcactgtttgaccattcgtcttatttaaaaaaaattagaattattatttattctaaagtactttaaacacaacttttagttttttatatttgcacaaattttttgaataaaacgagtgatcaaacattgtaagaaaaagtcaaaatccattatattataggacggatggagtatttgtaaaactaggttcatgtcaaaataatttacttaacttaagctaggttacatgataagtgttgagcgacagtacgagtatataagattgattaggaaaaataaattactctggttagctgtgccaggaggctttaattataagatgtcaggacgatgatgtgatgagcttggggttttggatatgggccggctcagcgttagaagaggtccagtgtgggaccagaacttgcaacgttaatcagcgttatgagcctagaagagaaacgtttcatcgtacaaccgtcgtaacaaattagtcgtacgtatagcagcgccgcgatccaactggcgacgccgcgcctcccactttttcaccgcgccccgctacacctccaccgccggcgccccttggcccaaatagcagcccgtcagcccatcaggaagaggagaagtggaatgcctcgatcttttctcggctcatcccgtacgccgctactcttccacgtctctttggtttccatacgccgtgtctcccgagaacatctcgccgtcgccttccccctcgcttggagaacggcagtgggtcacggctagggacgccgcactcactggctgccggccaacccgtcgctgatcgtccagtccaggggcaacagccagcatccggccaaactttcacaatatcagccacgaataagtccatcaaggtaacaaataatgcttcatctatttatttttcaatcaacttcactggttatagacaaaactaattggatgttatttttcatattgtaggattaggagtccagtaggtttcaatttgggttcttgagaattggagtaaaactgtaaattggaggcaaattgtaagtcatgtaaactgtgattttacttgaatgaatgataaaaaaaatatacaatttcaatttctggaacgcaatgatagagcatgatacttgatttttttttctgtttcttgttaagagaaaacaaggatggtggatatttagcatttgttaagaagaaattgtttaaggctgaaattgttaattgacatagatggactctgctgagaccgggaaagaaccaactgagattttagccaatacagagataccagagcaggtcaatgactcaaacatcacttatcaaagaattgagtagataaaaaacatctgtgcatcagaacacaaaaaaaccaaagaaggaacatgtaatccaaattatgcggcaaggtacttctattttctttagaaattatgatgtattttcttttgttcaaatatgatttatttttgaaatcttccgctatagattatatttgcagcgaagaagatagttagctcataggttatgtgagacaattaccagagagacaaatggtcgtcgacatcagtggtgcctttctttacatatatgacatggcctgtcttttttatgacagtacttatgttaatggcgatgtaactacaattatgtttagtatgcataccacaacatggctaaaaataatctaattgtttttttgcataggttataaatgcttatattcattgtatatgggaagaaaaacaccttactaatagagatggtggaaaggtatttttggataacactattatttctagcattcttaaaagtgacggtgcctcaaacttaggtcacaaaaattataaggatgatactatttgcggttctatgtcattgaatattgctgtagcattagctaaaaaaattgatgggagataaaaatga

SEQ ID NO: 20691 - DNA, 23366 bp, Oryza sativa
ctacagcaatattcaatgacataaatcaaagaaccacaaatagtatcatccttataatttttgtgacctaagtttgaggcaccattatttttaagaatgctagaaataatagtgttctccaaaaatacctttccaccatctctattagtaaggtgcttctcttcccttatacaatgaatataagcatttataaactataaaaaaaaaacaattagattgtttttggccatgttgtggtatgcatactaaacataattgtacgtacatcgccattaacatagctactattataaaaaagaaagacaggccatgtcatatctgtaaacaaaggcagcactgatgtcgacgaccatttgtctctcaagtaattgtctcacataacctacctatgatctgattatcttctgcgctgcaaatataatctatagcggaagatttcaaaaataaatcatatttgaacaaaagaaaatacatcataatttctaaagaaaatagaagtaccttgcagcataatttggattacatgttccttctttggtttttttgtgttatgatgcacagatgttttttatctactcaattctttgataagtgatgtttgagtcattgacctgctctggtatctctgtattggctaaaatctcagttggttctttcccggtctcagcagagtccatctgtgtcaattaacaatttcagccttaaacaatttcttcttaacaaatgctaaatatcaaccatccttgttttctcttaacaagaaacagaaaaagaaatcaagtttcatgctctatcattgcgttccaaaaatggaaattgtgtattttttttatcattcattcaagtaaaatcacagtttacatgacttacaatttgcctccaatttacagttttactccaattctcaagaacccaaattgaaacatactggactcctaaccctacaatatgaaaaataacatccaattggttttgtctataaccagtgaagttgattgaaaaataaatagatgaagcattatttgttaccttgatggacttattcgtggctgatattgtgaaagtttggccggatgctggctgtgcccctggactggacgattagcgatgggttggccggcagccagcgagtgcggcgtccctagccgtgacccactgccgttctccaagcgagggggaaggcgacggtgacatgttctcgggagtcacggcgtggaaaccagagagacgtggaagaggggcggcgtacgggatgagccgagaaaagatcgaggtcttccacttctcctcttcctgatgggctgacgggctgctatctgggctgaggggcgccggcggtggaggtgtagcagtgctcggcgaacaagtgggaggcgcggcgtcggcagttggatcgcgagcgtgagcgacgcggcggaggaaagcgagaaaagcgaatcgcgtgcgacggggtctgatgtcccaatccaatggttcataggacgcgtgtctgtcagggttggcttcaccgccaccactacatactttttaagtagtagagatatttttatggcccatatttatggaaagattttgatgtctggagatatttatcttggtaatgatttatgtcttggtttgcataatgaattcaattcttggaatggtgtcaaactgtcaactcagtatcactctcgaatggtgttaaactatcaactcagtatcactcatcgatattcatcaggttctttcaggtgtgcacctaaatatgtttttttttgaaacctaaaagaaagtgtaaatgttggtcctaaagtgtggaaatgtttcttgggctactttgatgtagctaatgagctatgaagagtatgtcagaatatgatccttttaatgaacctcttttccggatgttttactaagcattttttttaactctctcgattcatctctgaaaaattttataggttactggccctaagtttggctcaattataaattggtttttccaatattcggtgcgacttccatagttgaggaaccacatatcaaattatatgtttttctaaaggaacatgcaatccaaattgattaggtcgactttttaaccatttagggatgcgatctttaccactttgtgtcttgcatttgcatatggaacatgtcttcatttcggattttttctaatcatagaagatgggacgtagtgttgctcgatcagggccctatcgttattgcgaagcaaattaaacagctgcagtattctgttctacatgtagtatatgaaaatttcccataacggaaggggtattagtcacagattggactaaaacctacataaattttgtcaaaagcgaaatgatgttatagtttcccttaaaacgtgatttcgttctgatctaagccactagaacgggatcggttatctttaatgggctaaaagcctcatctctttcaggtataatccccgtcactaagcaaaggtcactgatgtgagaacatatctcaatcgggcacaaggccatcacggatgaaagtcatctcaatcgggccaaaaacagtgtccgtcacagataagtttgaccaagcaaaccgagtcaaaccaggctaggaaggagcccgtcacggatgactaatctcaatcgagcacactactaagcccgtcacggatgactaatcatctcaatcgggccttaagataaaggccgtcaccgctaggtttaaccaacgtgttgagtcaaaaataatcatgggccggacgaattatctctatcgggcttatagttatagcccgtcagggatgactatatccctatcggtctaaaggttgagaccatcacagatggctctatctctttcgggcctacttgaaatgcctgccagtgatgagtatatccaaaaaaaaattgttttttggctagtctcaggcctttgctagccatgcctgcagcaaaaataatagaagcaatatacatagtcccattcccagcaacccacaattcccagcatccattcacatattctgtcatagcattcattcatccatcacagcattcatccatcacatatttatgtcattcacatcctatttgctcttcaaaccgcctacatgcatcaaaacctgcaaaactgagttataaatttaaacaagtttatatgtaattagaaatgcaaatatttacataacattgtggaaaattgtgttacaaagaatatttacataaatccaatgtttgtcgcaaacattgcaaatgttcaaccattcagagacgagctagctggaccttgactctaaacattccttgttttgacaacatatcatctagtatgaattctgctatcttatctctaatgatatcgaagttgttttccgggatccttgaaagtttttcatgtatgtgaggcgccaagttagtctacatacttggcaagttttcgtcctatgtctataataatcaatggaagcacacacctcaaggtcgagcaatgtcaccttttttgcgaagctcctcatgttatgccagacatggaacccacactggtcgccaacttgttgatgcattgggaagtcttttttgtgaccgagtgtgggatgcccttccttatgccacccgccttttgccacatattggtcccaggcgttgttcaaagcagcttcaatcgccgaccaatcgcatatgtcttttttgatattggagttaaggtagtataccaaattccacttccgcactatgaccaaaagaatccaatgacgcctgtgacattaataaattgctagttaagttttaaaaacttaagttatatgcgtcgcgcatttgattctaagtagggtacacgcttactgttgattgtaggcgcacataatgaattccttgtcttgatggtaccataagcagtccttgatatattctaccatgttggctcgatcgctgtttataattgtctcgttgatgacagctagatcgagtaaggcaacatggggtgcatgacgacagacatgcttccaagttaacctagaaacaagacaagaatccgggtaagcgatagtatatggatagtgaataccatagctcgtatgcaactatacttataaggagtagcacttaaagaggatggtgtcgatcgaccgcaccctgtagaggtcccatagatctttgaagtctatggcgatgaaggcttcaggcccgaggaatggctgtctatcatagtagcccgtcatggaggtctctctattcttcctccttgcgttggacctctccatgcagtagccgtgcaactccttgcatgcagggcccatcttcactaacacgtcatctctgaccaatggcatgtctaatgtgaattctgtcggaggcttaggatgagctgatggcgtcttgccaagatctagcttcttcggagccagaagagtcccttgcacctttcctattgcttttccctttccagcagcttttttgagtgtgtcaaggtggggtggagaagatttcaccctcttgctccttttggcaggaggagggttttaagcctctgcattaagctcttagcatgtcctaattttggtgcagatttttcatgcttgcatcatattttaagaattgcaaaaaccccataccgcgtagattctagagcatgtagcagtcactcttcatatttttgcatagaccagtatccagtagctaaaattttgccaatttaccagtagctacccaacttaattaagaaaccctcacatttttcctagaatttttgcatgcctggagaatgggttaaaaattcgaacagcacagatcaacctgtagtttcagaactgcatcatctagtttagaaattcattacagataaatatatgtgtctaaaaattgtaaatcttataccataatgcggggtgtaaccagggcatccttaggcatgtatttaaccaagaaatttatgcattcacatgttgaattaaggttaacctattgcataatagtatgctggacagaacatgataaaataaccataacaccatttccgagttcctaatgagtttcaattgaaattctaattggtctatgcttccaaaggttgtagatgtctactgtgtggcaaccactaggctattccggaggttatgaggaaggatcattgcctcacatcttgtggctcatgctgcaacatcttggccataaccacccaccggagtatcatttcttttctcttgaacggagttcatctctccgagcttatatggctgagctgtgtatacaaggattttggacccatgaatcacccctttactttcaagcttatggttgggatgcaccctcagcaatgcatgaggccgcatttcaagcgattgtgtattaccgacaccacaggccagggatggatgggttctttcactattttccaactcgtacaaatcaagcaactgccaattactatccaggtcttgagggaaacatgagagagattgacactccacagcttttcttagctggcctagtttgtgctatggatagatatctcgcgaatactatggctgagttgcgtagattgcaagctagagtggtcatgcttgatagacgaatagaacaacttgggcatcaagggcactttgataatgccattatttatgtgaatcatgaacttcagcctcttactgagaccttgcctcctcccgtgggcgtttattaaaacataaacactagagcccacatgagagttggtttccaccgcaatcgtcgaaccatgccagaccctgcacttgttggatatccggtgttgctgggaccattctacgcatttgagcggaatgggagacaataccatttgaccatggccactccgtcaaccacggtgcctcaatctcctatcgaattctcccaagttccatagaatggtgtactaaaggaaaaatgtatggggtgtaactttcatttctttttccaaaagatgcatgagacgacaccctattatgtaatccttctaatggtaaaaaatttgtaacaccgaggcatgaacttggtttcttatgaccattatccaattctatgtatctatgatcacttagatcctttgaaactgatgtactggaatgagacttatgctccttttggaatgaattgcttgctgtccagaaatttgttttatgcaaatatgaaatggaagacttgtaaattcagctataagaaatcattcctgtgttctacatatttagggtgatgtatatgtcaagtctttgcacaaacagctcatatacttgtgtaccttgagtgcaggatgacaaatactcgctctggagctcactctgcagaccgtgccgggggtagtcgacgtactgccaccactgagcagcatgacgatgaaccgtcccttgtgcaactcttagccaatcagaaccggctctttgaaagaatggtggcaaagtctgagaacatgggggctgctatggcacagcaggctaaccaagcaccttccaagttggcagatgttcagcgaactcatccgccacatttctcctttgtggtgctccctgtgtatgcggtccagattttccagtcttcgggtaaggacagttaggagaataatgccccttcttgccgcaattataacatgcgacattatcattacgagatgcatctcccgcagcttgaactgtgcgaggaacttgacggactatctgagtttgtggacgtggaggcacatacatctgccgtggtggctgaggcgccatgggacgaaccacaggagatggagcaagacgaggccgagtggagctgctgccacttgcaaatttctttgcagcccacttgcgcttacgatcttcaacgacttccttctcacttgattcgacacgaagggctttttcaaccagtgacttcatgctagtgatttcatgagcagtaatagcatggttgagttcaggtgcaagacgatctctgcatagctcaaccttctttgcttcagtgttcatgtcagcagcgacatatctacccagatagttgaagcgttccatgaactccatgaaggtcatgtttccttgcttcaagttaagaaactctttctttttgatctccatgagaccaggagggatgtgagcagatatgaatccttcccagaaaacagtccaattgttaggctcatcagaggaatgagagtcttgtatgtctcccaccaagcagctgatgctccttgcaggtagtatgcagcgaatgtagccttctctacaggatcacactggcaaagatttagcttgattttaatatcacgaagccaatcatctgctgcgagtggatcagctgcagaggagaaatgtggcggatgagttcgctgaacatctgccaacttggaaggagcttggttagcctgctatgccatagcagcccccatgttctcagagttcgccaccattatttcgaagagccggttctgattggctaagagttgagcgagggacggttcatcgtcatgctgctcagtggtggcggtacgtcgactaccccaggcacggtctacagagtgatcaccggagcgagtattttccattctgcactcaaggtacacaagtacatgagctgtttgtgcaaagacttgacatatacatcactgtaacgccccgattttcggtcgggattaaaaatcaattaataatgcattttctagaaattcaataaaagttaaagtaacttaatcaagtgaaataatgggagaattaaaattttcccttaaaaaaatcattggccgaaaatattttataatattctttgggtcctaaatattctctgaaattttcccgtgaagtttcggagctcaagaagtaattttaaagtcacaaagttcattaaactcatttaaataaaaagaaaaaccaaattaaatccctttcctccctttttgggctcggcccaactccctccctcctctttcccggctaggccggcctccctttcccctccctcggcctccctcctatcctccctcgcaaaaagtcttttttgcgtcccttcctctctcccttcgctgacaggtggggccggccccttcctccggctccaaccgccgccatggccgcctgagcctccccacgacgctgccgtttccgccctccttctccaccccgcgcacgagtccgccggccgtgggaccccgccgccccacgtcctcctcatcccccacctctcccttccaaaaccgccacccacaccccacgatgccgcccacgccgccggcggttgccgccccgactccgcctctcccgggctcggtccgacctcccctcccctataaaaacattccccgcacctccctctccattttcccctctctcccgagccctcctgtgcacgaaaaccacgccgccaccgtgcacctctcgccggtgatcctccagccggccgccaccgctgctcctgccgccgccgctccgcgcgaccgccatcagcggcttcgccgcgtcgtgccataccccggcatcccctccgcttccccattgtgtcgccgaaaccacctccccacggcgctccctctccccaccactcatcggcgtgctccagccgccgcctcccgccgctcctagccacctcaagtcgtgccgtcgccgccgctcgcttcgcagcaccgaggagcacctcggccgccgcttttcacgaccagaatcctgctgaaacacggttcccctcgcgccggtgagcatccgccgctctttctcacctccggctggcgattcccgccgctgggagcccctatcccattcctaacctttcccttgtcctccccaggtccttccggccgccgtccgccggttcccgctcgcggaacgccggcggccgccattccgccttcgtcccgaggagcgtcaacgccgagcttccccgtctttccccgcccctcgtcgccgtgtcctcggtgagctcctcctctccctcctagcgccgtgcgccatcacttccgtgcgtgcgtcgccgccttgcgcagccgccgctcgccgccggtggcctttgggcccggcgcgtcgccgcggcgctgtcgtgtgctcggccggctagcttgccgccgtcccgctcgcccgtgccgctcgaccccctggtcgcgccgctccctcgcgtgagccgccgccgccgctcgcgtgcgccgcctttccccacgctgttgctggccgtcgccgccgtgccttggctctgccgggccggctttgtgccgcacccgtgcccctggccgccgctcccctcggccgctcgatcggctcgggccgatttgggccgtccacgtggtggacgcgcacccgaggccatgtgcggacttggtccaccgtgcgccgcccctttgtgccgctgacgtgcggggcccgcgtgtcggcgccggcctccccttgatgacgtcagcgcgtccctattcctctgagaaattaatcattaattgtgttataaattgtatttaattctagaaattcatttaaatggctcaaaacttctaaaattcaaatctaattcatatgaactccgaattgagccgttcaacttgcaaaattcatctaaaattgagctctacatgttttttttactttttatgtactgttcccttagtgtttattagagtttttccttgttttgtgtgccagcgtatagaatccgtcgtttcggaagtctacggtctcgaggaaaagagttcagaagataaaagtgaagaagcaaggcaagtcacacatcccccttgagcatgttgatccaaatttataaatgttttattgtttgcaaataaatatgcatcgttttactaattacatgggtatagggtttacctatctgcttgcttgtaccatgttatttgatatgtgtcctttgtcaaccttgggtgataaatcgactagcttatgttactttgatgacctagctagaactatatgcttagcgatgcttaattaccactagctcagtagatgggataattgcagtattagacatgttagtattatgatgagctacgtgctcgagacatctggccatgtttcatggtcataattatccaactaaaatacgactgaatagcgggttgtgggtgcatggttttgctggtcgcacccatggcaattaaggaccggttcgcgggatgcactagaagacatacaacgcttgccacaagcgggaatgggtaactgcctgccttgaagtgtagcttttctctggttgacgcatccaggcaagggtgggcgtgatggagcagggcgggccctgcgacggcctctgtcgcttccggattcacctagccacgagaggggactgtccgctacctgctgggggcgggggtgaagcctgaggtgtggtgtgcttggtcagagcgggttatatgaagggtcttgtcacaatcactcgacatggtgacgtgtctggccgggcacggtgacatgccagtggattgtgtcttgtgggtacagttgtgcacctttggccagagtaaaactattcgaatagccgtgcccgtggttatgggcgatcgaccagaatcaccgtgattagtctcacacttaataaatcgacccaatgcactgtagttcaggtgggtttgttgggcctgttcaacgtggtgtagcgttgaccagtggagatttaatattaccttaattactcaactgttttactgtttgctaaataaagtgttttacaaccgcctttatgcaaatagccaccaaccgtccttgtatccccttgcacgtctgcatcattggtgtggcttgctgagtacggtggttgtactcagccttgctattattttcccccttttaagaagtgtagtgcttctgagctaaagacaaagttagaggaccaaggctcagaccccagttgagtttttgcctgtggagtggagctgaagccccgctaggattgcctttttcagctgctgctgctttcgtttcggtgtgaggactaagtgcctcttctgtaagtattttacgctttatttacgtttggatctgtatatttacttgtcgttttgtgtaccccggctggtcctggacagggatttaatacacaaaatagtctggaaatttgggctaaatttatgggcgtgacaatcaccctaaatatatagaacataggaatgatttcttatagctgaatttacaagtcattcgtgtcatatttgtataaaacaaatttctggacaacaagcaatttattccaaaaggagtataagtctcattccagtacattagttccaaaggatctaagtgatcatagatacatagaattggataatggtcataagaaaccaagttcatgcctcggtgttacaaattttgaccattagaaggattacataatagggtgtcatctcattcatcttttggaaaaagaaatgtaagttacgccccatacatttttcctttagtacatcattctatggaacttgggagaatccgataggaggttgaggcaccgtggttgacggagtggccatggtcaaatggtattgtctcccattccgctcaaacacgtagaatggtcccagcaacactggatctccaacaagtgcagggtctggcatggttggacgattgcagtggaaaccaactcttatgcgggctctagtgtttatgtttttataaacgccattgaggaggcaaagtctcagtaagaggttgaagttcattgattcccataaataatggcattatcaaagtgcccttgatgcccaagttgttctatttttctatcaagcataacgactctggcttgcaatctacacaactcagctatagtattcgcgagatatctatccatagcacgaactaggccagctaagaaaagctgtgaatttcaatctctctcatgtttccctcaagacctggatagtaattggtagttgcttgatttgtgcgagttggaaaatagtgaaagaacacatccatccctggcctgtgatgtcgataatacacaatcgcttgaaatgcggcctcatgcattgctgagggtgcatcccaaccataagcttgaaagtaaatgggtgattcatgggtccaaaatccttgtatacacagctcagccatataagctcggagagatgaactctgttcaagagaaaagaaatgatactccggtgggtggttatggccaagatgttgcagcatgagccacaagatgtgaggcaatgatccttcctcataatctccggaatagcctagtggttgccacacagtagacatctacaagcgttggaagtatagaccaattagaatttcaattgaaactcattaggaactcggaaatggtgttatggttattttatcatgttctgtccaacatactattatgcaataggttaaccttaattcaacatgtgaatgcataaatttcttggttaaatacatgcctaaggatgccctggttataccccacattatggtataaggtttacaatttttagacacatatatttatctgtaataaatttctaaactagatgatgcagttctgaaactacaggttgatctgtgctgttcgaatttttaacccattctccaggcatgcaaaaattctaggaaaaatgtgagggtttcttaattaagtttggtagctattggtaaatcggaaaaattttagctactagacactggtctatgcaaaaatatgaagagtgactgctacatgctctagaatctgcgcagcatagggtttttgcaatttttaaaatatgatgcaagcatgaaaaatccgcactaaaattaggacatgctaagagcttaacgtagaggcttcacaaaaatctggtggcctttatatgacaagcaatctgtggttaaaaacaaatcaattccatcctgccccatactaccattttctaggccatcaatgaaaaattaaaattttgaatttaactttggaaaggagtaattagccatttatttactgaaaagttttaaaatatttcaagtactaacttgaatagaatttgtttcattcatttcctagtcttttctatgagttattacttttttatttatgcatcatccaatcctatagaataagatgtggtttttaaaatcaaaacaagattcaaaggaaagaaatttatccaaagagggctaagaagtaataatatattagattttgcaaaaatattcttagtgaggatattatcctcaaaatattttcttttgaagccttgctaccattcaatcttagaagggttcctgcgtcggtcttgctctgataccaatactgtcggaagcactccaaacctcttattatatttgaaggatgaatagaataactcaattcttccatcaaacataataagacattcaacgctccgagagaaagatacatgagaccttgctgggcctttagcctgccagtcaacttcagcccagatgtgcctgtcaagccactcgatggcagcgaccagatgtgttccacattcaggatacttgacacaaaatagctaaagatctacatgatctcaaatatctttaactcatactcatgtttaatatgctcctaacaaaaagaacactctaaacactttcatccaagcacatgatatctctaacataaggagttctaaattctaagtgttagttagaatcatacaacatagtacttagatacatatggccgaccagccaaatagctaggttcgcggaagcataatctacccaaaagatctttcatacaaccgactagggtagaccctagtaagaaccatcctagaagaacgaaacatcccctgcgaaatcctcctcctcaggagtgatctcacctacaaccaattctaagcatacaacaaaacaacaattcatgcgaaatcatcctcctcaggagtgatctcacctgcaaccaattctaagcatacaacaaaacaacaattcaagcaagagtcagtacaaataaattgtaccagcaagcaccaagcaaggctaatacactacatgcatggcatattcaaaataaagcttacattggatattttcagcataaagcatattttgtttgcaaagaccattttcaaattcagatttctttttaattaaatttcagcaagcatacacttagcaaatgggcatcaaagtagatgttaatcacatataacatagctccttattgccttccatggcagcaaggacataatccacaaatcacaccacattttgaagtttaaattcagcttatggaagaatagaacacaagtctatactcatgacatattcacacgccgctcataaccgcaagcacggctaatcgattagttttaactctgcagagtacgtacactttacccacatgatgcgatataataattatgcaaagcatggcatgcgatacataagtatccgatttattactcacaacaaagcccttccaaaattcatgatttagccttacaccagtacgatacgtgtttctccatcctaagccatattcgatatatgacctagaaccgttaagtggcgggcccacgccttaaacttaacgccgtggtggcggacacgacgggaacccaccacgtggcataataccgttgtattggacatgcttagtcacctaaactaccacatcagggtaaataggaagctcctctgaattattcgaactcatacacaccggcctaccagaatataaggctaaaccataaataatttactaagcttgggctatcccatactagcacatgtggttgtactatatacgaaatgaactatacgaagcgaactgacattgagtgaagtccccctatccgcacacaactaatcaccatatgtgtaccacataaggcccaaacctaaaatccacattttctaacattttatttaacaaatatcacattttattatttctatccagaccataaagtagatcattttatatacatagttgagccctggctaagcattttcatagacttgtgaccgcaaacatcataattaatgtgacaaaatgaattgttcctaaggctaggaataatggctaaggtcttttgtggagtttaggtggtaatgcaagttaaggagttgatctaataaatttttacaaagttttagtgaactagtgtataatcaacatgcacattttgcaatccttttcaaataacctccaaatcataggttcaatgtgatcaaagaggggaggtagcttgccttgctcttcccctccttgctcagctacgaagtgggtctcctcgtgattcgactgcgaatcgtctaaacatacatatgcaaaatcaaaattataaacatacataaaaatccaacatgctctaaaatgaatgtttttcatagattaattgtgttatgtgttacattgatttttagtgaaataattttcattttaacagttttcatttaaaagtttcaaatttttaaagtgtcttcatattaaatatagacctacatgcatttcggatttttgagacataaatcttcatgattttgtttagtcgaacatttttatgatgcagagcataaaaatatgattccaaaaaaatttagtttgtaaatttcagagttagaatgaattttctacaaatttctaaaattttaccatttttcagttgataagaaactagttttgcattttctctatttttctcaaatcattatctctctcgggtccaccggtcagtgactatatttttgcgcataagtccctgggttctcaagaaataggtcccgcagcctctaagcacgtgctccaggattttattcaaaaaggtgcttaagttttaagttattaccaaatgagtaaatggtcccacatgtaaagcgtctgtttacccctggagatttttaaatttcactaagccatgcccttgctcttgacagagcagaggagcagctctcccgcgagcttcccgacatcgccggcggtgaacagcggcgattcagttcaagctcccaaaacaaaaggtgtagaggacaaccgtacgaacctataggtagcttttttgcaagttttggtggtctatagcggcagttaggatgttagaagcggcggcaaagcacagcttgcacatgcatgccatgatagagactcgatctgtttgtgcatgtgtttgctgaaggtcctagggactaccagaaagctcaccaagcagcgaacacggctcagcacggtcttggcgatggagagctggtctggcagcggcgcagcggctacggttgtcgttggcggtacacctccggtcttgatctattcaaagagaaggcatgcatcgatttgagatggcacaagacagatttaggcgaaaaagcttgcgccgaagctcaccagagaaggaagaagagaggaatggcgtgggcggccggagttggggaagaagatggagatctcccaccatggttcaccacgtgcctattccttcgggattcttggtcaatgggtgctggtgaagatgatggcgagatggcttgaccaatggtggactgtggaagccgggcgacgagcaaaggcgaagcggcggtgtccagaacgcgacggcgttccgagttgacgtggtcgcgttcccggagattggctgcaccaaatgaggcgttcttggtggcgttagagagggtagtgagactggattagagaatggaaatggagctcaccggttagcaatggcgtcgaggacttctctcgccggtgccgagaatggcgcctctaaaacgtaggctctcttgaaatatccgatgcgatgccttgagagaagaatattggagacattgcttgacttttagcctgccagccaacttcagtatgagatgtgcccgtcaaaccactcgaaggcggcgaccagatgtattacacatttaggagactgacaaatggctaaagatctacaacatctcaaatatttttaactcatactcatgtgaatctaaattctcaggatgtgcactagattcacactttcatcttaagcatggacgtacatagcaaagacatttaagacgaaagggacttagagacttacatcaatttaatagttaagtaggccgaccggccaaataggcatattaaagaacaacggaagcttgactacccaatcctcaagcacaccgactaggggttcactccattaagttcacatcctagaagaagcaatcgaaacccgcattcacgatacgtgttaattcaatagcacgaaacctttacactacttaatttctagccttgcaccagcacgatacgtgttcctccatcctaggcatactggaaataatacctagaacagttaagtggcgggctcacgccttaaacttaacgctgtggtggcggacacgacgagaacctagcacgtggcacaatactgttgtattggatagacttagtcacctaaaataccatgtcgggataaataggaaattcctctgagttatccgaactcatacacaccggcctaccagaatgcaaggctagatatgctaagtagataaatcagcttaggccatcccatactaacacatatggatgtacgaataactttaagttggtgacacaagtttggtccttacggacttgggcaaacactccccctatcggtatgcaactaacaccatatgcacaccacttgccgcccaagtctaaaatcacattttacacattttagttcgcaaatactcatcatattgattttattccagcaaaggttcacatatcaaagtcacattttaattatagatggaatgagcatttgcatatttctaagcatggctaagcaagtagttgcatatacattatatataaacccatttgagcacaaggaatatactctaaccatttctaggggtacaaactgcaaggatcacaattattcaaggtagggaatgcagaaaaaaggtcatataccataacaaaaatttaaatatcgatatagtctaggtttgcatgcaattttgcaaacaaatattttcattcctcaaaccataggattcaatgtgttcaaaggatgggaggagaacttgcctgttcctcagaaatgttagcacctaagtaacctcttcactgtttaggcaattatctatataaagtatacgttatgcaattaaacactgaaataggcaaaaatccaaaatgctctaaaatgcatgatttgtgtactgtgggtaggtactgatctaacatgaatttaggtgaaagaatttttattttatctctttttatttgggagttattaattttagaaattactcggtatagggtaatatttactaggttacgtagtgaaatgtttttgtaaagtgacttttattatgtttgacttctctggagtgtagagatatattttattatgtttgacttccctttggtttcacaatttttggagttatcatgaattttctatgtactctacaagttataacacgttctaggcatatagtttctatgtgtatgtggctttggaggtttaggttcagaacttgttccatcttgctagtgatgtataaaatgaatgatttagtcaatcaattaaattttagttcacaaattttagagttgatattactctactacacattttgtaacttagggaatattctatgttaatgacttaacatatcaacctagagtttgttacacgagctatgttcatctaggttttagtgaatgaggatgaatctatagcttgtctagtctaacaaattttagttaggtttaattagagctagagtgcgtctatatatatatacatacctatgttttgcttaatcaacactatatgattagcacttgttttatcaaattaaggttcagagctataatttgtacaaaaagtgccacattatactttactaaattaaatttcactccttgctgactccatagaaacttggttcactctatatggactaaggatgaattttctacaaattgtataagttaaaggctaccttacgttggttattccttacataaatttttttagaggctttcattatacagtatgcatataattttattgtataacatggaagtataggttttggtgattctacagaacctgaacttactcaaaaaggagttaaaatgaattttatataaacttctaaagttcaccttacacaaaactaattattttgaagatattagttttagacgtatttggcttaaagtaagtatataattttatttctcctatctagagtgtgcatgttggtgaatctgtagaacttaagtttgttcaaaaataagttgagatgaattttggttgcattttataatttgggtatgctttatgtatgatttatcttggataaattttagagacaaaccttgtacagtgtgtcaatttttatgtttctaaaataaatttcataactttgtgaatctatagcaactggaatcatctcaaaatgagctacatttgattttatatggattttacaagtttgagcatttttctgcagaaaatgtaaagctttagtgattttcccttatattttcagattttaagttcatggggtccacatgccatcctctgctaatatacaaaaaggcccctatggttccgaggaatagaacccgcagtccaacatgtgtctatgccacagtttataaagagtccccatttttctcttgtattttcgctttagtcctttacctacatgtcagtgagtgaaatgtctcacactttagtccttacactttatcgaattcgtgaaagagatccctggcttattcctgtacaggaagcaatacagggcagcggcttggccgagctcgccggcggcgattgactgcgatttacgcgtgttagagtttgtgtcgaatatgtgtaggtagtcggttatagtttagaacttgaagttgtactaggtgtaggactagagtaagagtcggactctatcctaagatctctcataaatagaggggtgtgcctgttgtaaccgcatggcgacttaacatagcgagagggagcggctgccggcagcgaccggccgtgagtcgttgtaactctgatacgctgtatatgctggattggggaggagcgcccgtaatcagtgccccggagatgtaggcaactccgttatcaaatatcgtgcctcggtgtcgttatcatgtttggatctcctatggcgtatgtaggcctcggctgaactccgttatcaaatatcatgcctcggtgtcgttatcgtgtttggatctcctatggcgttttcttccgtgtttcgtttggcctacacaacccaaaagactagtctgataggtgagaaccgcccccaccttttaagtcgtgctcccccatcatcaattaccgatgtgggacccgtcacatcaacccatgtgaccccgaagacttgttacctggcctctccaccatgtgacccatggaaattgtatcttttaagtcgacccgtcacatcaacccatgtgaccccgaagatttgttacctggcctctccaccatgtgacccatggaaattgtttagaatgatgtgggacctgtcacatcaacccatatgaccccgaagacttgttatctggcagatttgttacctgcctctccaccatgtgaccccatggaaattgtttagaatgatgtgggacctgtcacatcaacccatatgaccccgaagacttgttatctggcctctccgccatgtgacccatggaaaatgtgaccccatggaaattgtttagaatgatgtgggacctgtcacatcaacccatatgaccccgaagacttgttatctggcctctccgccatgtgacccatggaaattgttccgggttctaaaccttgggctctgataccatttgttagagtgtgcagcctggcccaccaaccgtgggccacccaggtcacattggttctgctctaccacaagcccaattggagccacaactttaggtcctgggcctacacaaccaaaagactagtttgatgggtgaggatcgcccccactttttaagtcgtgctcccccatcatcaattaccgatgtgggactaaacccaacaacgcagcggtgcgaccagaagcaaaaagatgcagcaggtcattgcgaagctaatggtggtaatcttgctagctacggtggtcgtaattgacgacggcgttggtgcgagcgaaggtggttctcggcatgctaaggcatgtcgagctccggctcgtttctatgcgaatgggtgcatgcatgtgtgtctactgggttcttgggtactcattgaagctagacccgcagcttggattggtctgaacatcggtgacagtggagaagacgacctggcagcaacggaaatcggcatggcgacggcgtcgacgttccttcggtcttcgagctgccaaggacagggggggaacggcttagagggaacctatagatgctctacgagtgaggaatcgcgccgaagctcacccgagagcgaggaatggacgacgatggccggcggctggacttaaggtaggcgacgccgatctcccttacgttgcggcattggctgggattcttgagggatttccaagaggaggtcgtggtgatgatgatggccacgggttcgcccggatttggtcccggaggccggcgcgacgatggtgatgcagcggtggcactcggtgcgcgctccagagcgtcggagtgcgcggtcgcgttcctgtttaaccgctgcatggaatgggacgaaattagatggaacggagacggcatcaagagtagattgaggaacgcaaaagaagaggaaacgagcgcggctccatggcgttggcgacctttgtcttctcggtggccggcgatggagatgagggcgacggagccctcagtttggtcggctctggagtgaggagtggagatggacgacgcggctggaagagtggagtggagaaggcgagctccgcgttggacacgtcgaggccacgcgtcgagcacgaccagagctcggtcggctctgattcccttcgctctctctctctgtctctgttttcttgtcggctgagggaggttaacaagtgtaaggacaagccagtgagattgtcatgagggatgggtaggttcttgactgaaaatcgattttcagttatttacaggattatttcttttcccatcttcgttagttcttatattaatttatggtgtagataaatccatgtggattttactggaggtaggtgaatatacctagtttttattttttttgggttgcactaaaaaattatgtgtagtttgctctcagaaaattagagaaaataggcttggtgtaaactagtttataaatttttaggaggtctaaacagatgaaataaattctggaaaaattatatttattcatgataaatggcctttcactcatgcacttatatgcagtttaatgcgtattttggtgagggtatgttttagccgattaaggattataattagcctactatttgactggtttgactgatttatttgaggtataaaatttagttattaaattgtacgaaaattagagtgagttgtatgtgttaagtagagcctacatgaattttcccatgattttatcttactcaaattattttagataattagcaagacttatctttatatatgggttttcctcctcataaatgcatctagctatttataaaaaaatatatttggaatctcttgacctaaggtgaaatcatttaacatcattttcatgtctttataattatttgctcaagagtggtgtcgaggagagatcctctctagtgggtggtcgtgagaccccctttgtgagtttggccgggggagatggcgcgatgatcaagagcgtgcttccgcttgcagtctagccgctagattgctacctagcctctgtgaaagacaatggattatataggttcgggccgctatcgagagcgtaataccctactcctgtgtgtgggattatggttaacttttacaagagattttgagctctaagggaaacccagctgttcttcctcatgagctcaagttgtctgagagtcatccctttttccggtgggcgaggtcctccttttatagttcaaggggataccacatgtgccgcctatacctacccgtccgtgaaagggggacccaccttgcctgggtcagacggccgtacgtgccttcaaccagaagcaaggtggtcatgcgtccttgggtggggtccaacgccgtcccccgcctgacacgggggagatccctgttattcaccattaaacgcatggagactttgaaggctcaccatgcgcggagggcgctcctaggaacatgctgatgggacagggcatatctgcccccactccgcctgacacagagcggaacgtgggggcactgccacccgtcccatcgtccgcgaccagtcaccgaccggtcgtgctcgattgacaggggtcaatcgagcggcgccacacgcccaccaacaccgcattaaatgtggcgcgggacggttggggcaccgtgcattgaaggcacggagcagtgtctcctgctctgcctgctctc

SEQ ID NO: 20692 - DNA, 5588 bp, Oryza sativa
gccacgtggccagacgggaaggcggcttccctctactgtgcgtacccccgggcccatatcaccgacaagtggttataggtttgattagtgaaattttatcttttatttatgctcatgaaacctaatatgcaatgccaaccaaaaatccaaatgcacaagaaagactcaaatcaaaacatgtcttatgcaagtatgcatgcttacacttgtgtttgcatctatgttataggttaaagatgaaaaggttttaattttttcttaaattttacttcagtaaaagttgggttgaccacacctaagttaaaaatggaaatttctggctctcaaaaaatggaaaagttagcttcctactatttttgacaagaattccttaaccctagaatttgggtatgttaaggggggaggtgcggcctgctgtcgacctccgtaccgtcggcaccaaaatctgtaccgtattgcaattgcagatcttcatctccttcctcaacgacaggaggggcagatacaagagttggagggggatgccgcagcggtggacgagaacttggtgctagcctaggagttatgttgatctgaatgctatgcttgggccattgaataaaggtcccacgtgcagctccaagggtcataatctcgtcatttggtgggtgcgagagagtgaagctaacccaatcgagcttcactaagtccacttgaattttgccatgcccagctagcagctgcgccccatgcattcgggtctctggcgttggcttgaacgcttgaccctctgcggcaggaattgcaaatgcatgtgtcaccctaacaactagggtgcatgatgtgagttcctgagatacattgatacgtatccttagaatatgttagaacgtattgtggtgctaagacaacaaatgcatttatttcttggttttaccgttatgtggtccaccgcggtgggcccttctggttgttctcccgctgcctcagttgatgcgcagctgctacgcctctgcgtggggctcgctttcccttaagcatgtctccacccgagccttcacttgcaacaacttctcatcgaactattctctgagctcttctctaagctccgcacgaagttgttccttaaggcgtgcatatttctgtgcctttgaaagcttgtgcttcttgtactgccacgcgtattggggaaacccaagcttccagggaacactggatccaattccccttgtccgtccacggtgttcttcggttcccaacgctttcgtgaggacgtcatcctcgcgactttgtgaggagacctcttgggaggactgtttctcaacagtcagttcgacctgtggtacagttaggatgaattagatgaagaatacgatataacctaatgaaacttattctatgtgttgaacttacgattttctggtacaccgcttgatcttagggatttaggaacgaaagtgttccatcactattcttcttcacccttgcccttgcccagtttcttgcccactgcaccgggatatcaccaagcacttgcggggtgttagattccgcagtagcttcatcctccttatcccattccgcctgtttccccgtgtagtctctagtgcgaagccggtgcgggtgaaggttctttgcctgcagctccctataggcctcacttcttgctcaagacttaggggttgatttggcagcatggaactcttcccacacgacccgggtgatgaacgggtatttaacaaatggttctgactgggcagggttgaggacgtagtccgtgaccagtgcggttttgaaatttttctacaagttccccatcttgcggatagcctgccgcttgagtcttgcctaggcctctgcagggtactcgaagctttccttgaactgcttccaagcctcttctttttctgcctgtgggaccagaccgatgtggtcctctagaatggtgaagttccgcctccctaggactccgcatatcgctgggaattttttgacagctttcggaggagccgtcggaaatccaagctcgtccacctctgttatggtgtacacttacttaggaatcctattttgggtcctaggagcccagctcgaagttgtcccactagtagtcactgacattggttcgccttgctgcgacattgcctatgtaactgttgtacgggaagaaagttttaaaaaaagtactaagcacgtatatcttcataaactaggaactacatgtgtattctacacaaattcacattgtattccctgatggtttgatagacctctatgtcgtacctgcgttcgcctcatcgacagaacacaagcatggactctctacaaggttggagcagaggagaactcggcctcgacatcagtgtcccgctcgaacttgctagcgacattgatagcaagttcgagcgggatactgatgtcgaggtcgagaccccctctgctccgggcttgagaaacattgatgctacccgtgtgtgcaaggggtgcgaaggggtcactggtcaccaccctgcccctttctcatttctcccccaaaacgaaaatgctagggtttgttgctgctgcattgctcatcgccgggctcgacctcggccaaattcaggaggaaggagatgggcgggaggaaggagaagacccagagaggattttacatcaggaagctcaccgtcgcccttgcctcgccatcgccgatgtcgcccccatccattcctcggtgtccgcgctgccgccacataatccctttcgcgaccgacacctccagcgcttcccatcggatctggccgccacgacggtgacgggggcgaccagcagcaaccagcagcaacaaccatcgccaccatgacgacggtggcgagcagcagcagcaaccatcgccaccacgatgaccacagggagcggcgtgccggtgcggctagagagtggtggagcaaaaggagtggcgagcggtgggagcgatggatgcggtgattacgatgacagcgaccagtcgggctcggcagagcaggctgccagcggcaagggccgtgctcggcggcgaggagtgagagggtcactcttttttttttctaccgttctcattctctatgccgtaattagtcactaatataagatatactgtgtaatagtactacgaactccactacatgagctcaaataatgaattgttttacccagaaaaaaagatcctcatacatacggttcatacaaccaaccaaacaaactctcctctaaaccgtatctcttgtgcagacaaccaaacaacatctcatactagccaagctagactaatgcaaacaaccaaacgactgcatgtgtatcccattaattaggataagctcaacctggataagggagatgagccaggctagacagatacgagcaaccaaacacacccttaagtactgcaaatggttaatcaccttgacatttctcttgcataatgccatagcaacggctcgagccaccttgtcaagatttcctgcaagaataacttggtctgtccttgaggctacactattggaaaccaccgcagctgctaggctgctgccctgccatccacaattctagtcctcaaactttggctgctgctgatgaagataatgttctccgtttccattgagattacgtgcctgttttcattgatttataaactcatattcttgtcattttcgtggccttctcaggccaaatgtatatatgcatgattattcttttttctcacctggtttaggagtccaaggctgaaaactttagcacctcttctgtcagcttcatgtattgcctttccaatcaagtcgttgatagctttattctccctttttaagtggtactacacaaacaaattagatgcacgttcttaggatatactactctttgtccctgcattctaattagcataatcatcattattatgaatgatcagatattaattcttacatggaaactgtatcttggtatggcccatgtctgcatgttgaggtttttatctaggacacttctgtcgacagcaaatggagaagaactgaacgcccaggtacacatggcgatgagccatgataggggtgacaagatggttatcatggaccagttactttgattgtatcctctagcagcaaacatggagaatccgggcctcagatgataaatggattggaggtcggtgagatgcgtgaggtgaaccacatccagggatttctccttactgatcttgagcatgctctcgtatagggtgctagatgatttatccatggtattgtagatataatcgtagaatggcatgtaaagggagtaatttgtgcggaactgcgtgtggtgaagagaatgaaacctagcagcggaagaccaaagttcaaattaagtagaaacgattttgtaatgtgcatgtaatgtaagtataaacaacagtttggaatatcgatagagatcaagaaggaacatgaggtacttacgaaggggtgtacataaggtacttgaggggagggaaacatttgaagagataattgggaaccaactcaaaattgcagtggcccaagttgttcatgaagtctatgtagaatatgtaaattgcatatgcaaggatggagatggttccagtcaacaagcatgtgaccactgggattgcaaaagtacatcataggccactaactctgcaaatggatggacgacagctgaataggaataacggaatgatcatattagtcattgataagctcaggttgagtaaccaaaccccaaagaattaaattgaagtgataggctcgtgtctaagagagcatgagagttttttttttctcgaatacgtatgagagttgcatatcattgcattaaagaagaagaagagaggtgtccaagacgcaaatacaaagaaccaaaaagcaaaacacaaaaagagagcaaaagaagaacaaagcacctcaacaaggttgtcccaacaacctaatttaacaagtcttgttaactaggatcaataatcaacgaaaacccttggctcgtctatgttagagtgtgagttgtgaagtagtttgtgtttggtttgtgacatttgtcaacaaagcaattacatcagcaaaagtgcatgtcacctcgtggttgcagtgacctaagtagcatcccaagaacttgagttcaaatcttcatagaagcgaatttcggattgggttgtttgaggggctaagttcctaattttaaacagccccactccggtgctttctactcggagtagaaagaaatctgggccattgatcgtatttaattgtagggctgagatctagttctactcccaccagtattagtggaagtagaaatgtgaaagggtgtttttgttaagggaaaaaaatcgcgtaggggtattatcgtattttttcagtctcttactcaccctatccctatccgattcctctcgcatcatcaccatttcaccacttcccgtcgccattcccctccatccctgcctccgtcgccgtccatctccctcgccgcctccgtcgcctgtcctggtgtctgctccccctccagcgccatcgccttctccgctccctcactgccctcgccgccttctcccccgccagcgcccctccatcgacgtccgcctccccgcctcccccgctatc

SEQ ID NO: 20693 - DNA, 7164 bp, Oryza sativa
cgccgtcgcggttcacccctcctcatcaaccgccgcccccttctccaccatgccggtaccgctggtgtccacctgcatccgccgctcacgtcgttttcctccgcgccactagcaatcccgcgttgatctcctccaagtctccctctagcaacctcctccttggctagtggtaagtaaacgagtcaaaatttcttactgttatgattttgcagataaaggttgtctgttcttcaatccattgcattgtattttgattatttgattgaatggttgggagcagggtcagtttgcaagatggtggcatgcgcgaaggggatccgcatgccggcgaaggggttatcggtgttcaggtgcgacgttgaagtagatgcacgtcggtgacgtcgacagcttactgcattgagtcaccccgaagcgtaaggtttcatataccgctccttctcaaatggattcaaatatgaactataaatattatctcaaaaaggcatcaatgtttgggatccgtcaaatactcaagtagtatctaaatgatttaataaggggaagagagcatagtaaggtaattgtggtaaatgttcgacagataatccatttatgtcgtggttggtagtagtggacgatctttaatcttgctcagttcggagttgatcaaaattccggctaagtcctgtcgaaatgttttcacatccttctgcataatgtaaagggagtgcattttaaatcgtttttcgaaatgggaagcactggtgcaaaatatgaatagaggtcgttgtagttgcctgtatttgaattcctgggagataagattcgctccaatgctccatgaacttaagggtgtacaggccacacgagacgctacaagaatttagtcgttaggctaacacgtttccgtaattgaataatgtgaatatcatgtggaagagtttgagtcacccacccatctccttgctttggcaatttttggactttgttgtattcccattcggtaatattgaaaccaggccaatcatgttttaactgtgggtgttgattctctgtcccgtgtaatcccctctcgatagctagcagctgggaagttttgtgcaacgttggtacggtaaaaacatagcaaaaccgatttgaattatacaagtggaagtgtatcgcttaccacacgccttagatcgggtcgatctttactgattggctttgcgagcgaatatagtatttgcacctcacgtcgcttggcgttaagaacggctaggtaccagtgtgtatctttaatattaattaggaggaaaatctgcagatgttcaacagtaagatagagtcataaattgaattagccattacatagatagcttaaataagtattaccatgtcaaatgctagatagtcgcgtgccatatctctaatccatcgtttatctcgaggtttgcttgcttcgacatgcgctccctctacatttagtagacctgttttaatggccatctctaggaaggccttgccatctcccctgattcctttctcattatagcggaggcattggatgtatgcattcatgacctgaatttgaggttagttgagttacataacaaatataattataaaagaatagtaggcttgttaaataggcgaacttacatcatcatttaagaattctggttgtgttagtacattcattcttatccgtttaacctccacttcttcaatatgcaccatcactttgttatcctccgtattattaatgtaggtaatgaaagggtcttttttttagtcaactctacgaaggtaggacaaattagtaatagatctgtagaaatgttaaatggttaggcattaccttctgaattttttaatggtgtctggccattcatttttttcttcttttgacctcgtaaggcgttctttggtgggcctttgtctatgattttttggtaagatcttccttctcgatgtacactagaaaagggtaagtcaaatcagtaacacacaaacatagaatataagtaaaaaattatggatgatgtagagagttcatacattcagatatttcattcggtgtttggttgttttgtttcctcttcttttcaccccgtaattcgtctgtgtctggcatgttagcttctttatccgtttgcgcttgaaaaggaggaaagttagtaccattgacatgagcatatgtaactattaaatagcataatacctattgttttctttgtctgtgcttgggttctgattatgtccttctttttaccccttgtttcgtagatgaagtcagtccgattagtcagtttgtatgttcttcctgtaggacctgtaagcctcttcctgctttgattgctctggttactgttgtcctgttaggtaacaaagtgcacgttagtattatgataagttgtagaaacgttagcgagagaattaaaattcagtttaccttcgtttcacaagtcatgtttacattttggtttatataggactcttcgttatgatttgatacatgctacctgggatcaatttgttcttgttcaacatcctacaatagcgtcaacctttttttagcggtgttacgtaagtaataatgattaatagtctagcttatcatctttacctcaaacacatgcgtagtatcttttcgttctaggcattttgaatcattttccatgcaatctagtatcaatgatcgcatacgtggccaaaaatcctttgtgaaatcgttgaaattatcttgtaaagtttggatactttcttgtaaagtgatatcggctgattgttcagtggatgttgtagagtgtacttgaatagcacaagtgagaaaaggatgtcaaacatattttgttaaatagagttcgtattaaaaccccataatatatacctcttcaaaagtgcatagaaaatcttcattggtacgtgcttcgagtatatcgctccaatatttccgtttttccgttttttatagatatattcttgcacggttcaaaatgacagtagagtatatcgttccgctatttttccatttttccgttttttgtttacagataaaaggatggacaggtaccgatctcatttacattcttcataatctcctttctccccaatctcatcttcctccgtgtgcatctcttacttcgtcaacctcatcttcctccgtgattgcaatatgtctggttcctcggtatatcccgaagcagattccgccgttcaggtatatcccgaagcagaggtgagtgcatgttcatgtatacacttgtgagttctgagacgtataatagacttattaatcttcgattactagttgccagcaatggtctatgagtacttcggttactgcacatcttatgctgcctagatgttatcctttttcttttccctatgaatagatctactctctttgcattgcgtgtactgtatcttagattcattggttgggtccaacgcactttccctggcctttatttagctcggatcctgtttacattgttttcaagcaatcaatcaccaaattaaaacagatctgtaaaccctgattacatatgcgatcgacttttggtcctagtcatctggctgtcacttaattgtttacgatttggggataattttcttttctaattcattagcgatgagagcgccgtacattgttgagagactatcattaccatttgttgcactggcaatttgctcaagtatatcgacatattatgttatttcttatttaacctagtgcttaatttgttactgtattttttgctgtcttctgttttttctcttaagtatcaactgactcaaaaacttgcatgaataacctaaactttgaccacaattttcttaaccattagtccacacaaaatgtttgttgtgaaactaatttgccatttgtccacgtttgacttttgtaacaaaattttggagtattttaagtttttattttattttttcttttaggaataagctagattatagtatgttgtttcgtattagtaaaacttattattaagtcgcagaattcaacagccaccgaaacaacatcatcactacgacatataatccgtcaaaatcggtcgatgtcatgtgttactagtcaagtttgttaattggcacaatggtttatatgatgatgaactaagccgttgattttttttccttcttaaatgcagcttgatgatttaacatgtggcgatgaaaatatgttagccatgtctaatgttctaaagaacaaaaaatctgcaaggctcaaaaaccttgtgttggctagaaattcattttccataactgtatacaacataaatactttgtcaaatcttgtttatgttggaagggtacaaataactgtggatggtgatggccgtcatattgtatgtaagtgtgtcattacttgttttctatttctgttgctacaaatctgtgtactctataccttaacttgatgctattatatttgttggtatagacccaaggaatgcaccaacggcagaagacatagctagtggaaaggtaaaaaacatccattttataatgaggacggattttagggactggcaggtatgtagtcatttttatataatattgttaatggtctcctcttcgatttggttgtccatattttaattcaatatgttttaatcttgtttcacatttgtgggtagatgatgaaagatgtggttgtggatggcgaagagctaatgcacaaccctcagctcaccacacatggcaccaatgccagcaatacgtcacaggatgaggaggcggcggccaccaccacgtgtgagaaaatggagatgcgggaggctcaccacaagttgaaccgtagtctcttccaagacgatgacaaataattacattcactttttttttacgagaaacagcatgagaggctcctactgtgatatattaagaaatataaggagtttatatacatcaagggaaaaataaaaaaagtaaaaattaaaataaaaataattacaaaggaactaataacaagagtctagccatgattgaaatgggggtctgtcttcttccttcactctttgcataagaagagtggaattttccttaaaggcaaatttccaacattgagagatattgcaatattgtcaaaaatgtgagcatttcgtgatgaccatatctgccagcacaccgtgcctattacctcaacaaagaatggccggttcaatgcatgataggctgactgaatcatttgcagaaattccaaatcctcatcccagttgatacctaggagattccagcatgacttggcaaaaggacaagagaaaaacaagtgtaccatatcttccacaacccctgaagtgcacatcctacatgaggggccatcttggacatgcaattgcctcctttgcagcatatctcgagtgtttaatcgatccataaaaaggagccagagaaatgctttaactttcattgtacacttacttttccatatcgaggtgattgctggatgaggggagaggtgggcaaaaaacaaatcatagaccttcgttgtcttgaaagttgcccctcaggagtaagaccaaatgtctagatgatcagtgagattgatattttccaaaaggcgtgaaagttcagtgaattgctgtaacgcttgagaggatagtggcaaattgaaattttgtcacatcattctgaacataattttgtactgtgatatcctcattgatagcaaaggagaataatgttgggaaagcattttgatgtaggtcttctgtccatgggtctttccaaaagagaaccgaatctcctgtgtttatctgaattttactaacccctctgaagattggtattaaacgaaagatatccttccaccaaaatgatcctctttcctgcagggcatgcggtggcaccgagttgttactatagtatgtattccaaatgagcttcacccagggcagatccctcttattgtagaatttatccagatgtttcattagtaatgcacagttttggaactccagatttatgatacccattccccctcttttttttggtttacaaactttgtcccaggctgctagggacagagatctagcatcaacttcactggacttcctccaaagacaatgccttcttgctctgtcaatgtgctcaattacttttttttgggattttgagagtgcacatgtagtaagttggaagggaggaaagtacagagtttaccaaagttagcctctgcccttggttcagaaacattgttatcgctgggagcctcctttccactctgtctataaggggcgcaaagtctgcaattttaggcttagttgttccaacaggcagtcccagataagtgaagggtaagtttccaatttggcatccaaaagtttcagccaggatctttgaattttcttcagatacgttgatcggaatcatacatgatttgtgataatttatttttagtccagttgatgaagcaaaagactgaaggatgccctttaagcagaaaatctccttttgactggctttcatgataataagagtgtcatctgcatattgaattattgggaacttagtatcaggttggggaataggcagggagaggatgcctatttcgggagctttgtttatcattgattgcaacaggtcagcaaccaaaacaaagagaaggggagagattgggtctccttgtttgacacctcgaaggcatttgaaagtctttcctggcactccattgagaaggacagaagttgtggaagtggttaggatatctttaacccaatttatccaagtgttagtgaaacccttggctttcagtactgtaagaatggctgagtgttctacagagtcaaaagctttctcaaaatcaatcttaaggataagagtttctctttcgctttgataacattgatggatatattcaaaggcccatgccagacagccttggattgttctttgcttgataaagccatattggttttcatggatgagatcgaggatgactgcttgtagcctttctgccataattttggttagaaatttcgtgctagagctctggagtgagattggtctgtaatcatctacagattcaggtgatggttctttggaacaaggcagataaatgagctattcaggttctggatagaaattttctgtccaaagaaatcatgggcaagtttacagtaatcttcagagatgatagaccagccttttttcatgaataagccattgaacccatctagc

SEQ ID NO: 20694 - DNA, 26072 bp, Oryza sativa
tctgttggcattgttcttatcactttgtcaatttcttcttttgaaggcattgttgacaggtctgataagtgattagaaggatgatagaggtcttgcagattgattatcatttgataaccatttgaggttcccattctggcttgaaaacagcttagaatgccagggccttctcctggtgagaggtgacaatgttaccatcatttagtgttaaatgagaaaacttgttctgtctgaacctttgcgttgccgcagcatggaaaaatttggtgttgtcatctccaaatttaacgcacagaattgtgcaccttttcttccaaaagatatttctgaagtgcagaagtttgagcacatgttttttagcaatagtcctgaaattccattcttggatgaacagtggcctgacctcttcaattttatccaacatatcaattgcttcattggagttttggattaattgatttaaatttgacaaccttttactccaacgtttgaggcctcttcggacatttttcaatttcccattaataactatcccttgattagttgctctgactgggatatcccaaaaaatcttgacaacctccatgaaaccagtcatatcaacccaatagttctcgaatctgaagatgattgactttggtatagaggtttcaattgaaataacacatggtgcatggtcagagacacatttgttcagagcagtgaccattgtgttgggataatgagttgtccaggagggcgaagtgaagaaccaatcaagctgttgaaggagaggctgactttgcatattactccatgtgtaggttctgcccttgagaggtaattcttgcagtccaatgttactgatggcctcattaaaaatcatgatatcattcatatcgccaccaggcaagtttctattttgcattgatcgaatgaagttgaaatctcccatgagcagccagttttcatcaggttggataactatgccatttagccagtcaacaaaatcatctcgtaaatctcctgaacacggcccgtaaatatttgaggaaccaaatttcattgcttgatgctgtggcagtgaaatgcatagtgattgcatatgggaggctgctaattaaagtgccagtaaataggtgactgttccaaattacaatgagccctcccgaagctcctagagaaggatggtagcaaaatttatcaaaccttttaggggcaaacttccttatatacgagtgatcaaaatgctcccttttttttcttgtaaacagataattgcacaaccactttcttcaatcttttgatgaatagccagccatttctgatctgagtttatcccccgaacattccaacacaggatattgcaatttctatttcgtgaggttgtattcatttgggcaaacaaatttatttaggaagcagggaagtaacacatgtacttcataagaaactaaccataaagatatgatgtttttcatggagctgccagtcatcactcagaaccataaagagaatctaccctgtgacaaagaaatagtcttggcccaataaaacacaaaagacccataaagttgaggataacaaccctgataaggaccagggcaagaaggctaagcatagccaaaacagaatttaaactaatcattcttgcgctggaggagcttgtcttcagccacttcctcaggaagcatgccacatttctccacgcctattttttgcagctgggccactgggatggctggtggaagatggttggacctgtcctccttgctgggcttgaaagctggcaccatcggcttcaccttggacttctttttagggacatcacaagttagatcaagtttctcccccttgtttgcaaaccttgggcttcttctcagaccctcaacagagagctgggcctgtttcttctgcttcctcactctcacaggcagggaaattatttctgtcgaggcagagctgtagggaagagctcttgcgacatttttttccagcaatagagattctttgacgcttagcaggactttgaatgcaccaagggagcacatagggaatgacaacccagttgatcttgacggtgttccatggaatcgtttgggtgatgcattggaacatagtggggttcacagccaacagaaggagtctgaatactccaaatgcaactgcataacagaacttttcagggaacctgaaaaaaggcagttcagggattggcaagctgtatgggactatctgaccagatggctgcttgatgatctgaacagaggatgaagattcaatcattgagtaatcattgaaagagagggacagctgtggttcaacttcatccagttgattctgattatcctgatccatgtcatcaattccaccattttcaccatcaccttcagggttggcttgttggagttgtaggtccagttgtaactgttgtatctggtcttgttggtcttggataacttcccaaatggctggggcatcttcatctccaggcagcatatcaacaaaattgcctgtaaacacatacgggtagaaagtccaggattcccctacacctccaagctctgcagtgtgccccatcacaattttttcaggcacttcatgagggacagtatatctaactttgacaagaaccctacccaagatcctgtccgtggaatgccagcgcataagctttccaaacttattcacaatttgctcaataatggaataggttcttagcctcaaaggaatacccaaaatgatgacccatccttctctattgtatggtctgtttcttctgttagcaagttgatcatgtgggataaaattggcttgcgcgaggttttgttgcatgatcggaccctcatcaaccatagcatctctgtgaaagacagactgaaattgaactatacaaagggccagggggtagcgttgcgccctaatgaccgaatgtgacagaaatgagtgacaaagtgaatgatctcattgatagtctggttcactaagtgctcaggaggttggggctcaatcagaacaacagcaaactcttctccaaggttctgagggatggactgaacagtgaaatctgaccttggtattctggcaatccatggggcttccacattggcgccaggaggaagaaagagctccggccgaagctcagcatcagtatggttcgccatgttctccgcccaggcaatgggagagaccaacaatggggtggtgggttttgggggaggaggattactgggaggaagcatgatggaagggcgaaaagacgggggagacgaggggtcctttccgagcaaagcaagattagtttccttgtcagagccctctcccagacgcaaatcacgaagcttctctcgccaatgggctttccgctttacttttttggcccaacaaaaccgactaaggtgcccatagttgtaacaggcccaacatcttatttgatttttacaagccgagactaaatgatcaggaaagagacagcgggagcagatacccggatttgttccctgcaatcactgcaatcctgcataagccgtctccgaagaaatctaagatgtgagcttcacattgggaggatattttttcaaaaagttacgagatgttcatttgtcaatgagatgttttatttttaatattctaagttagtttgctcggatgttcatttggaataagctagttgataaatatttattaaatgatactctatttggatatttattaaatggaactctatttggttattcacgtgtgagatgcctttggttcagtgcacaaatattgcacctttggttcagtgcgattcttctttcagtccagcagggttgcattcattcccgaacctgaaatatgaagatttccgttcaaaaattggctccaacagagtccctagcgaagtatgtggtgatgtatttcctatagggtatacaatatatataatttttatccagaaaatatataaacgtgttcaagtaaaacaactggaataggatcctaatttcatcatccaggaccaaatttcagaaaccaagcagcaagcagtcaagttaggacacaggaggtagttcaattgtgtaattttctgaaaatggattaaatcgatctcttctgtatttctgtaatgtttctgaaaaagacatcttttatagttctaaagcatttcagcttatttgcctctgtacacatctaaaataaattaagtgcctcagtttcagagtgtaatgcatatgcagagatggccatattcaggaagacaggtttgatctgctataaaagagtatccatctcacatattcataatcaagctataaaagattatccatctcacagattcataatcctcaaaaagggttacttatgcactgattcagggttttatgctcttccatacagtgtgacagtgtgtgtacgtataatttggaaaaacaaagtgcaggtttcaggatgaatgcccaaatactgaagaccaaacatgtggttttgcaggattcagtttcccttaagtgaaatgtgtctcactaattaaccaggtgcttaacattcatacgtgcctcctgaataccagatcaaactcaagatagtaccctctgttatttgcatataaagatggaccgaggaggaagagaaggatatgctttctcctgcatggagggagaaggacgtaaatgtcatgcatagtttcatgtgtaaatgaagccacaataaatggagccgaaaatcacctttcagcctttggcactgttcaagacaaatcccacatgtgggcatcatggatatcaaaaaatgcctgcatgaacaaacaattttatcagtaaggttatttcgattttttgtcattaacgtgacaaactgagaccctgtttagatgggactaaaacttttaagtccctatcacatcggatatttggacactaattataaatattaaatgtagactattaataaaacccatccataatcttggactaattcgtgagacgaatctattgagcctaattaatccatgattagcctatgtgatgctacagtaaacattctctaattatggattaattaggcttaaaaaaattgtctcgtgaattagctttcatttatgtaattagttttgtaagtagtctatatttaatactctaaattagtgtctaaatacagggactaaagttaagtccctggatccaaacaccacctgaagagatgctgcaatatgtacatgtactatgaatgttacacacggtatgaaagacacaaatacatccaccatgaaaaaatagcgtaataactctgaacaaaactcagcaccaaaataaacttccattttatcaagtgggagtactctctcgacttccagggatttctatgagaagacaaaattgcaacctctgaaccaggaacagtaatatatgattcaacacaaattgtataagaaagtttagtagacaactttcctaatccaaacgcatgcaccagggaaaatacttaatatgcgcatcttgagaaaagattaaattaatccaataaaaaacaatgccattaatacaaaagatacaaagtttgtgaggcacaataaccttattggttttttgtgtgcaatgtctcacggaatggccttcgtctctttgatggagctccttttgccctaatctcatcaggatcacagaccctcttctctaatggctagttactagatgaaaagtgagttggcataggagcaaaatctccagccacgatgttctcatgggatgacgatcctttatccaaaatcccatttaagaaatccatcgctttttctgtctgctcagggttcctagcatcactacccagatttcggaggctacgaaaacgaaccatgtgttcagaccacacattaggatcggtattcctgtctgacctaaatgccgccattgctcccattgtccacctatccacgacacaacaacgagggatggtgtcaaaaccaaggaacttgagtacaacaaatatgtgtgagcaagggatgtcttcgcactccatcttccggcagtgacattccacaccttccaacgcctggcctttaaaagtaaccctcacttcatcccacacctcattatcgtccttcaaaccaacaacatacagtgacgaaccatcttgattagtcccacttatgacttcgagtccagcaattagccatatctgtgcacggactttcttgaacacgattgttgtgaatatacgggcagtgtctttctccaatgggtcggcgtctattctacaaaaagggatcgaattggtacacttagcgtccaactgagcctccttcttacgcagacgttgtatgcacaacttaacatgtttgactaagcacattagtgacatatttctcttcagaagggtgtgaagctgtgagttcagtgactcactatgttggttgctgcgcatacccaacaagtatttcacatctgtataggtagcagcccacttctccctaagtcggtacatcagagcgatccattgtccatttcccgtgcctccattctccttaaaatcagcccaacgtctctcgaactcctcctcatccatactctcataaattaattttcttagctcatcgagttttggcttacgaaggtgacgactcatattctcctctatatgccaagtacacaatctatggtaagcacccggcattaccttactgatagcctttgccattgctaggtcgccatcggtaattaatgattttggatgcacttgacgtattgcctccaaaaaagtctcaaggagctaacagtaagagttgacagactcattggatagaattccgcacccaaaaattgttgtacttatatggtggttaactcctatgaaaggaatggaaggaagattgtacttgtttacccggtaagtgctatcgaaaataacaacaccaccaaaagcagcatagtctaaacgagattcaacatctgcccaaaacacattcctaagacgcccttcctcatctgtggtgtatttgaagaaaaattctggatcttcttcttgcttccttgttagatatttcaacacatcttcagcatcacgacccttgatattcttcatctcgtaccgagtaaagaaattataaaggtccttcatcacaaaactaacctcttccgactcatcgtggttattctccataacctccatgattgaaagggcgtaaggccactcatgcgaagctcgatcgcttgggctttcttagaatcagtcatcacacgatgaactcctaaaaaagcatcatggtcaggatttgcaagttcgagcgtatgttggttatcaaactccttaacaaaccacatccccttctgctcgttccgctcaatctcaagcttagctaagcaaccacagcgggtcagtgcccgtggctcccttttccactctgtcctctcaaagtgcttcaactccctgtactctttacatgagcatacgaattgcctccatataatctcaccgtccttccgcttcaagttgtttttcctcacactgaaacccttaccctttgcatagtctaaatagaatttgtaactttcctcctcgctttaaaaaaccacagtacccatcattttatactcttcctgatcctctaggctcacatagctcgaagtcattatgtcagacctcacctacggaaaagtaaaaaaaacaaacagaacaagcacccaaatataaccttacgtcctttatacctcataagaataaaaaaaaagaacaaccgtcgcctgcataaatacattgccaatccaaagaaaacacgggaaattcacattaggcaattcagttactgtaggactgcatataatatctgaggttcataacagggcagagtaaggatgctgattctataaataatctaaatgattacaagcttacttgcatccagcgcttggcactcaacatctaagtctccaaggtaaaatgggtccacctagtactgtaatacaatccttttaagtctgcacttttggggaaaaacatttgtttgggaaaagacaaatcatgattgtttaatttatttttcactattgttttgtgggagtgggtgggtagttcacaatttcatctatccagttcaatcagtgcaccttcacattcagaattcaaatgggtttgagaaagttctacaaatatgtcttaataaattcacagataaaagaaaacatcttttacaaaaactgcaagaaataatttcatcgcaagtgtacttctgaaatacatgaatttctcaagtgatttaaagtgcattgtgttgccaaaaaaatatattagctaaaacaaaattaaaccaagacatgacacattaattgtcaccttgttttcttgtgcagaacaaaaaccaaattccacttttgttgggacctaactacacaaactgttggtacatagaaagcttgcccaaaattaaagattgaccagtggaagtaatagatgaagaagagtacctcactaaacacaggatgacaggaacgtgtgacttcttcccagcatcgtcaagcagcacctgtagtgatcaacccctgcaaggcatggagcaaaattgaatcacacctgtagtgatcaacacatgcactaataaattaatacaatgcactactactagtactgatgaactagctggaaatgctggatgcattaaccagttgacaaggcaagcatttgggagaaaagatcaaagatcaattgcacaagatatgatttaacttgccacctttgctgaggtttaatgctagacttatcagtaacacatcaattgctgcaaactgttttgagtggaatttgaagtgacaggtgtatttcatttgcagctcgagaccaaaattattgttcagttttctttcaaaaaaatattgttgttcagtttcatcgtttatgcttacaactcaacatacaaaatcgattaaatatatctcctattcaatttaacatcagctagtgtagattctctagtatagttatccatttacaagcaagttgatgcatttatagaggaaaaattcagacaagttcaccactgagtagaggaaggggaacagaaagtcaggatgggggtgggatgggaggagtggatacctgatgatttcgccgcgcccagctgctggcagcgccgccgcctgcgtcggacagatgcgacgcgccgcgccaccggccgcgacgccgcctgccgggaggaatacccgccgggcgcacagccgcctgccggtgcctgcctccgaccagatgtgaaccgaagggggagggtggagagggcggggccgacggacggcgacggagggggcgagggagatgtaaggcgatggagggagcggagacggcggcgagggtgggcagggcgggggaggcggacggcgacggaggggagcggagaaggcgacgcaggcggaggagacggccggcaactaaggaggcggacaaggcggcgacggcgagcgataaggacggcgacgaaggcaaggcggcgaggccaggggaggaatagcgcgacagagtccacacctgcaatgcgaaccgatgcgaacatcccataccaaaattacccataaaggatattaggagattacttaactaccctttaaaataaactatacagattaattctactcggagtagaatacttcaagtatattgcaccggagcatcgctgaattttaaaaggctgcatatatccgattggatgtagagtccgggtaaaaaaacccttctctaaaaaaaaatacagctgatttattaaccttgcaattttcatttggagagctataaatcgaaaccttaaaagagttgaacaacctcctagtagccaagtaattcatgcaagaaagcaaagagatgtatcttacaactgattggctcagtgacgatggaagcatggtggtgtgagtggtagcgagagtacagggcatgatggtgcagtgcacgatggaaccagtaggatagaaactcaaccgggccagcgtgcatcaggaccattacaagggcgccgtctcttctccttagtggcattccttgcccgagtggcatcaacaggaggactaggtattccaagtggctgttaagatgaaggtatcatccctgcaaaacaaaattaattttcttggtttagatttttactgaccatttgtctgaactcaaaagaattaaagcatacacgaacttggcatgtccatataaaaaatcatatatagagatagaactagaggagattttgcaggtgagatacatatataccagttgttctcacgatccactttgctcgaattcaataccacgttctacaatccggcgccgattgccacgggcatccatgagccgggagatggttagccagacctggctatggagaatccttagcaacatgaaaggaagcacactgaggtaggccacatctttctctcccaacttcttggcagtggccattttgtggcatccgtgaagcacccatggagccaggggcggagctagagcgaaacaacaggtggtgccccttgcttaatttactctattttagattgagtttaagctaatacggctgtctaagtttgtattgaggggtgcatacatggtgaaaatagatgaggtagagctaaaaaattttcttgaccggattcctgggcaccctgcattagcacatgcatagacagcatccacgcatgtttatttcgtttatgctcatcttagcatagaatcattttttctctctctacgtaaattcatgtactggttgctaatgaatttgaaaaatcactagcagatcatttgaaatggaaaattatgtgcagaccatatgtactcccgagaacattgttacctttaggtttccaagcttttgccatggcgattcagtacaaaaggccaggatttgtagccatttttctctattgcctttgaaggcttgcggcttaagtgttctcgatctactagtactactgaaggggctgctgctacagcgcatgattgctcaaagcagtaagccggcaagctctatatataacatttcgtttatatagcaccagataggtaggaggatctacgattctttacccatggaccttattaacaaatcaggtatgaagaacgaagtacaaaccagccccaataatttagatacacaaactaacaaattcaatgcactagtattgaaacaatttctccagacatccaaaagagatttccgcgtgcgggcctccggcccgtctgctcggaagtgtccgcaaaaatcacaatttttccatgcgggtggcgcacccacatgcaaaaataaaatccattggtgcttatgtcgtccgaacgcaataacaaaaaacagaaaaaaaaaagaaatcgcaaaaaataaaaatgcgcgcccacacggacccgtgggctgctggatccgggcgggaccgtccacccgccgcacgccctccaccggagggctcctcctaccaccgccgtcgggctcctcccgccgctgccgccatgctcctctcgccaccgccgccagatccacgcaggggacagctatgcacccctcgccgtcttcgactctcttcggtcaacgttggctctgtggccgcttctctaccaccatgcgccaccggccgactaccaccggctgctgcgcgcccaccggctgttgccacttgcccgccgtctcttaatgctaaaatttggtaagccccaaagtcatcatcggcctagagccagtatcagcttcacagtcctgaaatcgaccgatggatattatgaaatgctactagttggattcttgatggattcggtcaaagaagtttatctagaagagatcgtgttcaaggaggacgtgtcttggcagtttatctattaattaggcagatttagttagttttcttttatttttagaaaagtgtattcagcattcgatcaggacttgtgtttttcctttcatcttaaggaaaatttgaattgtgtccaatatagactagcatctacctatggctataaatatatactcatgaggtccttgtaatttatctctcgatcaacaagttgggttgcatcggcttcgatctccgatgagggttaaggcttgttatggctgtttgtatcgacgaggctagggccacgacactctaacattgttgatgtaaacacctatcttagttaatctaagtcgatgtctcaatttattttgttggtgatagttaaattgcttcatcgatctagattagctaaagtattcaccactctaaaaatcagtcaaaagcttgattatttagactttatgcttcttttcatacttagtgttgcatcaattgagtttgacctattaagttgtgcttagaataaaaaaatactaacatgtgtttgattggcaatacgggtttatcgggatttcagccgatgagttatctggatgttgcatcggcttacaagtattacatacaagttggttttaaccgattgcatcaaaggtttcactgattatctaatcttttggatttaatgtcatcggaagaccaaccgatgtatgcttaaccttcggatcaaacaattattctattgtatcattattgaccgattggtttctattggattatagtattatttattatattattaccagccgattgtctttatatcattatttacttaagtgtcagaatcttcattggacatatatcccattgttcaaaaccctattgacatcggcgggtatcggcatcggctagcattgctatatcggcttattggctaattggctttttgttcttcaacttatacatcttgtcagttgcaggatcaaactgactggcacgttcgcatctcataaatattttggacctgtattggaactaagcagatctctcaggccgttgtattcgttgacttagtttgtgtcaacatagatctggcaccatcgaccgagcgtggatttttcatcaacactgccgcgtgcccgccggccagccgctgcctcccgagaggggaatcgagtgacagagaggagagaaagttctctcctaggagagagagaggggggaatttgagagagaggagtatgaggagaggaggtgagaaaaagaggagaggagataaggatgacttgaaaaagaattgtagcgctaagagggaaagagaaggtaattcagacttttgggcggaccttcaagaggtcttcacgcgaaaataccttttcctgtgtggccgtttaagatgctagtgtgaaaaatagccaaattttcacatacggctcattaagaggtctttctgcgttaatatatttttgcatacggaccttttaaggagccgtatgtgaaaatgtgggttaatttttgcagatgcgaaaacttatggtcggttctacaatatatcaaggtgcttgttaagaaaatcatttgtgtggagtagtgacggtggcagtgggggaagattaatttgcatcgttttcacgcaatcgatgatctttaatttagtcaatgcatcattaataatctatggatagggttgacgcagagggagatatatcattggcaggtatcaaatcgtagcaatcagtttaaaacagtaagagcaatctagaggagaaagggaagttcagccgctttagatagctgctgctacctaattaatgatggggggcatggccggccgcattgccgacgaagcgccccatgccacaggaagccggtgtcactagaaaagatacttctacatgtgacggcttctaatatgtctagaaatagcagcccatcacatgaaagtcatctcaatcggatcaaaaagtacccgattgagttatggtcgcacatacatattagatgggcataaaacttaagcctgtcatggataacacctatcagtgacgagccgtagtttagacccgattgtgataacattccatatctcaaacgggcctaaagttacggtccgtcacagatgaccatcatctgtgacgggtaccaactttagacccgattgagataacattccatatctcaaacgggcctcaagtgacagatgaccattatccgtgacgtgcaccaacttgagacctgtttgagataacaactaggcccgtcacagatgactcgtcagtgacgggctatatactaatgcccgattgagatgacttaatctctatcgggcattaactaaagcccatcaccgatgagtatttttttatttttcatgtgaaatgtttatatttgtaagttgaactatagcaaaataattaagtgcagtataataattcattttatgagtaaaagtaattttacgggtagtaaatgatttgaaatggaaaaaatgtcaacaacaaagttgtataacttatcaagatttacaatttttagtttgttcatttttctatataacattttttgaataatttgaatttgaatttaaatttgaaaatttgacaacttcaaacaatattttcaaatactaaaatgatttcaattgaaaatgtcatcaacaacaaagttgaataactcatcaagatctaaaacttttatttttgttatttcttcattcaacaaaatgttagtaacattattcccaaattttacatatgtgttataatttataaaccagataagagatatgtcatgtttgtgaacaatgttactatgcactttgtcgtatgtagaaatgaccaaaataaaagttttagatcttgatgagttattcaactttgttctcgatgactttttcagttgatatcatttagtatttgaaaatgttgtttgaagttgtcatatttttaaattcaaattcaaactgttcaaaaaatgttatatagaaaaatgaccaagttgttgatgactttttcaattgaagtcgttcactgatctaaaattctatttgaatttctcaaactttgaattttgaatttcaaattgtttaaatagagtcagatggagaaatgacccagataaaaattttgcacctcgatgagttctacaactttggttttggtgacttttccaattgaaatcattttataaccccaatttttgtttgaagttgtcaaattttgaaaattcaaaatttgaattgttcaaatgaatttatttgtacaaaggaccaatacaatagttgtagatatcaatgagttatacaatgggggatgtgaatgaatgtatatgaatggggaatgttggggtgtgacattctcgcctagggcttgataggattaatagaataatcataccaacatgttacagctatattttcggaagccgatcttcaaataactttgatgttaagcgttctaggcctggagcagttgagtttcgcgatgggtgaccgatcgggatgttcttcttgggtgcacacgagtgaggacaaaaaagagtttcgggatgggtgaccgatcgggatgttcttcctgggtgcacacgagtgaggacaaaaaagagtttcgggatgggtgaccgatcgggatgttcttcttgggtgcacacgaatgaggacaaaaaagacccgcctgggagaggcgggacggcatggcatggctaggcaaaaaataaaatttagtttttttgattatactcatctggcatggcatggctagccaaaaaataaaatttatttcttttcgattatactcatatgtgacgggcattaacttatgcccgattaagatgaggatcatatgtgacgggctatagttaatgcccgtcacatatgactaatttgtgacgggctatagttaatgctcatcacagataagggtcatctgtgactgacgggcgctagttgtggcccaattaagatagatcatctatgacgggctatagtttgactggttatctgggtcaaagctatctgtgacgggctttaattaggggttgattgagatagattcatccgtgacggtcgtttgcccgattgagataaatcttcacatctgtgacttctagcctgtgacggacgccatgcccgattgagatggggcttaccgccctattgagttgatggtatccgttctagtgtgtctccacctctgtgatcgccggcctgcggtgagccagtgaccatgcatggacaacgacggagaaagcggctggaatagcttaggtgcggtagccccaactacaactcccaaacagagccgatgaagccgctctccggggccccaactcccaaattaagtagattgtaggcaaaaaaaaaatggaattaactcaactaactggatggccctggcgccgatccaaaattatattttacttaaaatttattaaatagctatctctggttgtaaagacttagaaagaccaaactttatcatccctatgtttttaattttatagtttttaaaagttacaacagttgatacctcttacttctatcctctttctttatttgcttgttcaatctaccactatttttatttattctccatggaacctttaaaaattggaccttatattttttagaatttatctcgttgggttttatttttataatttttagaagtccgtcaaacgctacaactatactcctctacggctcgttcactacgtcctctctttattgtgattgggattttaaaaatcgaccataattatcgtttgggtttatttttttttactttctataagtcctgtcaaaccatcaacggctttatcactgtactcctctatggcttgttcgttgcctccctttttttattgtcattgagattttaaaatcgaacatgattatcattgggtttgttttttttattcttttagaaatccaggaacctttaaaaattggacattgtagtttctggagtttattgtctcgttaggtttatttatataatttctacaagtctcgtcaaacgctgccactatactcttctacaacccgtttgctgcctcatttctttattgtcaatgggattttcaaattgaacataattattgtttgggatcatttttctactttttagaagccctgccaaacaattagcggcttcactactgtactcctctacggctcacccgttgcctcccctctttactgtcattcggactttaaactcaagcgtgattattattagggtctatttttttttttactttttagaagtcccacacacaaccatgaccgtgttgcttaacggcttatctgtcgtcactccttttaatcatcattgggattctatttagggttttgttaatagtttttagatgtcccatcagccatcaccactctactcctttatagacccgttgcttctcccatctttattgtcatatgtcatctgtgttctagataaaatatttttttttgaaaattccatatttttcatccaatatttttaatatgtaaattatattcctacttgaactcttataattatttttctatttttgaaatttattttattttttatttgtaattttaatttatctcgtcatctgttctagatagtctcttcttttactagtctttattttctattacaaattttagttatttataaattgtattcctcattgaaatcctattttttattctattttgtattttatttttattttattttgaattttaattaatcttgtattgtgttatatatggactattcttttaatatttattgtatttatttcgaatttcagttgttttaaaattgtattcctaattgaactctcttttttatttttcttagtttcgattttattttatttttatttataattttaattaatctcgtattatgttcttatgtggactcttctatcaaattactaattttaaattccaaatttcagttatttttaaattgtattcgtacttaaactcttattttcttcttataatttctaattttattatttctttattttttattctaaattttaattaatcttgaatatggggttattatttggactctttttgcaatattgcttatttttaattccgaatttaagttatttttaagttttattttttacttaactcttctttttgatttttcccttctagttttgggttttattttattttttcttccgaattttaagattcttatacgtactcttcctccaatattgcctattgttaatcccgaatttttgttatttctaaactgtgtttctatatagactctctttttctttttcttcaattaatgttggaatttctagcatcctcaaatttgcctattgttatattgttaagatgttttaataatataatgaattcgtagagttacaagtctttgcacaattcgcctctgctatcaatactataaacctctctcgagcaccttcttgggaagcttttttttttctgagtaaacgtttgataaaccacttacaaaaattttaagactaccattcaaaatagtattatgggtaaacactccaaatcatttgttcatttattatgtactgtctatatccgtaataactacaccctagcactttggaaggtaaattattggagaataaaaatgactttaataccctttcaataaatgatgtggctaggaataagatggaataagctagactgatctactatgaaggtttttttattttttttgacgagaaacagtaggagaggctcctactgtgaaggtttggtaaacaacttattaaaattttaagattatcctgtgaaacaatattatgggcaaacaggattatttcttagagtattatctaacatatatttgtctagtaatacttgaaaaataatctccagcccatagctcattttgatttaaatatatgttgcctcatttattctattaggaacctctttgaagcattataaaaaaacgattagcagttcaggaaacgtccgtgttgaaaatgaagaagtagaagatgggaaagagaagtatacaacacaaccttaggttttccagacattaagttgttgtttttggaatatagtgtttgatcattcatgctattcaaaccctatttaagtttatttattttgttgtggtaggtttcatcactaagatactttaatcaagcttaggtttcttgcatagtcgcacttatttttttaataatatgaattttaaacatcatgtaaaaaaatgaacagctagcatcacatatttaaaaatagggagtagatgatttggtggagaggcatgcggtgggatgaaaaatagggggtgcatacaggaggaaagatatatgttgcttaggctcctttattatttaggcttatgcttttatgatgagttttttttatgattttatggtttataagctggtagctgctttgaatcatcaaatggaagggttgagttctaactttaatttacactagatgatactccgcgtgttgcggcggacaattcgtgcgtgcattgcagttataaaatttcaatgtataggaatgagaaatattatggacctgtaaaagcatctcacatatatatgaaaaatgaaatacttccttgtagtggtttcttatagcatactatattaagtggtcaatgaatgttgagttatgtcataatcaatgagaaatgataactgtcgatatttaatgtctatttaatgaagcttggaaatgatccaataactcttatttagcgggtgatgtggctcaatgcatgtttagtttttggtgccaactatatactccttccggttctataattattgacattttagacaaggttgaggtcaaacttttataactttaaccatcaataacataaaaaatatttagtttaaagaaactagaacaatatatatagatttgtctttcaaaacactataataaaagtaaacatgcatttatttattgtgtatattataatagaaaaataaggtcaaaagtatattttgtaggccgtgtcattgtccaaaatatcaattaaaatgaaaccggagtcccaattgatggtggttgtttcctctaatttaattgctcatgacaaagcgcacgtataccacagtcccacttctgatcgcacgttggcactgagcactgggaagccgttggggtactgaggaacgaagccgtgtgaaatcccaatccacgcgcgacatatatatcctgtatgtcgatcgtgcatcgattggagagatgtgcgggagtgaagatgagtctagctaggctggtccatcaatttgggccttctttctcgtagattaaagaagtttcaaaggtgtatatttgatgtcgacattgatcaaatagctaatataatgttgatgacgtggtgaattgagtagtgagtaccaactatatatgagaaaaatagctaataaaacctaatttcataattagacttcattagatgtgtggtggcttggggggtaagatgagaacatacaaatggaggaatgcacgctatgcacacaaacttactgtgcatactccatacacaccaactagcaatgtcacagaaatttgtataaaaaattagacacatactttcaataatattacacctatgtttgaaatattatcttcaaattcattatatattagtcgcaaaaaagataaaattctgatagatttttactctaacagatttttcattttttgtgacggctaaaatataatgaatttgaatatgagactttgcacatatgtgtaataatattatgattacatgtccatttcttctagaattattttgtaatatttgttagttagtgtgcatcggaagtttttgtacataggatatgttcccatataaatgatagtttgtccatagaaaacagtataataaataatttagaatcatattttgtgcttcgaataaccatcatgtggccatggatctcatttatttaggttcaatatagacaaaaagttttccagacttttctaagtaaaatataaatgtaaaaaatataaagtaaaatttcagctatgttttatgcatttgaattttaaaattcattactgggtaatattattttaaaaaatattagttatagattggacaaattataacctacataaatttggtctaaagtgaaataatgttagagtttctcttaaaatataattttattctattttaagcattgtttttgtatgcagttataattatcttgcttctataaaatatttagaaaaaattgctacaggacatcattttttaatatttgccctagaatgccataaaaccttggtttcggctttgcatactaagcttttgtggtaattcgctaaaatatattctagcggtctaaccattacttttagctatctggctcaacatgagatgtaaaattgtggaaaggtttttctcggttgtagacaagaatgttgccaatatgtgttcctatggaccaactgggagctttacgcatttcgagttatagttgcattaaatccgactggctggtttgtggccaccggcgaggctaatggcacgaatttctactcaatcggcgccaactgggaagagcggaggaggccagtggcacatgaggaggaggtcggtagcgactttgactgaccttgtacatgatattttatttgcgagtacatgtgagacgcatgtaagcactcaaacgcacatatcacattatattcatgttcatatacacccttatgagtgtgtgctaacacatctaaaagaattggaggtctagaaacacgtaacatgggtacacgttttaccactgagcacacctatgtgtgcatgaactttgcaatattacatcactgggaactatgagtactcaggccatgtataggattttaacctagacgagcaggttccaccacaaagaccctaaccaaccttttgttgcacaaaatttgcttagatgagcccgatacccataggtggagcgagaaacaattaaaactagttgatatcccgcgtgtttgtgacatctcggcccagggcttaataggattaagagaatactcataccaacaagttgtaattttttttccggaagcccatctccaaagaactctaagattaagcgtgcttggcatggagcaattttgagatgggtgaccgatcgggaaattcttcccgagtgcgcccgagtgaggataaagtgtgcaacacacgtatcgacgaggatgtcaatctctcttaagggggagaatactcataccaacaagtctagtctgtgagggcagtctatgacctggtcacacagcacggacgtggccaaggagtggtcacacagcatggcacatgcgctggcattggacgcatggacgtggccaaggagtggtcacacagcatggcacatgcgctggcactggacacacggacgtggccaagagggaatgtttgtgtccaagagggaacgttcctgagttggggttgatcgacgaggacgtcgatctatcttaaggccttaattggatgaagagaatactcataccaacaagttgcaacttcttttccggaagccgatctccaaagaactctgaggttaagcgtgcttggcctagagcaattttgagataggtgactgatcgggaaattcttcctgagtgcgtagctgccggatataagtgggcctgtcttgggagaggcgggacgttgcagcgttgcagcgggcacactataaaatgttcttagtgcataaaattgatgcaaattggtcactgaatcagcattcaaagaaaaggagatttacactgttgtgatagaaatgcgcataaatgttcgtttgaacatatacaattgaatcaggaaagcaaccccaattaatggtacatggtattctagcgtgctgagctggtcgatttgctgaattgctgtgaagatatggtaggtgtaaaaatcaggattagcctcttggcaatatgatgaactgagtaagttcaaaactttataaaacataaatggtatctcaccttcagcagacttgaacctttaagcaaagctactagaactgcaactcaatcctaggaagtagcaacatggctgccttcatctcatcctcttgataaagctaggctacatgtaggccatatttatagcatctctaacctgtattctaagaaatatatatattttgaaaccaaattcatactgaaatttgtggtttgagcttgttaggtgtacaccacatttgagaaacgtggtgtactttgcccaacatccattgggtaagccctttgttttttatttcaatcaacagagctactggttaaatattttcaaattattaaaactttgcagaatatacattttaaaattattggaactttgcaagtgtaggatgcacgcatgagctatatttgaagcatgaaatgccaatgataggatatcgaaagaaaaggacgggtgcacgcagcatgaccaacaaaggataaggtaaaaaaaaaaacgcatgccagtaaagtttatctgctttgatgagagtcctttttgcttggaagactggtatgacaatcctcgcatttttccccatgtgctggaacatatattccttctatctattaaatccatagcacaatttgcataggtcacaagcagtataatcttcttttaagaaactaaaaaatagtcaatacataagtgtaggactaacaatagttgttccttctttaagttagcaaaaacaattcatcaaaaactttcagctcgatcctgcaagaggaaaatcgtaggcaatgctcaataagtaaacagaagcaattcacatatacataattgttatacaaattggaatacaattggaggatacataaacagatttgaaaactttagttacatgtagtatactaacctttcatgctatgattctcttcatctgctcaattcaattgggggatatgataggacatggttgactcgaaggatgagttgtgaggatggtgaaaggtatttgttgtatgttatgttgcagaagggattgaaagagggtaatgaagggtaataatgtggatcctggtgatctaatagattgtgacagtttctgctgtaattgctgaaaaataatagtaataggggacggaaggaggaggcgaatggacaggaccaaggcgattatggtattgatagtttggggaataatgaatgaataagagaagggcatgaacgattctcacttggattgccgatgcggctagttgagccgaggggaaactgacggatccatggtggctgaaccggttgccctcccgaagcgtgcacggtgctggcgaatacgccgcatcccaaaccgccgcgtatgccaaaagggcggaagcatgtgcagggtgggttgggccaacagaaaaaaattgatgggaagctggcccaagatatcaacctcgttcatctggaaacacgcagaccaatccaacggctgaaaataaacaataatgtggcgtaacatggtgcaagttttatagcaataactcctctagtgggtaccaactatataggaagaagggatagtatggtagtgggtggcaatagtattagtttgagtaaatttgacaaaacaatagatctaaggacgtaaaccatagaactatagatttagcgcaaaatttatcataaaactttagatttaaggtgttgtgtcatcaaaccgcagattcagtgatgaggttatcatataactacataatttcaaatttagatcaacaaaaatattcttaaaaaagttaaaaaattgtagttatgtgatacaattgatgttaaatttgtagttagaaaaattccaaataccccctgaactttgggtcgaagtccgtctagcaccctaaacattaaaactggacatccaaccctttcaacttttcaataacgttcatattatctcctaaggtggttttggatgatagttttgcatgttttggaagttcaaacaaaataacttttaaataactaatataacatatttgcatatcatcaattgtaagtcatcaatttatacttatatagtgataccataatattaataaagtttagggggttgaatgtccggttttaaagttcagggcactaaactgacttccatccaaagtttagggggtgtttgaactttttttttcctttgtagttttgtgatgcaacgccataaagttgtaacttcatgaaaaattctctctttttttcatttctaaccagtagtgtagttatacacattcttaaatatgtagttttatgatgagaggtggagagtttttccttagttgtacacaagaatgttgctattatgtgttgacatggatcaaatgggtggtgcataactgatcaaaagttacgtatttcaagggataattgtgtcgaatccagttggcttgtatgtggcctctagtgaggctattggcatgactttctacttgatcggtgccagcttggaggagcagaggaggccagtggcacacgaggaagttggcagcaccatgcgcaactcagtgacagtgtgaaggagatcagcagtgccttgactggctctgtacaggatatttcaattgctttatgtacatgatgtttcatttgcaagtacatgtccgacacacataagcactcaaacgaacataccatattcatgtccatatacacccatccaagcatgttctaatgcacttctaaaaaatttagaggtctagctgcacgtagcacgggtacagattttaccacgaaacacacctatgccatgctatgtataggacattaacctagtgggcatgtttcaccacaagttcgccaaccgagcttaacttaagttggttgtatagaatttgcttcaatgagcccgctagccagtggcgaagcccaaaacattaaaaaaattatatattggagagtggaaatatcattggtgtctattttcaaaaaagtccaagcccctacttgcatcccccttatctctgcccttaccaccagcaaatctgcttcaatgaaatggtataggatcttagactcaacttagtggcaagtctagcttagtcttttctagcaaggatgattttcataagtttgcaaatcatgatagattatatttcttctatgcatgtactaattccttagcttgtgttgaacccaaccatagtgttggagatcggtactcctacaacagagaagagaagacccccccccctcccgagatttagccgaggggcaagtagagatcgagttcatatggtgtaaacactcaaacaaagaacacaagcaaatatataggtttatgctgctcgagagcgtaataccctacttctgtgtctagcactat

SEQ ID NO: 20695 - DNA, 53084 bp, Oryza sativa
tgaaaaggcgcttagtcctcacaacaaaaaaaactgcagcggaaaaataaaatctagcgaagctccggctccacccccataggcagctcaactcgggtataagtcaaacgtcttctccttctggatcatttttcttcaactgaggttgattgattattgcaaggcaagtcacacagatcccaaacacgattcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgctatatatatacttgcttagccatgcctagaaacattagttcattaatgggatgaatcctactacattattatttatggttatatttaggggcaatttcgtttctgcccctaatttgatgtctaatattgattttacccttattttttagggttttcgtttttaccctcattttttttaaccgaacgcttgttttgcccttaccttggatgataaaattaacggtgttaagtaattgacaaaatgacatttataccctctcatgtatgttcattaattgtgtttttgccctcattttatacatatagctttgaaactttatttttggagtatatttaaaactagatgatgcacattgactaatataacaatttggaaaaattctgtatttgattgaattttgacaaaatttcagcattttgatagaacttaaacaaaattttggcaacattatgtaaaatgtaattatctgttctctttagatattagtcaatgtgcttcatttaattttaaatatactcacaaaaataaagttctaaagctacatgcataaaataggggcaaagatataattaatgaacagagatatgagagggtataaatgtccttttgctaattacttaacaccgttaacttaaccatccaaagtaggggcaaaacgatagttcggttcaaaaaagtgggggcaaaaacgaaaaccctaaaaagtaggggtaaaatcaatattagacaacaaagtagggttagaaacgaaattgtcccttatatttaatggtagctcacgatggttaatcgtgttatgataattaattgataattaaaacttgataatggtgggttgtgagcacatggttttgaaggtcgtgctcatgacaattaaggaccagtacgcgagctactgttgtgagacattaaccgtgccaaccacaagccagcgtgggcaacggctttaccttttgtatagtatggtacattgcggggcaccagactgtgaagcggcgagaagtccgtgggggtcactgggagtccacgcctctggttattgagggggtgattatgatccaggaatggtgcactgtggtggattgtgttgtgcaaggggtactgtcacagttcctatctgagatatcgtggtggtattgaggcgcatggtaacatgttgtggagctgtgtcttgtgggtacagtggtacatctctggccagagtaaaactattcgaatagccgtgcccgtggttatgggtgagttgagcaatgttttcgtgattagtctcatacctctcacaataattattgatgcaataattggtaataatttgcttagctcctggttcggagttagatctgtacagctcggtatggttgttcagaatggttgggcctgagcagcatgggcgtgtgttaacaaccaaatttggtaatatcggcatcgggaaagaagattagatcgaagcaaagtcggaggcggagatcgagttcggaaacatagcaggaatcggctggagtccagttcggctacgattaggatcggctgggtctgagttgggctaggtaagccgatgcagccgattccgacaatgcaacttgatgaatgacatcgggttgaattgaggtgcttcaaggtgattgctgcacatcgatagagtcctgagaaggcaattgtatctattaattaagatgttttatgtaatttccttagagatatgcttgggcaaaagtctgccgcaaagacttatggtatcttagagtttgttagagatagtagtcgtgtccgttatggacatatcttgtaattctcgggtataaatagacccgagccctatgtaacttttaacacacacgttcaatacaatttcggcgcatcgccaccctttttgctttagttttatttcgacgagttcttactttcgggttgagctacatcggtttcgatcttcaacaagaggtaaaacttgttatggcggcttgcgttttcgggattagtgcttccatctttatgacactctaatcttgtttatgtaattcgtcgagttatcatatatcctacataatccttggcaatatcgatatctgacctataatcggctaacatccgtcaatagaaggcagccgattaggttaaataccgatgtttacttagattatataggatatctaccactctatgacacatccaacagcttgattgtctagatattgtcctccttttcatacttatagctgcatcagttaagtttgatattatgagttgtgattagaatctcaatctctagcccgcttattggttgctgattagggtagtatcggactttcagccaatcttgcctgatttaactactttttatcctatatgcttgattgacatgttaaatctgccctttacgttaagatcttgctgcatttaagtatattaagcttttgtttagtatattctacttgctttaatatcttaatatagagtggtatcggagtattagccgatacatgctagatctatctgatcggctatgctatgaacgtatatagtctcattattaatatatatttcgatctaagtgatttatactgcctcggcatggcgacggatctatcccaatcacttgatttaagtatatatcgatataaagattatatattggtaatatctgcagccgatcgagtagattcagtcctttcttatttattaatgactgccgatcgatgcatatacgacatcggctcaaagataaatgatatgtcatcggcacctcgccgatcggctatcatttatagatttaactgcgatttatttatcaaatcaactggcacgctcatacattcgaaggcgagctttggacctgcactggagttaagcagatctcccaggccttgtgttttctgtcaacacgcttttggcacacctggtgggacatttaagaagtcagccaacaattcttcctcatggccgagaaaccaccaccatccccagctagcccaggctctgttaaggaaaagatgctgaaattagggttggctgacgtcaatgaaggaaatgtcgtgccgatcgatccagaaaaattcacacctgagcagaagaaagagtttgaagcaatgttgcagcaagcacgggatcagtgcttgaactcattcatgcagacccgcaaggggacacttgttcagaagtacaaaataaaagtggttgctgatgatccggggaccagttcttctaaggatggagatgggaaacaagctccagacggctcggctcagctgagtaacaaaagtgctaccgacagctctctaggaaatcaaggtgacaattctcaaggagtccatggagtgcaaggtgacggggtgcatggagttcaaggtggtggtgcccgagggttgcaaggaggggatcttaatcagaatagtgatacgacactgtaacatacccaaaattctaggacttaaaaatttgttgtcaaaattgttagaagataacttctccaattttgagagccaaaaatttccgttttaatttaggtgatgaccaacttaaaccattgcatgattaaaatttgagaacaaaataaaaccttttcattcccagcattagactagaaatgtcatcaagcatttgagcatacatgtgcataatgcatgcctaggcttgagtccattgtgcatttggttttggtatcgcttttcataatagatctcatgagcataaactaaaagggttaaaactactaaacaaaactatagttaatattgggtgataacatgtggacttaatattaaattctaatatcattttctcagcccaaaagaagtttaatgtaaaccctataatagtattagatgcaattatgaagtaggaacacatattcaaagaaaggttattctaattctttagaataatctatgcaagaaaaatcatggaaaaatttatgtaaactatgtttagctcaagcaattcactataatattggtacaggttaataactaagtttaataccacaaattaatcagtcaaagcagacaactaaaataaatcaaattaaactttaatcggctaaagcgatacttcatccaaaagtatatttaactgcacataagtgaatatagaaaataatttattcaaatactagattatttatcatgcctaaatataatttttctagaatttttctcctctgtttaagcctcctaaaaattcaatctagatttctaatagcccttctttgtttaatttctgtgagcaatctacccattatttttaagtgcaaccaaagaaaatggaatctacgtgtaatcatttacctccagtaaaatcaacactaattaatttgatcgacacattaaattatggagttacaaatttagaggagaaaataattccgaaaattaatctaaaaatcaagtttacccagtcttctacccatatctctctccctagcctagtttccatcgagttggccccacttgtcagtgccttaggctagctttagccctgtccatcacttcctccactgctccagccgagagagggagagattgagtgagccgacgcgtggccacaacgtgtcgtcgatctcggtttcccttttctcgctctctactcctcccagacgcgtcgccattctccattcaacactcagagctaaagaaaccgagggaggaggttctctgcctctccatcgctccaaaccttgccgccggccatggagacgacgaccatcgccatctccatttgagtcaaggtcacctccatctctttcgcgttcccatctctccacacaatgccgagcatttcctcttttgacctaaacccctctcgtgcagtgcatcgccgggaacgcaagccacgccgacaacgccctggagcacgcaccggagcgccgccgcttcaaccatcgtcgtcgtccggccattctcgaccacctcggagcaagccgctgcgccatcgtcatcgcctcaacctcctcttcaatacgcctcaagaaccccagctggagatgtgaaggactcggagaacgcatcttttcttcaccggcgccaatctagaatcgcctccgccgtcatcgtcgattaccgctgcctcggtgagccattgttcgattcctcgcacatacaccatctccttgacctcacaaaccttgtgcatgcttgcttgtagcagctcatgcgagccgtcgtcgttcacccgaggaggagtgccgtcgccgagccgttccacaagtcaccactaccgccaagaccttgacaaccctagctcgacccatggtgagcattctgaaggctagaagaccacatgcatgcatcctttttgttcggaatcgacttccatccacacatgcgctttcaccccaagaaccaccgccgctcacactcgccattggcgctactccaatgtcccctaaccaagaaaactagaggaatggaatcgcaagaacatgctcttcatttatcttttaaccccaactccaaccgagccaccaatcgccgccggtgaacccgggatcgagctcagccatggctgctctgcctctgtgcgtgtgaaaaaggagtcagggacttcattttgagaatttaaataactataaggttcattacgtaatgttcccaatcaatgacatatggacctaggactgcgggttgagttcctgaaaccctaggggcctttttgcatattggcctgatactgacaggagaaccccatgagtttaaaatctgaaaaaaaatgtaaaaagataatactaaaagttttgtattttcaacaggaaagcatgtaaacttataaaatccataacaaattgaaaacaactcattttagaaaatccataacaaattgaaaacaactcattttagagtaaatcaaatttctgtgaactcaccaaatcatgaactttagagttattgcataaaactacattcactgtacaaactttgtctctaaaattggtctaagataaatcatacataaagcatacacaaacttataaaatacatagaaaattcatctcaactcattttgaaacaaactcaaaaaaactgcagattcatcatcatgcactctctgattaggtgaaataaaagtaattacttactttgcatcaaatgcctctaaaactattatctctataatgattagttttagataagctaaactttagaaattcatgtagaacccaatttagcttcaatttgaataaacttaagttctgtaggatcaccaaaacacgtatttccatgttatgaaataagattatatacttactgtgtgtagtaaaagtctctaaatattcataaaaggatttactaacatagagcaacctttaatttggcaaaacttgtagaaaattcatttttagtccaaatgaaatgaacaaagtttccatagaactagcaaatagttatcttcaacatagtaaaataaaatttggcaccttttgtagagaacatagatcaaaaccttaacttagtgaaataagaatttaaacacatagtgttgtttaagtaatacataaacatgtataagtatatatacactttaggtctaattaaacctaaacaaaaacttgattgaccagtaaagccatagttccatcctcatccactaaaacttagaagaacttagctcatatgacaatttctaggttaatataatatattgctagtttagattagagcatctctagcgtataaaatatgaaccatagtagtaaagaccataaacatgtgaaataaaaatgttttagttaaccaaattagtccttttattcaacttaaacaggaagtagcatgttctgaacctacaaattgagagtcatgcacatataaaacactatatgcctaaaacacgttgtaacttgtaaaatctataagaaaatcattataactccaaaaattgtgaaaccaaaggtgttagtcttagaaaacacatctccacactcctgtcaagtctaatataatagaaatcacttgacaaaagtattttataacactacctaagactatactactataaaccgataaaacttctaaaaattcataactccctaatggaataagataaaataaaaattctttcacctaaattcattttagatcagtaccaaaccactgtgcataaataatgcattttagagcattttggatttttagctctttcggtgtttaattgcatatcgtgtcctttatctagataattgcataatcggtgaaggagtggattaggtgctaacatttctctgatcaaggcaagttttctcctcccatcctttgaacacattgaatcccatgatttgaggaatgaaaatgtttgtttgcaaagctgcatgtgaacttagattatatcggtatttaaaattgggttatggtagttatgacctatttgctgcataccccaccttgaataattgatcctcttgctgtttgaacccctagaaatggttagagtacactctttgtgctcaaatgggtttatatatgctctatttgtaactacttgcttagccatgcttagaactatgcaaatgctcattccatctataattaaaatatgattttgatatatgaacctttgctggaataaaatgaatatgatgggtatttgcgaactaaaatgtgtaaaatgtgattttatacttgggcggcaagtggtgtgcatatggtgttagttgcataccgatagggggagtgtttgcccaagtccataaggaccgaacttgtgtcacccatttaaagttattcgtacatccacatgtgctagtatgggatggcctaagctgagtaatctatttaggactagccttgcattctggtaggccggtgtgtatgagttcgtataattcagaggagcttcctatttaccccgacgtggtagtttaggtgactaagtgtgtccaatacaacggtattgtgccacgtggtgggttcctgtcgtgtccgccatcacggcgttaagtttaaggcgtgggcccgtcacttaacggttctaggtatattccaaagtatgcctaggatggaggaacacgtatcgtgctggtgcaaggctaggctctaagtagtgtaaaggcttcgttatgacctctagatcacattcaacatgaagagtgtggtggagtcttgcaaactcaaaacaaactagagagttcatatcatgtgggtaaagttgtacaaactctgcagagttctttaaactaatcgattagccgtgctcacggtcatgagcgctttggtgatgtgtcatgtgtatagactatgttttaaaaatgtgatcatgtgacattggtttgaaatggataaatgtgttgagttgtgtgtgtggtgatacattatgacttattgttaagtatggcaataagagattgattatgatggaattatgaagaagttaataatgaaacttaaaacttgttttgttaattgaagcatcaacttctttacaaaagaattgcgaaacaaaacttgctttatgctgaacatgaactacatattgccttcctttgaatatatgccttacatgtagtatggtaggattgacttgtgcttgccagtacattaacttgtttaatgtactgactcttgctgttgatataaccttttgtttgcaggtttagacttagtctttgaatgatgcgggtcctgattgcttcttctaggatgagaacttaatggggtaaacccctagtcggtgtgcttgtgattgggtagtcaagcttccattgttctctaataagcctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacgcatctggtcgctgccttcgagtggtttgacgggcacatctcaggctgaagttgactggcaggctaagggcccagcaatgtctccaatattcctctctcgaggcgtcggatgtttcattatgcttgttggatgacttgaattattcacttcatctctcaaatataatggaagatccggagagcctacgacagacacaaggttttttcagtaatttccaagatcgggtcgactacgctgtgcatcatgttttgatcaatcaatctggggtgttagtcaagaccttatcaaacatgatgaagtccatagccgatggttcaatagctgagcatcaggctgcaggcccggtttatttgcaaggaggtgtctttccaaattatcggtctttgattaccgatgttcagccatcaactcaggcggttccctctgttgcaccaacatctcagccgaaggcactggcgtcaattcccctacctgttccgtcagcaatggcgccaggccagccagtgaaccctcagttgttaatgagagagcagccacagcatggtgggcaggttgcgaatcggctgacccaagatcaggttgctgccacgtttctgccgcctcaacctattgttgatccaatacagcagcatccgattcagcagacacccccaattcagcaggttgtgcaaccaatccagcaacaggtcatgcaaccagttcagcaaacaccaccaaggcagcagcctctgcagccgactcagcagacgctgttaagacagcaaatcgttcagccgatccagcgccaaggttcaataggtgcatcggccgggtttgcaacgcctggtggtcagcctgtgcaacaatttttaaatcaagttgtcccagaacacttggttcaccacgtacagccggatggcacagtaatacctcaagttgttcctgagcatttggtacgtaatatccagccgaaccttcataattactaaggggtaacttgaattaccaatatcaacctccttccctgcaagcccaatatcagccagggggattggctcaacctcagtttgcgcctcaatacggtcagttcgagcccgtgcagcaacagtcataaggggtagctcagcaacgaccgtgggctgatgtgattgctgacgtaatgagggaacaatttgggcttaaaccaaaagagacaggaagcttgtatcggcagccttaccctgagtggtttgagagagttcctcttcccaatcggttcaaagttccggacttcttcaaattttcaggacaagatggtgtgtcaacttatgagcacattagccgattcttagctcagtgtggtgaagcatcggctgtagacgctctgaaggttaggttattccggttatctttgtctggatcggcttttacttggttttcttctttgccgtatgggtcgatcaatagctgggccgatttggagaagcaattccacagctatttctacagtggggttcatgagatgaaattatctgacttgacagcgattaagcagcggcatgatgaacctgtgcacgagtatattcagagattcagggagatgaggaacaaatgctttagcttgagtttaactgatgcccagttagccgatttggcttttcagggtacgattgctccgattagggagaaattctcgtctgaggactttgatagcttgtcacatctgatacagaaagtaaccttgcatgagcataggtccgcagaagttaggaaaaactctaagaaggttaatcatgtttgtccgtacatgtatggatcggatgatgacgaggacgattctgaaatagctgcagccgagtgggtgaggagtaaaaaggtcataccatgccaatgggtaaaaagttctagaaaagaggagaagtatgattttgatattactaaagccgacaagatctttgatctgctactccgagagaagcaaattcaacttcctgctggtcatacaatcccatcggctgagaaattaggcaaaaagaagtattgcaaatggcataattttgggtcccattctactaacgattgcaaggtttttagacagcagatttaggtggccattgagggaggcaagattaggtttgatgattccagaaagccgatgaaggtcgatggtaatccttttcctgttaatatggtgcatacagctggccaaacagccgatagggcccgtgcaaggggttttccggtgaattcggctaagattatcaacaaatatcagaagaagtatgacaagcagcaggagaagcatcatgagaaatacgatgatggttttgatcctcattggggttgtgagttctttagattctgctggaatgaaggtatgaggttgccatctattgaaaactgccctgggtgcagtgatatcgtcgagaactcaagccgatcatatgataggggcaatcggctaaggcagacaagagtttctgttcatcaaagattgggtccagtaaatcaagatcatggccaaaaggaccatgtaatcaggaataatcaatggtgtccttctggtattttcacgaagaatcagaagagaagggttcaatgattgaggaacagggagcgccttcaagaggctgaacaagaaattaatcatcggctgaagaaagcaaagccaaggcaggagtggcgtgttaagaatcaggttcctgcagtcgatgatgttgcagcagttgaggcaaaaaggtaggcaaaagggaagagtgttgtgacggcaccggttaacatggtctttaccctgccagccgaattcgggatcgaccaagccaatgttgacgaggtggaagaggaatcgactaagttggttctgtcactagaacaggcagtgttcgagaaacccgaggggacagagaatcggcatcttaaaccattgtatataaacggctacgtcaatggaaagccgatgtctaaaatgatggttgatggtggggccacggtaaatttaatgccctatgctacgtttaggaagttgggtagaaatgccgaggatctcatcaagacaaacatggtgctcaaagattttggtggcaatccatcagaaaccaaaggtgttctaaatgtggagctgacagtcggcagtaagactattcctaccacgttttttgtcatcgatgggaaaggttcttacagcttgttgcttgggagggattagattcatgccaattgttgcattccttcaactatgcatcaatgtttgattcagtggcaaggcgacaaaatagagatcgtgccagccgacaagtcagttaatgttgccagtgctgatttagctctttgggagatggatagccttgattgtttatctggaaaagtctgggatagagattttctaaaagtgtccgattctgatatacagccaattgaagatggagaacccaagctattactttgagggcgtcgtggagggttcaagtgtctacactacggacacggtagatgatctcgatgacaagcatggtcaaggtttcatgtcggccgatgatttggaagaagtggacataggtccaggcgatcggcccaggccgacatttattagtaggaacttatctccagagtttagaaccaagctgatagagctcttaaaagagtttagagattgctgagcttgagagtattatgagatgcctggactcagccgatcgattgttgaacatcggctacctatcaaaccaggggttatgccacatcaattacctccgagaaaagcaaaggcgaacatgcttgaccgggtcaagggtgagatcaaaggatgatatgatggtggtgttattggtcctcgccgaatatgttgagtgggtttctagtatagttcctgttatcaagaaaaacagcaagggcagggtatgcattgggttcggaaaattggaataaggccaccccaaaggatgaatccccattaccagtagccgatcaactagttgatggctgcttcgggacataagattttgagttttatggacggaaacgcagaatacaatcaaatttttatggccgaagaagacattcataagataacttttaggtgtcctagtgcaatcggcttatttgaatgggttgtcatgactttcggcttgaagagtgctagagctacatatcaaagagccatgaattacatatatgacgatctaatcggctggttggttgaagtctacattgatgatgtggttgttaagtccaaagaaataaaggaccatatagcttatttgaggaaggttttcgagagaaccagaaaatatggtctgaggatgaatccgacaaaatgtgcttttggtgtatcggctggccagtttttgggatttcttgtccatgagagggggatcgaggtaactcaaaggagtgttaatgcgatcaagaagattcagcctccagagaataagacagaattacaagagatgatcggcaagattaattttgttagaaggtttatttctaatttgtctggaaggttagaaccttttacaccattgtttagattgaaagtcgatcaacagtttacttggggggcagagcagcaaaaggctttggacaatattaaggaatatcttagctctcctcctgttttgattcctccacagaaaggaataccgtttaggttatatttatcggctcggtcttgattcaggaattggaagggaaggaatgagttgtattctatctcagtcgtcggctcttgcatgctgaaactagatattcccctgtggagaagttatgcttgtgtttgtatttttcgtgtacaaggttgaggcattatctactgtccaacgagtgtactgttgtatgcaaggccgatgttgtcaagtacatgctatcggctccaatattgaaaggaagggttggaaagtggatatttttcttaaccgagtttgatcttcggtatgagtcgccgaaggcgattaagggacaagctatagctgattttattgtggaacatcgtgatgattcaatcggctctgttgaaatagtgccatggactttattctttgatggatcggtgtgttctcacggttgtggtatcggcctagttataatttcccctaggggggcatgtttcgagtttgcttatactattaaaccgtatgcgactaataatcaagctgagtatgaagcagtgctcaaagggttgcaattactcaaggaagttgaagccgataccattgaaatcatgggggattctttgctagtaatcagtcaattggcaggagagcatgaatgcaagaatgatacattaatggtttataatgagaagtgccaagaactaatgaaggagtttcggctggttactttaaagcaattctctcgagaacaaaatattgaagctaatgatttggcccaaggggcatcaggatataagccgatgatcaaagatgttaaggttgaaattgcagcaatgacagctgatgattggaggtatgatgtgcatcagtatttgtgtaatccgtctcaatcggcttctaggaaattgcgatataagggattaaagtatactctgttggatggtgagctatattatcggacgattgatagtgttacttaagtgtttgggtgccgatcaggctaaagatgcaatcggcgaagttcatgaaggaatttgtggtactcatcaatcggctcataagatgaagtggttacttcggcgtgcagggtatttttggccgacaatgctagaggattgtttcagatattatagggggtgtcaggattgtcagaagtttggggcaattcagcgagctccggcatcggctatgaatcctattattaagccatggccattccgaggttggggaattgatatgatcggtatgataaacccaccatcgagtaaaggacataagtttatattggtggcgactgattatttcaccaagtgggtggaggcgattcctttgaagaaagttgattctggggatgcaattcaattcgttcaagaacatataatctaccgttttggtattcctcaaactattacaactgatcaggggtcaatcttcgtgtctgacgagtttgttcagtttgccgatagcatgggtatcaaattattgaattcttcaccttattatgcacaagctaatgggcaagctgaggcgtctaataaaagtttgatcaaattaattaagcggaaaatttctgattatcctcggcagtggcatactcggttggccgaagcgttgtggtcttataggatggcttgtcatggatcgatccaagtccctccttgcaaatttgtttatgggcatgaggctgttttgcggtgggaggttagaatcggctctcgaagaacggaataacaaaacgatttaacagctgatgagtattacatccttatgtcacgattgcgagcccttgcaaaggttaccaaggataaggaacgtattgctcggcattataataagaaagtggtacctaaggatttttcggaaggagaacttgtatggaaattgattgtgccgattggtactcgtgatagtaaattcggcaagtggtcgccgaattgggaaggaccgttccaaatttataaggttgtgtctaaggaagcatatatgttgcaagggcttgatggtgaagtctatgggcgagtgcccaatggcaaatatttgaagaaatattacccaagtgtttgggttaacgcatgatcggctagtattgccgatgcatgacagccaatgtgtttgcatcgccttgagatggccgatattgttatatcgcccttagttgttttttcaagaggtaatcggttgtgatttgccgatgtacaatggccgatattgttatatcgcccttagttgtttttcatggtgtaatcggttgtgatttgtcgatgtacaatggtcaatattgttatatcgccgttagttgttttataattttatcaatgcttttgtcattgtaaaattaggggggcacatatatatcaaaatgcaagaatcaaaattcaagacaaaaatgcaatgcaaattttttgaggcaatttttttgagcgaattttaaaagtcatattaatcggcacaaaggattgtcaagacaataaagtactagagcatcttagctgattacaaaaaatttctgagtcctattacacaaagttattgagagaagtatcgctggatagccaaaatagccctttgcctgattttttctacttcttcaatagcttgggcatcttgagcatcagttccagagatgactttcagagacttggttaggtcagcaacattcttgatagccgatttgagccttgcttttattcttcaattgattttgggagatcggctagctttttgtgttctatatctagctcggcattgcattcttcaagttgcaccaagagctcaattttgtgagcttcgagccagtcaatattggatttgatcggaccttcagatagctgatcaagtttggttttttcttcatgcacaagctgccgattagcttggattgtggcctcaatctctttgcgatcacggcgttcggctagtcttagcttggctttttccagcttgaactgatgttgctcgagataagcggctggagttaggacatcggccagatcttcgggaatcagagcttgaacttcatgtagccttgtcctaattgacccacagtcaactaccaaattgtctaaagaagaggcttctagccgatgagaaatgtcttcaagtgtttttctcacatcatcgaataggggagctagggctttgcttgaagtgtcttcttctgcttcgtcaaggtaatctctgatgtcaaaagagaagagatcagctagtgcctgtagagacaatttcggaaagaataagagctgggtaaattatagccgatctaattgttgagacaaagggaaacttactggaatagcaggagcagctggttgttcttcctcttcgacgtgatgactccccacagctgatggagtttgatcacttgaagattgctgtacaggaggagaaggaggaggaggctgcgaaatagacaagtgttatatagaatcggttgagattgattaattaaaaggattaaggacatctttctggtggaaccgatttaacaattgttgctgctgttttttttcttcacagcagttttcttcttctgcaaccacaaagtctatgggtaattagctgaagagtgaggtaatttcagaagaagtcagagaaaggtacttactcttgtaaaatgaacgggggcagaaggagttggaggcgtttgcttgggtgaagccgatggtgttctttctatgtcactcatttcggctacagcttggtcaacatcttcatcaatttcctcttcatctaaagcttgttcaatagatggatccaaggcgggcagatcatcagtcgacatatcagttggttgtggttgagttttcttgaatttggtctttttctttggagccaaggataaggtactcatggctgatgatctggttttccttttcttgcctgcgtcggctggttccctagttaggccgtgaaggagagttgaagtcttgggggcatggtagccgatgaaagggggagatagtccacctccattcggaattagatctgaagcatattcaatgttcttgacactgttactttgatgaggaggggaggactctgttgtctgcaaaacaggagtaagaggtcagtcaagtaatgaatcggctaactggttatgcaatttagtaatgacaaagtttaccggggcatgatgtcagggaatagatctgtcacatacattgaagccgattgatgaaatagatgcagcttccattcgccccaccatctatcaaagtttttgcttctaaatcttgccaactcaatattatcaatactgcccagagggggtcctggtaggttaagtagccgatccatcattagagtggaagtgatttgtcctcggcactgaatcttgtcggcaaagaataagccgattgggagttggcccaatccaagttgtctggccgagctcattgggtgataaaactcgtaagagacttggatgtttcttccttggtgaataccgacagggaggatgcatgggctgattgcagctataagaatttctctggatttttggaattttttatggttaatatcttcaaatctaaagtctaatggaagttcaaggtctgctgagtcttcgtagggaaaccagattcgtgcatctttcttaaaaccttcgtagaagctgcagaaccagtcttgagtaactcagccgatagcttcgctccagcatcggttggtgtggatgcatattctccatatgacatgcatctgcgatgggtgcgctcttctccatcatcttccacaatcggctctggcaatgggaattcagcttctgtcacagagggccgattgacaaccttcatgactaccaggtttaaccaagtttgcagcagccaccatggtccacctgctccaactattgagccgacggctattttagccgatgcattgttcaacatctggtacagatagccgagaaggattttgcccaaaggaaattctttctttgattctaaggcttcggctacgaattgccattggttgtagagcaacaactggatccacagaagaggaatttttccagccaaataagcaagaaagctacatgctctcgaggggtaacagacccttggcccatatatgccgccacatagccagaccagccacctatgcttttggtcttgaagttgaattggttcttggtgttcatgctcatagggttagccgatgaagttacatctaatccagtaatcatggtgatgtcaattaaagttggagtcatcggcccttggttgaataagaaagcattaatggtgttggactagaagtaggtggcggcagccatcagaggttcatccttagtagaattggctatggtgagagcgagtgcttggccgattccaatttcatcccagtgaactttcttactagccgatacgcgttggtactaggtggtccagctcttatcaggagtaggtttttcgagagatggccaagacttgaaggtattcttccagtgactcaggttagggttggctagtctaaaggggatccggttagtttcaccgatgatgaaatcagtggggtcgagattgccgattgggccaagaaaatagtggtttttgtgtgaaaggctgggaatcgcgactaggttggaaaggtgctgcaaatccaaaggaattgggaagtagaaaacaagaggagaaaaggagaaattgagttcatgcgaggaaaagggaactagctggtgaggacttacctcagcgtactcagccgatggcgcagtagaagggctggtggaagacgacatcgccgcgggcggagatttggttgggaacaaaatcgcccggggatcgtcttgtgcgtcggggagatcaccggagagagagagagagggcaaagttggtttcagtggcaaaaacggaggaggacggtgtgagatttctcgagggtaacggttagtatttaaagcacggcagtaacggtcggaaaacggcaaagtgtgaaacttgctcggagtcgatttacagcaaatctgaaactctatcgaatattccggacttcgggggcatgtgttaacaaccaaatttggtaatatcggcatcgggaaagaagattagatcgaagcaaagttggaggcagagatcgagttcggaaacagagcaggaatcggctggagtccagatcggctacgattaggatcggctgggtctgagtcgggctaggtaagccgatgcagtcgattccgacaatgcaacatgatgtatgacatcgggttgaattgaggtgcttcaaggtgattgccgcacatggatagagtcatgagaaggcaattgtatctattaattaggatgttttatgtaatttcattagagatatgcttgggcaaaagtctgccgcaaagacttatggtatcttagagtttgttagagatagtagtcgtgtccgttatggacatatcttgtaattctcgggtataaatagacccgagccctatgtaacttttaacacacacgttcaatacaatttcggcgcatcgccaccatttttgctttagttttatttcgatgagttcttgctttcgggttgagctgcatcggttttgatcttcaacaagaggtaaaacttgttatggcggcttgtgttttcgggattagtgcttccatctttatgacactctaattttgtttatgtaattcgtcgagttttcatatatcctacataatccttggcaatatcgatatctgacctacaatcggctaacatccatcagtagaaggcagccgattaggttaaatgccgttgttgacttagattatataggatatctaccactctatgacacatccaatagcttgattgtctagatattgtccttcttttcatacttatagctgcatcagttaagtttgatcttatgagttgtgattagaatctcaatctctagcccgcttcttggttgctgattagggtagtatcggagtttcggagtttcagccgatcttgcttgatttaactactttttatcctatatgcttgattgacatgttaaatctgccctttacgttaagatcttgctgcatttaagtatattaagattttgtttagtatattctacttgctttaatatcttaatatagagtggtatcggagtattagctgatacatgctagatctatctgatcggctatgctatgaacgtatatagtctcattattaatatatatttcgatctaagtgatttatactacctcgacatggcgaccgatctatcccactcaattgatttaagtatatattgatataaagattatatattggtaatatctgcagctgatcgagtaattcaatcctttcttatttattaatgactgccgatcgatgcatatacgacatcggctcaaagataaatgatatgtcatcggcacctcgccgatcggctatcatttatagatttaactgcgatttctttgcttctatttcttgttgattacaggatcaaatcaactggcacgctcatacattcgaatgcgagctttggacctgcactggagttaagaagatctcccaggcctcgtgttttctgtcaacagcgtgttgttcagagttgaataaaattaatgattaaattactctactgtttcgctactcttaaatctttgctaaatgctgcttttgcaaatgagcctatattatgccatcctttggtatccttgtggacttgcatatttgttgtgtggcttgttgagtatgtcatatgctcattcttgcaataatcaatcaacctcagttgaagaaaaaggatccagaaggagaagacgtttggcttataccccagttgagctgcctatgggggtgaagctggagcttcgctagattttatttttccacagcagttttcttcgttgtgaggactaagtgcctcttcagtaagtattaattgctttagttattttgatgtatctgtatataaaattgtcagtttgtgtacctcggctgattcctggatggggattttatgcacaaataagttcggaaattactagtgaatttccgggcgtgacaagttggtatcagagccatctcgactgtaggataagccaaatggtcagactttaaggacaaattttctgaaaacatgatttgtgaaaaattttcttttcttccttctctaaaattctttgcaaattgttttatcgttctttcccctcccactttcaacttaagtagttgttaaacttattagagaaactcgaagacgtcgatgtggtctacttatggaggtcaagtcaagtgagtcgaggaaaaagaagataatggtcgaactgaagtgcggagcttttgtgatggagtgaagtttggatcctaccttagaacctaaaccaccaaagtgactttgaagtatagtcagtagggtacaacgtttgttacttgcttgtgtgtaggtatggttgcattcccatcattgggtgtgatgagcgtgtaattatactaggttgcttgcttaatcaacttaaacaatataatggtttacacacatcagatcagtggtaacatggttaaggtctcgtctttagtgtgacccctctccttctaacttttcaaactctgcgacggataaaaaaaatgcaagctatagtgggaaccacaacaatgctagtggatcaggaagttggaccaatggatcaatttaggacaatcacttgggcagagttcactgaagcattaaagaagacacacatagctgcaggagttgtttttttgaggaaacgtgagttcaagacacaaacaaaaggatgataccatgacagagtacctccatgagttcaaccgtctagctcgctatgctctagaagatgtgcgtactgacgaagaaaggtaggagaagttcttggaaggtctgaaggatgagctgttaattatgttgatccctcatgactgcggatttcaggagctggttgtcaaagcaattcgactggaatataagaagaacaggatggacaaccgtaagagaggaaggattgtttcccaggaggcacagggtagtagccaaaggcagcgtaccaagccactccaaattggtgaatcttcttctgcatgtcaagaacaattacaacagttggacattagtggtgagatcaactcagagactaatacaagaaatgaagttaacatggagaaagctactcaattagtgctagttcagcaggatcagtctcaagaaggtaatagtaatggaagggagcagcagttgtgtttcaattgttatgagccaggtcactttgcaagagagtgttcgaagccgaagcatcaacatccacaaggtcaagtcaacaacatcatcctcacaggagcaaatgcagtgccggttgcgtcttcaagtgatacagctcagcgatcagtttcaaagcagcagtagtttttttaaagccttagaataattattggagctagggaataagatagactgcagttttacctatttcctttttctttctagccgttccgaatctcgagacgagattctttgtaagggggtagatttgtcacatcctgattttcgttttaggatttataaattatctaataaattattattagaatttatattaaatgttcattaatttacaagtgaagttaaatgtggaaaataaaatttcctaaatataaagcatggatggatttaatttttattcaattctccatggttaattatactctctggaattttctcggatttttcggagctcaactcttaattttaatcatacaaacaatatttcagtaattatccacatattaaattaatcattaaatggtctggttttagtatttttaaatactttgagtgtccaagtatgttcaagatttttcttggaattatttgagcataggaagtatttttaacaattcaaagatcatttcagtgattaatttaattgaaaaagtaataaaaaatcctcctcctcagcttgggcccttttcagcccattccctctccgctctcctttccttagccgcagcagcccactctccctctttctcttggctgaagtccattcaggtccctccttcagtcgggccggagaaaaagtaagcccagacaaagtctactttacctccccggtactgttcatcttccagctccagacagagcccgagccagccgtcccgagattgtgcagcgccgttttctcctccaaatctagtctcctctctcgtgttatttcaaaattagttgaggggaaatattcctcttatgcttctctatctttttcccccaagaatcggactttatcccgaagaaatcaacgcggaatcgagctcgattcgtgtttatctctccaccaaaccctaggttttcctggcgcgattccttgcgttccaagcgcgatctctctctcccatggctataaatagagtcccctccctctcctctttcggccgccacctctccctctctccgccgtcgcttgtagcgccgtcgccgcgttcgtcttctctctccgccgcccgcagccgctccagccgccgtttgccgccgcctcggccgtcgccctcctgtgccgccacctctctcggctccgcaaggtcaagagcaagcccggcagccggttcccttgcgccgaagaccccgggaagcccatcgtcgccatcaacccgaagctcgccgtcgtgttttgatctccggcgaggctctgcagctcctcccgtcatcgccaagcttcgccgccgcctccattggattcgcagccgcgaagtgaagcccggccacccctccattgtcgccgaaggtcgccgaaacaccgtcgccgccgtggacagtacctcgctgccatctcgatctcgtcgccggccatcttccgtcactgtctgtcatcacgtaagtgttggtaagaatcgccgtcgccttctctacctctcggtgccctctgtttgcattgttgtgttgtggttcgccggcaaccgccgcacctatgtcgttcaccggtgtagtttatccctagggtcttaattcaatataatctaatccgtggttgatctagcgcgttgtcatctccgtgtgttgctgtcggaacgttgtcatcatcccttcctctccgatcgctttggttcggtgcgacttctatccgttctctcttttcaatggtatattatttctttttaatatatgtcatctaccaaatataatctaatctttttcggaggtcgttttaatcttttctctcagttataaatcatttgtaaatggtttaattaatttggaatagtcttttctttaatatgtttaattggaattaaatcttataaaattcatatctaattcatatgaagtcggaatgaggccgttcaagtctctaaattcatctaaaatcatgatttacatgtttgtttacattttatgtactgtttatttggtttttattagtttttttctccgttttgcgtgttagcttgtcgtttccgttgttgcgaaggttcgcgagtgtgttggaagtggttctgaagactaattgaagactgattattgcaaggcaagtcacacagatcccaaacatgattcctttgagcatgttgatcctatatttaaattctctatttatttcaacaatgcatttattttcgaatgtcaccgggtggtgtgaacatattcctttgttatggccaatttgtattgaatgccctattccttgataccttgggtaataaattgattagcttgaaccttatgtattggtttggttcagctaaatgctatatatataattgcttagccatgcctagaaacattagttcattaataggatgaatcctactacattattatttatggttatatttaatggtacctcacgatggttaatcatgttataataattaattgataattaaaacttgataatggtgggttgtgagcacatggttttgaaggtcgtgctcatgacaattaaggaccggttcgcgagctactgttgtgagacattaaccgtgccaaccacaagccagcgtgggcaacggctttaccttttgtatagcatggttcattgcggggcaccagactgtgaagcggcgagaagtccgtgggggtcgctggggagtccatgcctctggttattgagggggtgattatgatccaggaacggtggctgtggtggattgtgttgtgcaaggtactgtcacagttcctatccgagatatcatggtggtattgaggcgcatggtaacatgtcgtggagctgtgtcttgtgggtacagtggtacatctctggccagagtaaaactattcgaatagccgtgcccgtggttatgggcgagttgagcaatgtttttcgtgattagtctcatacctctcacaataattattgatgctataattggtaataatttgcttagctcctggtttggagttagatctgtacagccgggtatggttgttcagaatggttgggcctgagcagcatgggcgtattgttcagagttgattaaaattaatgattaaattactctactgtttcactactcttaaatctttgctaaatgctgcttttgcaaatgagcctatattatgccatcctttggtatccttgtgcacttgaatatttgctgtgtgacttgttgagtatgtcatatgcttattcctgcaataatcaatcaaccttagttaaagaaaaaggatccagaaggagaagacgtttggcttataccccagttgagctgtctgtgtgggtggagctggagcttcgctagattttatttttctgctgcagttttcttcgttgtgaggactaagtgcctcttcagtaagtattaattgctttagttattttgatggatttgtatattaaattatcagtttgtgtacctcggctgattcctggacgggggttttatgcacaaataagttcggaaattacctgtgaatttccgggcgtgacagcatgtatgcaacacgttgcttcatccatgtgactttgagaaacgcggcataactagtgtttccaagctttgccatttcttggttgcatgtgatcgagctgtaatctaaattcgtaatcttttaatcttttgagcgccgcactataatcaggatgatgatgttgccctcgatcaggtcactgggcccaccatcttgctcagaccgctagcggcgcacacagtctttgccttgagatgataacccctcaggcggagatctctgtgaagagcatgaggcaaccaataccagcgggcttctcgttagaattatcagatgttttgcttttaccctgggatagcgtcaatcccccgggctgtgttctaccccggggcacgtactgtgcctgggcccattggacggacccgagccccaggcacagtcccgtgctttgtaatagaagtcttcattatgttggacgaatttctggaagatgtcgttgatgaaggagttcatgatggacacaactctacaagtttattccaatacgcaattgtatctatgccttgaagatgcaaatcttgatggaagccagggcttaagggaagcaagggacccaattcttgttctgtgccagatgtcagtccccacatatgcatgccagatgtcagtccccacatatgtaggttgtcacctggcaaatgaattctaaatatgacagaaagtaataatgtggcccatggtactttaggatcccggagaaagggggaccccggttcccatttctccaacacataggattcttcaaaataataaatttcaaaaataaaaactcatgtgttgcaatagttccctttgttccaccggtcatatgtcataaatcatactggataaattgtctactttgcaaaacaaataacttactcttatttcatcattattatctagctattattatctagttgcttgttgtatacctggtttgagcatagaatttgatattcctcttaactcccagatttggcacctagctagagtaagaataggaaaacatggccagatttaaaaagaacccaaaacttgctatgcgaggccagtctaaccgccactgtagggtaaacttgaatgcgtaatattattactaaaagttttttggtgagcttaggtagatagtgcaatgaaggcgtgcggttttatggtagtgagtacaacatatcacttatttagatgtggcaaaacttaagtatatcacaatgagtacaagtttacttgcgattatacgtttcaatagccaaggctttgagtggtgtctctttgtgaagcaccatcccatacttctctctcatatccacaccatctttctcggctccttctggaagcttccagtcgaagtgaaacaacagtgacgcaagaaccatatgaaccatcctgtacgccagtggcaaaccaaggcagatccgccgtccgccaccaaacgggatgaactcgggatgcttgccgaagaaattggtgtccgtctccatgaatctctccggcataaacctatcaggatcagcccacacgtcaggcttgcgatggatcgcccaaatattcagtatgatgttggtgcctttgggaataatatagccttgcacttccactgtagcctctgctttgtagtacgtcattgggacacttgggtggagccggagcgtttcttttagtacagcttggaggtaaggaagctggctaatgtcagactcctctatctctgttctagtacccaaaactctcctaaactcgtccttcaccttctgcattgattgtggattttgcagtaattcaacaattgcccactctattgcagttgagcccgagtcagttccagcgacaaataaatcctgggatgtgtgttgatcaaagccaattcatcaatattatgcagattgtgatgaacgattgaaatgataactaattactaccgtcttctgtcaaacgaaaatgaaacactaattggatgtcattatcatacattctcgtctcgtctcgctttccattgaattgagaaataatttaagattcaagaattaatcataccgcgatgagtcccttgatgttattacggtcaatcacaggattgttgttcttccattcgtcttcgttatcgagcgccacgtccagcatgtcatccttccgcggctcgccggcttcacggccacccttccgccgagcaagaagctcgtcgatgatcccataggcacgcgctactagcttccccatcctgcgccgcaagccctgcaggcaatgttttaaataacggggttaaggcatttatcggttagcttctcaaacagttatagcttccgctacagtagactaaatggagttataacgactaaattgtacatgagagcaaatagctagaacccttctcaaacagctatagcgggagatttaaaaccctgcctgcaggtcggcggccgccatcgccgggaagaagtcggaggcgttgggcgtcgcggctagcttggtggcctcctggacggcgtccctcaggtcgggtcgacgaggtcggcggagaacgcggtgcacgacaggatgcccaggaatgcctcgaacgcctcgagcccgacctcgacgggctcgccgcgcgccgctcgcctggcgacgcagcgcatcagctcccgaaccttctcccgccgcgtcggcgccagcgcgtcgagcctcctgggcgacatgacctcctccgtagcgagcctccgctgcgcgcgccacacgccgtgcagcgggaggacgatgacggagttgcggtggtgctccgcgccccgccacacgtcgaacagcgggcgggacgcaaggtgcgcgttgtggctgtggtggtggatatcgcccgcgacggccggcgacgaggcgacgacgtaatcgacgacgccgagccggacgcgcatgagcgggcagtagcgctcggcgaggcgcgcgagcgagcggtgggggccgctccgcgatacggacaggaggttgccgacgagcggaagaggcgttggtcccggaggaaggcggcggcggcgcgcggcggctactcggtggtgcatggcgaggtagagagaggcgaggacgatagcaacaagcaaccaagccagggatgccgccatggctagcgtacgttcaaggggtacgtacgtgctgatcgaccttgatatgatgcagtagcttgcaccatatgcctcaatttatagtgaatgctctggccattagaatgctattactccttccatgtcatattactacgtgaataccccgccgcattgctgcgggaaattaagttatatcatatgtataaataacatacaatacaattattaaaactaaaacaaattgatacttatgaattttaagccgaaaataattgagattgcatggtgttatgagagaagaaagaagagacaatttgaaccacagctctatcatccaaatgctagaaataattgaggtcatgtggcataataagagaagagagaaatagcattaactatgtaggatctgttaacaaccaaatttggtaattcaggcatcgaaggtaaagataaaatcgaagcagaatccaagatatggatcttccggaaacagagtaagaatcggctgaaatccgaatcggctgcgaccaggattggcagagttcgagtcggacaaggtagccgattgagccgattccgtcaaagtgtcccgatacacatcatcgagttgagttaatgtgcttcacatggattgccacacacggattgagttctgaaaaggcaattgtatctattaattaggatattttatgtaaataacttagagataagcttgggcaaaagtctgccgcaaagacttatggtatcttagagtttcttagtgataagagtcgtgtccgacaaggacatattttgtatctcggatataaatatgactcgaagccatgtaatcaaacaacacacgttcaatatcaatcttggcgcattgccaccctttttactttcgtttcatcccgacgagttcttgctttcgggttgagctgcatcggtttcgatcaactagaggtaaatttgtcatggcagcttgcgttctcgggattagtgcttccatcattataatactctaatcttgttcatgtaagttgtcaagttatcatatattctatgtaatctctagcaatattgttatttaaccctcaatcggctaacatctgttaatgggaggcggccaattaggttaaataccaacgttgacttagattatatagggtgtctaccactctatgaagtttccaaaagcttgattgtttagatattgttattgttttcatacttatagctgcatcagttgagtttgaccttataagtcgtgattagaatctcattctttaacctgcttttggtcgctgattaaagtagtgtcggggtttcagccgatattacctgatttagctttatatcttatatgcttgattgacatgctagatcagccctttatgttaagatgctgtggctttcaggtatattaagctttctgtttggtatattttgcttgctttaatatctttatatagagttttattggagtattagctgatacatgctgggtctatttgatcggctatgctatcaactcttataatcttttcgtcaatatatatttcgatctaagtgatttatattgtctcggcatggcgaccgatctatcccaatcatttggtttaaatatatatcgacaaagggattatatactaatgatatctacagccgatcgagtagatttagttctattttgcttatttacaactgccgatcgattcaaatatgacatcagctcaaaggtaaatgatatgtcatcggcggctggccgatcggctatcatttatgggtttaactgctattttcctattttatttcttgttgattgcaggttcaaatcaactggcacgctcacgaacctaaaaggcaagatttttggaccggcactgaagttaagcagatcttccaggccactgtctgttttccgtatcaacacgcttttggtacgcccagtgggaccgagtttcaataacttttctcatggctgagaaaccaccgcagtcgccagcgacggtgggcaaggccgagccacctcttagcaagccaccacctgggcaaccgtctgaggtcaataagggaaacatcatcccaatcacattagataagttgtcagctgagcagaggcaggagctcgagcagatgatgagcaccgtgaaggacaaattcatgaactcattccaggagacccacgagggaacggtcgtccaaaaatataagctcaaagtggtcactgccgatgaagctgggacaagttcatctcaaggtgttaagggtactgcagattgctcaggtgataaaggtgatgggcttcaagatggcttggtcgaggatcttggtgaagatggtaccgaagagcaacaacctctgaaattcaacagtttccaagatcaagtcgattatgctgtaaagcatgcgttgatgaaccaattaggagttattgtcaatactttatcgaatatgatcaagtcaatggttgatggcacgatagctgagcatcaaaatacgggaccagtttatcttccaggaggtgtcttcccaaattacagagagttggtaactggtaaccaacagcccgctatcagtgcaccaccagcctagccgatggcaccagcttcggctcctgcgccagttgcaccgtcatcggcacagaggcaaatgaccaatcccagattgctgaccagagaacgaccatagcatgctgcgcaaaatatcaatcggctgactcaggaacaggttgccacgatgtttctaccaacaccaccaactactgatccagtacagtcaatgctggttcagtaaacaccaccaaggcagcaagtagtacagccgattcaacaacaggtggttcagccgattcagcagcaaatggtgcgacaagtgccaactgggttgaggacacctgacaatcggcaaagacaacagaatgtagctcaagttatccctaagcatctggtgcataatgtacaaccaaatcaatcggctgtggctcaagtcgttcctaaacatttggtacacaatatacggccgaatttccagaattatcaagggggtaatttgaactaccagtatcagcctccttcacctcatgtccagcatcaacaaggtggatcacctcaattgcagacattgcctcagttcagccagtttgatccgatgcagcaacagatgcaaggagtacctcaacagaaaccttgggcagatgtgatgagggagcaatttggccttaagccaaaggactctggaaatttgtatcggcacttgtatcctgaatggtttgagaaggtttcattgcctaaccgatacaaagtcccagatttttcaaaattttcatggcaagacaatgttttgacttatgaacatattagtcgattcttggctcagtgtggtgaggcatcggctgttgacgctttgagggttagattgttcccattgtccttgtacggatcggtgttcacttggttttcttctttgccttacaactctgtcaatagttgggccgatttggagaaacaattacacagctatttttacagtggagttcatgagatgaagctatctgatttaacagcagtcaggcagaggcatgatgaaactgtacaagactatattcagaggttcagagagatgaggaatacgtgctacagtctggctttgactgattctcagttagccgatttagcttttcaaggtttgatagctcgaatcaaggagaaattttcatcccaagactttgagagcctatttcatctcgcacagaaggtgactatgcatgagcaaaggtttgcggaggctaagaagaatttcaagaagatcaatcatgtatatccttacatttatgactccgatgtggaggatgattccgaagtagcagcagccgggtgggttaggagcaaaaaggttgtgacatgcccattggtgaggagttctggaaaggaggaaagatttgactttgatatcaccaaggctgacaagatttttgatttgttgcttcgggagaaacagattcaacttcctgctagccatataatcccatcggccgaagaattaggcaaaaggaggtattgcaagtggcataattctggtttttattatactaatgattgcaaagtttttagacagcagatccaggtagccattgaaggggacaaaaatcaaatttgatgattcaaagaagccaatgaaggttgatggtaaccctttccctatcaatatggtgcatacttctgggaggacagccgatggaggaaggagccagaattctcaattgaattcggttaggattatcaacaagtatcagaagaagcatgataaacagcaggaaaggtttgatgaagaagttgatgatggttttgattctcattgggattgtgaattcttcagattttattggaatcaaggcatgaggttaccatcgattgaagattgccctgggtgcagtgatattgcaggagttcaagccgatcgtataacagaagctatcggccgagtcagaaaaggttgcctgttcatcagaggttgggcctgatcaatcaagaccgtcaccaggatgaagatgaggatggaaagacacagtggtgtccttctggtattttcacaaagaatcagaagagaagagttcaacggatgaggaacagggagcgtttttaggaggtacaacaagaaattaaccatcggctgaagaagacaaagaccaagcaagagtggcgtgttaagagcacggtcacaacagccgatgaagttgaagccgacaagaccaaaagattgctcaagggtaaggctactgcatctgcatcggtgaacatggtttttatgctgcctgcagaattcgaagccaaggaagccgatgttgatgatgttgaagaagcttctgctagattggttttgtcacctaaacaaacaatttttgagaaaccagaggggacagaaaatcggcatttaaaaccattgtatgtcaatggatttgtcaacgggaagccgatgtccaagatgatggttgatggaggagcaactgtgaatttgatgccatgtgctacattcagaaagttgggcagaaattcaaacgatctcatcaaaactaacatggttctcaaggattttggtggcaatccatcggagactaaaggagttttgaatgtggagctgacagtcggcagtaaaaccgttcctacaacattttgttgtgattgatgggaagggttcctatagcctgttgcttggaaagggattggatttatgctaattgttgtattccttcaactatgcaccagtgcttgattcgatggcaaggtgacaaaattgagattgtgccagctgacaggtcagttaacgttgctagtgccgatttagctctttgggaaatggatggtattgattgcttgtctggaaaagtttgggatggagattttctaaaagtgtccgattgtgacatacagctaattgaagatggagagcccaagctattactttgagggcattgtggagggttcaaacgtctactcgaaggacagagtagatgatctcgatgacaagcaaggacaaggtttcatgtcggttgatgatttggatgaaattgacattggtccaggagatagaccaaggccgacattcatcagtaagaacttatcttcagaattcagaaccaagttgatagagcttttaaaggaatttagagattatttcgcttgggagtattatgagatgccgggacttagccgatcgattgttgaacatcggcttcctattaaaccgggggttagaccacatcagcagccgccaagaagatgcaaagccgatatgcttgatgctgttaaagctgaggttgcacgtctatatgatgctagtttcattcgtccatgccgatatgctgagtggatttcaaatatagtttcggtcatcaagaaaaatggcaaagttagggtgtgtatttattttcgcgatttaaacaaagctacccctaaggacgagtacccaatgccgattgccgatcaattggttgatgctgcttcaggacataagatacttagttttatggatggtaatgcaggatacaatcaaatctttatggcagaagaagacattcataagacagctttcaggtgccctggtgcaatcggcttgtttgaatgggttgtgatgactttcagcttgaaaagtgctggaggtacatatcaaagagccatgaattatatattccatgacttgattggctggttggttgaagtctatatcgatgacgtggtcgttaagtcaaaagaaatagcagaccacatagccgatttaagaaaggtttttgaaagaactcggaaatatggcttgaagatgaatccaatgaagtgtgctttcggtgtatcggctggccagtttttgggattttttttgttcatgagagggggatggaggtgcctcaaaggagtatttacgcgataaaaaagattcaacctccggaggacaagaaaaagttacagaaattgatcggcaagataaattttattagaaggtttatttcttgagattgaaagccgatcaagagttaacctggggggcagaggaacggaaggctttggataacattaaagaatatcttagttctccttcagttttgattcctccacagaagggagtgcctttcaggttatatctattagccggtgagaagtcaatcagctcgattttgattcaggagcttgaaggcaagggaagggttatattttatctgagtcgcaggcttttggatgttgagacaaggtattctttctgtggaaaagtggggtttgggtttatatttttcttgcacaaagttaaggcattatttattgtccaatgaatgcactgtgatatgtaaggccgatgtggttaaatacatgctatcggctccgattttcaaaggaagagttggaaagtggatatttgctttaacggaatttgatcttcggtatgaatcactaaaggcagtgaaagggcaagctgtagccgattttattgtggatcatcgtgatgactcaatcggctcggtcgagattatgccttgtaataagaacacaactagctcggatataaccatggctactttatgtattactcaaccaaaggtgcatatgttctatattagatttacttgttatatatttgaacaaacattgcaaaacgatgagttttgtgtgttttcgtttgcagaggtacttgcttgggcgaaagaaaagagaccgagcataagaaatgcatggatgattgaagaagttgattagggaccaaaccaagaccttctccaagtcttctttcatctaaccacgtcacttttggcccatagaagacaagagattaagttgtgcacgttttggaatcggattcgggcctcctaacatgatcaacttcaaacgaacctagccactgatctagaaggaatttcggggcccatgaatacttgttggaaagcttatggagtctactttcagatggtttgtgtcccatgttaatattcctattgagctgccgggaatccgcaaaacaagccacgtatctcatacagtccgaatctgatttgggttctgggccatataattttgtcgtgggcttagcccaagggggtgtgcaccctaggcaatcctaggacgtccctaatcacattttttcagtacccgtcaacgtttagagtggggttttgcttagattaatctgtcaagaacagttttgccgctagatcggtttgtggaaccccaaatttgtgtgcttaatcattcatatgcaatttggttgcaatctatcttgttcttgcttgtgttctttgattcgcatgcagggattagctttctcggcgaggtcaaccgggtttcggcacggttgataaccagaggagacgtggtgctacgattgcgggggtcagtagcgtgtacattcagaagctggatcgagttgtgtcgcgactctgcccaaatcgactgtttatcaatacctatcggaagatcgggacctaacatccctcatcaccttggactttgtttttcgatggatcagtgtgcactcatggttgtcgtttcggcttagtcataatttctcctcggagggcaagtttcgagtttgcctacatgattaaaccttatgcaactaacaatcaagctgaatatgaagcagcactcaagggtttgcagttgttaaaggaagttgaaaccgatgctgttgagattatgggagattcattattggtgatcagccaattggcagaagaatatgaatgcaaaaatgatacattgattatctacaatgagaagtgccgagaattaatggatagttttcggctggtaactttgaggcatgtgtctcgagagcaaaatgttgaagctaatgatttggcccaaggggcatcgggatagaagccgatgataagagatatcgaagtggaagttgctatgatcacagccgatgattggaggtatgatgtatttaattatttgcagaatccatgtcaatcggcttcgcggaaattgcgctataaggccttgaaatacaccttgttggatgatgagctgaattatcggacgattgatggggtattgcttaagtgtttaagtgccgatcaagccaaggtcataatgggcgaggtacatgagggtatatgtggtactcatcaatcggctcataagatgaagtgattgcttcggcgtgcgggatatttttggccgatgatgttagaggattgcttcagatattacaaaggatgtcaagattgtcagaagtttggagcagttcagagggcaccagcatcggctatgaaccctataatcaaaccatggccgtttaggggttgggggattgatatgatcggtatggttaatccaccctcgagcaaaggacacaagtttatattggtggcaaccgattactttaccaagtgggtggaggctattcctttgaagaaactagattcgagagatgctatacaattcgttcaagaacatattatttaccgatttaggattcctcaaaccattacaaccgatcaaggttcaatctttgtgtccgatgagtttgttcagtttgccgatagcatgggtatcaaattgttgaattcttcgccttattatgcacaagctaatggacaagtcgaggcatctaacaagagtttaatcaagctaattaagagaaagatttctgattatccttggcaatggcatacaaggttggtagaagcattgtggtcgattggatggcttatcatggttcaattcaagttcctccttgtaagcttgtttatggacatgaggcagttttaccttgggaaattagaatcggctcgagaaggatagatttacaagatgaattgacagccgatgagtattacaatctcatggccgatgaaaaggaagactttgttcaatcaagattaagagctcttgctagagttactaaggacaaagagagggttgctaggcattataacaagaaagtggtgcctaaatatttttctgaaggagagcttgtttggaaattgattttgtcgatcggaactcgagataataaattcggtaagtggtcaccaaattgggagggaacattccaaattcataaagttgtttccaagggagcttacatgttgcaagggcttgatggaaaagtttatggacgagcacttaatggcaagtatttgaagaaatattatcccagcgtgtggattaattcacgatcggttgcgctttgctaatgcatgtacatccaatgtggttaacatcgccttcagatggccgatatagttatatcgcccttagcagtttttgtttatcatattcggctgagttttgccgatatatgatggccgatatggttatatcgcccttagtcatttatgtaatcttatcataatcggttgtatcttgccgatgtatgatggccgatagttaatatatcaccgttagtctcaaattataattttatcaatgctttcatcattgcaaaattagggaggcacatgtataaaaaaattgagaatttttgagtaaatttgagaattttcgagcaaattgaaaagttatgttaatcggcacaaaggatcagtaggacaatcaaaaggagtatcaaagtttcttagccgattacaaaagttttataagtcctattataaagataatcacccagacaagtaacgttggatagccgacacagcttgttgcctaatttgctctacttcttcaatgggctggatgtcttgagcatcggttccaggaatgaccttgagggatttggtcatgtcggctactttcttgatggccgatcttagtctggacgtctgttcttcaacagcgttggggagattagctaatttttgtttctccagatccagttcggcgttgcattcttcaaattgtgctatgagatcaattttgcgggcttcaaactgatctatgttagactgaattggcccaatagagagctgatcaagcttagctttctctttatgcacaagttgccgattggcctgaatggtggcttcaatatcctttcgctcccgtcgatcggctatcctttgcttggccttttccagcttgaattgatgttgctcgagatacacagctggagagatgatattcgccaggtcatccgggactaaggcttgaatctctgcaaatcttgcccgaattgaaccacagtcagctaccaagttgtccaatgatgactctagccgatgagagatatcttcaagagttcttttgacatcttcatccggaggagctagggtcttacttgttgtttcttcttctgcctcttcatcaaagtaatccttgatgtcaaaggaaaacagatcggctaagacctgcaagagagaaaattgaagacagttaaatttaaagctatataaccgatctaagaattatgacaatgaaaggattactgggatagcaggagcggctggttgttcttcttcctcaacattatggctacctgcagccgatggagtacgatcacttgatatcggctgaccaggaggagaaggaggaggagcctgaaaaggacaagtgttaattaacattggctatgatcaaagttaaaagacttttatagaaggaaccttaccgatggaacttgtctatatggtgctggtgccgatttcttcttcacagcagttttctttttctgcaaatacgagactaatgagcaatcgactatacaaatttctattcaagagataataaagatgagttatttacccttgaaaagtgagctggagcagcaggagtaggaggtgttcttttacgagaagccgatggtgtcttatctcccgagtcgcttagtctagctgctgcctggtcaacatcttcttcaatctcctcttcatccaggactttttctatggatggatctaaggcgggcaagtcatcggttggcttggacttcttcttcatggctttcttcttcggagccagagccgatagatcaacggccgatgccttagctttccttttcctgccgatattggctggttctctcagttgcccttggagtagacttgaggtcttgggggcatggtagccaatgacagggggagctagtccacctccttttggtatgaggcctagggcatattctatgtccttgccgctattgctcttgcgaggaggagaagattctgttgtctgaaaaatagaagaagttagtcaagatgcaaatcagttgacagctattatacaaaattgacaacatgaaggtttacccgagggataacatccgggaataagtctgtcatatacatggaagccgattggcggaacaagtgttgcttccattcatcccaccatcaatcgaagtccctactcctgaaccttgccagttctatgttttcaatgctgcccaaggaaggttctgagatattgagcagccaatccatcatcaatactgacgaaatctctcctctgcattggattttattggcaaattataagccgattggcaattgtcccatcccaaactacctagccgagctcattggatggtagaattcataagatacttgtatatttctcccatatggatgccaataggaagaatgcatgggctgatagcagctgaaaaaacttctctagacttatcaaatttctcagaattgatttcttcaaatctgaagtccgatggcagctcaaagtccattgaatcctcatatgcaaaccaaactcgggcatctttctgaaagccttcacagaaactgcataaccagtctttgagcaattcagccgatagctttgctccggaatcggctggtgttgatgcagcttctccatatgacatgcatcgtcggtgggtgacttcttctccatcatcattgatggtgggttctagacttggaaattcagcatctgtcaaaggtggctgatttacagccttcatggcaaccaggttgagccaggtttgtagcagccaccatggtccacttgcaccgactactgaacctatggctattttagccgatgcattgctcaacatttggtataggtagccgaggagaattttgcccaaaggaatttgcttctttgtttcaagggcttcggctaagaattgctaattggtagtagggccatagcttgatccacagaacagaaacttctcgagccacattaacaggaaggctgagtgctctcggggggtaacagatcctttgcccatgtatgcagcaacatagccagaccagccacctatgctcttggtcttgaagtcaaattggttcttggtgttcaaactcatggggttagccgatgaagtcacatccaaaccgatgagcatggtgatatcaagcagagtgggggtcattggcccttgattaaaaaggaaggcattaagggcgttggactagaaataggttgcagaagccatcaagggttcgtccttagccgaatttgctaaagtaagagcaagggcttggccgattcctagttcatccgagtgaacttgtttgctggccgatacacgcttgtaccatacagaccaacttttctcgggagaagttttctcaagggaaggccaagacttgaaagtgtttttccaatgacctagatttgggttggccaatccaaagggttatcctattggtttcggcgatgatgaactcagtgggatcgggattgccgatggggccaagaaagtactgatgctcatgtgacaaactgggaattgcaaccagattggacagatgctacagatgcaaaaaagaatagagaagaagaaaacaagatgagataaggaaaaaccgatctactacacaaaggagaggatctagccgatgggtacttacttctgcgtattcggctgatggtgcggcagacgggctggcgaaagtcgacatcgccacgggtggaagcttctcggagcttgaatcgccttgggatcgcctttttgcactgaggggattgccggagagaaatgagacaaagtttgcttaagcagtgaaaacagaagtaacggtgtgaagtttctcggggtgacggttagtatttaaagtgctgcgataacggtcggacaaacggcaaagtcttaacaaccaaattttgtaattaaggcatcgaagataaagataaaatcgaagcggaatccaagatatggatcgttccggaaacagagtccgaatcggttgaagtccgaatcggctgcgttcgggattggcagagttcgagtcggacaaggtagccgattgagctgattccgtcaaagtgacccgatacacgtcatcgggttgagttaatgtgcttcatatggattgccacacatggattgagtcctgaaaaggcaattgtatctattaattaggatattttatgtaaatactatagagataagcttgggcaaaagtctgccgcaaatgcttattgtatcttagagtttgttagagataagagtcgtatccgacaaggatatattttgtatctcgggaataaatatgacccgaagccatgtaatcaaacaacacatgttcaataacaatctcggcgcatcgccaccctttttacttttgtttcatctcgacgagttcttactttcgggttgagttgcaacagtttcgatcttcaactagaggtaaacttgtcatggcggcttgcgttctcgggattagtgcttccatcattatgatactctaatcttgttcatgtaagttgtcgagttatcatatattctatataatatttggcaatattgttatttaaccctcaatcggctaacatctgttaatgggaggcggccaattaggttaaataccaacgttgacttagattatatagggtgtctaccactttatgaagtttccaaaagcttgattgtttagatattgttattcttttcatacttatagctgcatcagttgagtttgaccttataagtcgtgattagaatctcaatctttaaactgcttttggtcgccgattagagtagtgtcggggtttcagccgatcttacctgatttagctttatatcttatatgcttgattaacatgccagatctgccctttatgttaagatgctgttgcttttaggtatattaagctttctgtttggtatatttttcttgctttaatatcttaatatagagttgtattggagtattagctgatacatgctgggtctatttgatcggctacactatcaactcttataatcttttcgttttatatatattttgatctaaataatttatactgtctcggcatggcaaccgatctattccaatcacttggtttaaatatatatcgacaaagggattatatactgatgaaatctacagccgatcgagtagatttagttctattttgcttatttataactgccgatcgattcaaatatgacatcggctcaaaggttaacgatatgtcatcggcggctggccgatcgactatcatttatgggtttaactgctattttcctatttaatttcttgttgattgcaggatcaaatcaactgggacactcacgaacctaaaaggtaagttttttggacctgcactgaagttaagcagatcttccaggccactgtgtgttttttgcatcaacgggatcgaacacaagtaaccaagccttccagaggggggtgaatggtagggaaaacctaaaacccaaaaacttttagcggaaataaaagttaccctcaaatcgatggaaatcacgacgtagtcatgtcaccgccggtcacaccgcttctaagccgccggtccgaccgccgtagtttgcctggttagaccatcgcgccgccttcggttagactgccgtactcccaccggtcagaccgccgccttgctgtcgttcaaaccgtctccctgccgccggtgtgaccgcccgccggttagaccgatgactcgcctccggtcaaaccggtgggatccagaaaaacacttatcgacaaaacacttgaaagtatatcaacatttttgcatcaatatgtgtttacaaagttcacctaaagcactcatctctcaattcacgaaataggattaaaaccacgaagtaaaccctaacttttctttcctagaagtcgttatcttctagcctcaaccgctcatctatttatagcaaaaaatcctctattcaaagtacatataaaactcctattcccagtaggactcaatccttcaatttccaaaacctgtaaccgcacgcaccggtcacagaaaatccagcatcaaatcccgaacgcactcggtctcctcgagcaggctgacaccaactcggcctagctcagagttatggatgtactgctaaacagccaaggtcggagcttttttcattaagagttgaaagcaaattggtaatataaatgctattacttaattaaccatttttggatgcaacacatgaaacaaagatgccacaaatgaccttaaaaaaaagaatcctagaacaaaatgggaagatctctgccttgcgcctccaggccgacagcctctgctggtcctgcacacacgcaagcaaaaccagcaagctgctgcatgataactccaagcaagtaacacacacgccaaccaactagctgctcatgtacagccacatgcacacatacatgcttcaccaagcatgtatcaacacacacgccaaccagactagctgcacatgtacagccacatgcacacatacattcttcaccaagcatgtatcgatcacacatacacgtacagcacacgtacatgcatctctgctacagtgcctcatgtactgtagcagccctttttctcctccaatttaatccaatctccttcgcgaacaccgacgcttgcacgcacacctcgtgaagcccgttgcataaatctcccccacacggtgtccatccaccgtgcgccatctcgtatccaactttgtcacccggtatgcttgaccgtatggacctcaactccgccttgagtctagtcccgatccccaccgttgaccgaagttgacctccaagaattctgattctagtcaccttctcaaatggtatcctgaccgcactagacctctgctcctccccaagaatagtcccggtcctcaccattgaccaaggatgacctcaagtcacctgcacacaatcagacaaaacaaccgttcctgggcacatatatcacaacatgacccacattagtcacacgaactcacaccaacatccacacatcttttcaaaccattttatcgaataaattattttgcaaagccaattattcatcacaaatattaatcatgacaatgatttcacaaactacacttagtgggaatgaactatatcagtatataggataagtcacttcgaattttttttctaatcatcttttagtttgatcaaatttatcgaaaaatttgcaataacaacaacattaaattaaagtttcatcaaatctaacatttgaatttatattaataatatgtttattttgtggttgaaatgctactgtgcaaaagctaaaaaaattgccttataatgctagaagttcaattgctctcatctggcggtagattaaagtgttagtatcagttaccactcttaattctgctcttgatatatagttccaataggtctatttagtgtgtgtgcgtaaaatttgaagtttattacaaagttcttttgtcccataatttacacagtgcaaataatctattttctgatgtgttttacatatatacaaattcaattgctgattcgccttttttttaatgttgattcatgtgagagtatcctcgagtgttacgacttgcatcttctatgaaggccaaaaaccttttaagaggtcaatctaggatgaaaattaacaggatgcttaaggtatcttagaatagatcgagtaatatattgtatgcccatgatgtcgaaacaatatttcagcaatactaaaagggtgtgtgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctatactacaccggcggattcaaatccccaaacaggagtagggtattacctctcatcgagagggcctgaacctgtctaaatcctttgtctctgcatccatccacttttaggtctcgtgcgctacctccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttgcgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccgccggcctgcctccgtcgccgccgagtggtgcctccgcctacacggctggcctattcactccgtcgccgccgactggtgtcctcgcctatacggtcggttggtcacaccaccgttgatgggcatcgttatctacaccgccggcctgcctccgtcgccgccgactggtgtccccgcctatacggtcggttggtcacaccaccgttgatgggcatcgtcatctacaccgccggcctgcctccgtcgccgccgactggtgtcctcgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattcactccgtcgccgccgactggtgtcctcgcctacacggctggcctattatgccgccgctgttgggcgtctacgacttcaccgccggcctgcctccgtcgccgccgactggtgtcctcgcctacacggctggcctattatgccgccgctgttgggcgtctacgacttcaccgccggcttgcctccgtcgccgccgagtggtgcctccgcctacacggctggcctattatgccgccgttgttggatgtctacatcctcaccgttggctcaccttcgctgccgtcgactggtgtttccgcttacacggctgacctattatgccgccattagtaggcatcttcgctttcaccgtcgaccgccttcgtcgccgccgactggtgtcttcattgttattgatggacgactttgttcccacattggccacttccgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctacacggctggcctattatgccgccgttgttgggcgcctacgtcttcaccgaccggcttgccttcgtcgccgccgaccgatgtcctcgcctgcacggctggcctttatgccgccgttgttgggcgtctacgtcttcaccgaccggcttgccttcgtcgccgccgaccgatgtcctcgcctgcacggctggcctttatgccgccgttgttgggcgtctacgtcttcaccgatcggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcgtcttccgccgccgactcgtgttatgccgccgccgactagtgcttttatcttcacaactgcgcgtcttcactaccggttcacttcatcacggcaacacaactttgtcatcatggtggagcgacttcatctttattatcttcggaaccagcaaactctattgctgctacttcacaagttttgctacatcaccaaccatgacgttgttgtgaatctcgacatctcgacatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagcaatcaattaatcagccaacaagtcaactctgggagtcatcaattttgtcttcgcttcagagcagtaggtcaagattaaatttacatgtctgggagtttggagtcatcaaccaatcaactcatatcagattcaatgagttgaacaacagcatatactttcctccaagtgaagcatctacaacagtttgatggattattgtcactgacatcatcaccagcacatctgcttcatcagctctgacattccgccgttgctaatggatgactaagactttgccaacttgctattccgccttcacggttgacctactatgcaaacgctgatgagcgtcttcgtcattatcatcggctattacaccgctattgactggatcaccgacatcgtcatcttcatcaacatcctgtcaaacctctttatcatagcttactctactgctattgataggcaacttcgtcatcatgtttgatcatctctgttgatgcttatcatcattgctgtcggttacgtttgtcgtcgccgactaatttcctcatcttcatgattggtggatttcgtcatcgcctttgatctgcctcgtctgtcaccgactgattattttgctgccatagctacacaactttatcgctgagcgccttcatattcattgctggctgatctgactgctgccgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtgttataccttcaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagagataatcactcagatcacatggtctatatcacccgggagcatgttacatgcgtcatcctttaaagggtgtcgaaggcatattttttggcctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctggcttttttatatagtcaaggtgctgtttgggtttatcaagcaattgattggatacaatatcattgctttttgccacgtaagtgtgtatttttattgaccaatattatggcttaggctgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttggaaatttctttattcacagcattcaagcttctttataattgttttgctatgtgaactttcaaagatgttgtcaactttaggttgtacgcatcatattttgccaagcagtcggtatatcacttggatcatattattcggggattcacaccgcatatgctatatattggtatcaagtcacttggttgactataattatcaaaaaccactcggttaattggataatttattccttgactatatgtttagtttgttcagctaatcacatagtcgggggctacacctattaggtgcatctagtcgatgcacctgactttatttttcagccctccacagtcttcatatttggtaaaagtacttcggagaccatggcgaagatgattgaagcactcagctttggagtaatctagttcgagagaagattatcttttcgactgtgaaggtctcaggggctactgtggagattatgggtaccccatacccacatggcatagttatccgactggtataggggataacttatatctatggaatatgtaacagatcatgacttgggt

SEQ ID NO: 20696 - DNA, 1017 bp, Oryza sativa
ccgattggtgtcaccgcctgcacggctggcctattatcccgccgttgttgggcgtatacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtatacgtcttcaccgaccggcttgccttcgccgccgccgactggtgtttccgcttgcacggctggcctttatgccgccgtagttgggcgtctacgtcttcaccgaccggcttgccttcgccgccgccgactggtgtttccgcttgcacggctggcctttatgccgccgtagttgggcgtctacgtcttcaccgaccggcttgccttcgtcgccgccgactggtgtcctcgcctgcacggctggcctattatgccgccgttgttgggcgcctacgtcttcaccgaccggcttgcctttgtcgccgccgaccgatgtcctcgcctgcacggctggcctttatgccgccgttgttgggcgtctacgtcttcaccgatcggcttgccttcgccgccgccgactggtgtttccgcctgcacggctggcctttatgccgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatctggtttatacagctaccactactgatggacatcatcgtcttcccgccgccga

SEQ ID NO: 20697 - DNA, 632 bp, Oryza sativa
ttcaactatgcatcaatgtttgattcatggcaaggcgacaaaatagagatcgtgccagccgacaagtcagtaaatgttgccagtgctgatttagctctttgggagatggatagccttgattgtttatctggaaaagtctgggatagagattttctaaaagtgtccgattctgatatacagccaattgaagatggagaacccaagctattactttaagggcgtcgtggagggttcaagtgtctacactacggacacggtagatgatctcgatgacaagcatggtcaaggtttcatgtcggccgatgatttggaagaagtggacataggtccaggcgatccggcccaggccgacatttattagtaggaacttatctccagagtttagaaccaagctgatagagctcttaaaagagtttagagattgctgagcttgagagtattatgagatgcctggactcagccgatcgattgttgaacatcggctacctatcaaaccaggggttatgccacatcaataacctccgaggagatgcaaggccgacatgcttgaaccggtcaaggctgagattaaaagattatatgatgctggttttattcgtcctcgccgatatgctgagtgggtttctagtata

SEQ ID NO: 20698 - DNA, 598 bp, Oryza sativa
gacaagaggagaaatacatatttataaatattttaaaatacttgattttttctcgagtattatatttatatcagatactactcatcctatatgtttgttctgcaggatccagatccagatatgcataaaagggattcatggctttaagctatctcttacgctccaggaatggatcagtcagaacatcaccaccggctcgcctcgaccgccgccgactggtgtttccgcctacacggctggcctattatgccgccgttgttgggcgcctacgtcttcaccgaccggcttgccttcgtcgccgccgaccgatgtcctcgcctgcacggctggcctttatgccccgttgttgggcgtctacgtcttcaccgaccggcttgccttcgtcgccgccgaccgatgtcctcgcctgcacggctggcctttatgccgccgttgttgggcgtctacgtcttcaccgaccggcttgccttcgtcgccgccgactggtgtccccgcctgcacgggtggcctattatgccgccggttgttgggcgtctacgtcttcaccgaccggcttgccttcgccgccgccgactggtgtttccgcctgcacggctgg

SEQ ID NO: 20699 - DNA, 4818 bp, Oryza sativa
atgtagctttggttgaggacttaaagtataatttgctttcagtttcacaaattgttgatgaaaattttgaggttcactttaagaaaactagaagtaaagtttttgattcttgtggtgattctgtgttgaatatttctcactatggaagagtgtttaaagctgattttgaaaatcctgtttcacctgtgataacatgtttggttactaagtttgataaagatgtgatgttttggcatcacagacttggacattttggttttgatcatctcactaggttaagtggtttggatcttgttcgtggtttgtctaaatttaagaaagatcttgatttggtttgtacgccatgtcgtcatgctaagatggtttctacttcacatgctcctattgtttctgtgatgacggttgcaccggacagctattacatatggacactgttggtccagctagagtgcaatctgttggaggaaagtggtatgtgttggatattgttgacgatttttctcgatattcttgggttttctttatggcaactaaggacgaagcttttcaacactttcgtggtttgtttcttcgattggatcttgaatttcctgattctttgaaaagaattcgaagtgataatggtggtgaatttaaaaatgcttcatttgaacaattttgcaacgaaagaggtcttgaacatgaattttcttctcctcgtgttcctcaacgaaacgttgttgttgaaaagaaaaacgtgttttggttgagatggctagaacgatgttggatgaatataaaactcctagaaaattttgggccgagacgattaacactgcttgttatatttcaaatcgagttttcttgcgatctaaacttcgaaaaacttcttatgaacttcgatttggtcatcaacccaaagtttcacatttgcgtgtttttggttgcaactgctttgtcttgaaaactggaaatttggataagtttgaggcacgctctaccgatggattgtttcttggttaccccgcacatactcgtggctatcgtgtacttattttggggactaacaaaatcgttgagacttgtgaagtttcgtttgatgaggctagtccaagtactagacccgatattgcaggtacactgtcacaagttaagggggaggatgccgtatttttgaagacgagagcgactacgacgacgacgatgaggtcggctcggccggtcagaccgggcgccaggccggtcagaccgccggcacacctccggtcaaaccggcgcaagacgtgcggtcagaccggccagggttgtcggctgagggttccggtactgttgatgctgatcgagatggtccttcggaaactactacttcgaccagtaataatacaaaacgtggatcaacttcagaagtcactgctcctttgcacattcaatgacgacatccgccggaacaaattattggtaatataggtgagcggactataaagtctaaggtaacgactcatgatgtttgtgcaaattctgtatttgttgcttcttttgaacccaaagatgtgtcacatgcattaactgataaatcgtggattaacgccatgcatgaggaacttgaaaattttgagagaaacaaagtttggactttagttgaaccaccttctggacataatattattggaaccaagtgggttttcaaaaataaacaaaatgaggatggtttgattgtgagaaataaagctagacttgttgctcaaggttttactcaaattgagggtttggattttgatgaaacttttgctcctgttgctagaattgagttaattagacttttgttggcttttgctgcttcaaaaggttttaaattgtatcaaatggatgtgaaaagtgcttttctaaatggttttatataggaggaagtttatgtcaaacaaccaccaggttttgaaaatcctgattttcccagccatgtttttaaattgtctaaagctttgtatggtttgaaacaagctcctagggcatggtatgataggcttaagaactttttgcttgcgaaaggttttacgatgggaaaggttgacaaaacgctttttgttcttaagcatggtgataatcaacttttcgttcagatttatgtggatgatatcatctttggttgttcgactcacgccttggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctatagctgtgttggatcctgatgaagatggtgaagctgttgatcaaaaggagtatagaagtatgattggatctttattgtatctaactgcttctaggccagacatacaatttgctgtgtgtttgagtgcgcgctttcaagcttctcctcgtgcttcacatcgtcaagcggtcaaatgaataatgaggtatttgaatcatacacttgagtttggaatttggtattctacttcatcttcgatatgctgtcgcgaccgagaaagttgccttttcccgaacgctagtgtattaatccccgtcccaggaaaagccggggtacaccaaacaaacatgatataaaagacacatctttattatatcgacaatatttacattattacaaaggcgcttcaagcctgacaatcaaaaataaacagcagcggactagcgagcctacggctccatcttcacaggcgctcaactggggtataagccaagactccacctaagacttcttctctaaagcttctcttactgaaggggggagaaagatagagcaagaatgagtacaaccacagtactcagcaagccacaccggcggatgcacgattaatgcaaggggggtacaggggtaatgatataggggttaagttttgcagaaaacaacatttaaaagtcacttagttgccccaagccattttataaagacgatcctagagtcacacagtgttattaatcaaggccgtgaaccctcacgaacctgccttaacccaaggcctacgatgattcagaccgaactggcaacccgaccttgggtcccagctcgtcccaagccaacccaggccaaccattccacattttagttgttgagcaaattttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccagtagacatgtggaagtacagtagtgctttgcaacagaggcccgagcttaatccttatagtaaccgaggtacgactaaccaaacctaaccacgcacctcgagcccagcctaaaaccattttgggggttttgaatagagggggaggtgtgtgtccaattccaacaaaagccaactatttcatagtgtccaagtgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcactttcccaaacgtcggcttcaacttccacgaagagcggatcttccgaagctgcagcgtctacacgaccaacggaaaagaaacggcttttactctaataaactccatataacaagcagaaacaaagcacaaaaatgggttcttgacttcttaaggaaaaattagagacttgaacggtccaattccgagttcaaatggccaagttatggccatttgaggtttatatgcgctttaaatggatatttgcgaatttcttcatttaaattttaatttaaaatcggatttattgcgtcagccgggagagaggagcgcgcggaccgggtccacgggagtggggcccacacggcagcctctcgatccacggtggaccgggagcacgcggcttacgccggccggcgccgtgggtccctcgtgtcagccgcacctaagggcgcgggcggctgacagccgggccccacacggcagccgcggggcgcgcccgaaggcggccacgccggcacagccgacgggaggcggcgcgcccgcgcccttatggtcgccggcggcggccataggcacggcggagcggtggccgagagaggggagggaaagggggaaatgaagcggcggttcacggctcaccccgggtcgacggcgacgacggaaacggcgaccgaagcggagagaggcggcggcgcggctcgggtcgacg

SEQ ID NO: 20700 - DNA, 1825 bp, Oryza sativa
ggcggcggcgctagggcgcagcctgggcggcaggagcggcgggaggatagagatgacaggtgggccccacccgtcagcgagggtggcgggcgggcccgcccgtcagcggcgcgcgcacggggagaggccgagtgggccgcggggagaggagggagaggggagggagatgggccgggccggccagagagagagagggaaggaaaaagagagggagggagagagaactttggccgcgggccgagagagagagagggaggtctttgggccagacttggcccaaagggaggagggggattatttttagctttttctttttataaaatcattttaactttgattatttcttcttaattgttatttgtgctctgaaaattccactaaaatttatttacgcattttaggcttttaggaaatatacaaaaatcctctaggccttatttgacttttaacttagcacattttaattgttggaggctttcacatggattttaattattctaggcataattttgaggatgtattttagagtcgttttgggacgcgacatatgcttaggtggatattcaaatgctgattttgcaggttgtggaattgataggaaaagtactagtggaacatgtcattttcttggtacatcattgattgcatggtcttctaggaaacaatctagtgttgctcaatcaatatgttgctgctgctagttgttgttcacagattctttggcttttatctatgttggcggatggcatgaggcccttcgaccaaatctgccgaaacccatgacgaaggctatggagcaagaacggcgtgaggcgaagagtcgtacgagtgccttgccaggccaaaggagtctcaggtgaagggtgcaaggcaaagactatctgccgaaggaagacgacttcgccttggcaagttcgcccatacgagggccgaagaagcctttccggcccatcaagcctaggggcaatagggccggcgatcaccagacggcccatcaggggcccatgaacccctatatcatcatgtacccctgtaaatgtccctttcataagggtaatcatgtaaattcccctgtataacctaaaccctagaagtaagaacctgtaatggggctataaatagtcccctagggccatgtaatgggaaaaaaggaaagaagggaaactcaaaatttaatacactttgttttcttcctaccactgttgagtaaccacgtctttcgacgtatgcggttgtcatttcgacaacagctggcgccgaccgtggggacctccgagcgaaaccactgaaagcgaatgccaccgaagaaggtcgtgaaggagaaggttgcaaggcggaaggaaagcaacgccggaccggacatggctgtcgcgaccgagaaaattgccttttccccaacgctagtgtattaatccccgtcccaggaaaagccggggtacaccaaacaaacatgatataaaagacacatctttattatatcgataatatttacattattacaaaggcgcttcaagcctgacaatcaaaaataaacagcagcggactagcgggcctacggctccatcttcacaggcgctcaactggggtataagccaggactccacctaggaaatcttctccgaagcttctcttactgaaggggggaaagattgagcaagaatgagtacgaccacagtactcagcaagccacaccggcagatgcatgattaatgcaagggggtacaaggggataataatataggggttaagttttgcagtaaacagcatttaaaagtcacttagttgcccaaagccattttataaagacgatcctggagttacacag

SEQ ID NO: 20701 - DNA, 7424 bp, Oryza sativa
cgggggtctccgcgggaaacggagggcaagccggggaaagagaggccactgcgatgctggaggaggcgacggcgcgaccggatggcgctccggtgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccgtcggccatggaaagcggccggagaaaacgcgggcgttcccggcgattgggggcacgatccaagggggaaattgggggggaattgaagaggaatcaatgggatttaaaaccccccaattaattttggaatctatggtttgatttgcgcggatttggaggaggaacggctctaggttttcccggagagggagaggaggctgagcgggaggaggaagaagatgacggccggcctggcgcgtgggccccacgcgggcgcgcggcgtcagcgcgcgtgcggcgcgcgtgcccacgcggctggctcaggcagggggggcgccgctcgggttgggcccggaggcggcctaggtgggagggggcggaacggcttgggccgagaggcggcccaggaggagaggagggcgagggagcccgggagagagagggaggagggagtgggccgggaggggaggaggcccaagaggaggagggagagaaggagagggagagaaagagagggaggagagggagactttgggctgggcttggcccaaaggaggaagaggattttttttttagctttttctttttaataaactttgataattgtttttgttgcttaataattatttccggtgctctgaaaattcaagtaaaatttgagggctcctttttgaccaaggagaatttaacaaaaattctccgggccacattcgaatttttcttgtgcgtattttagtgtttgcagatttctttccgaattttaattaattctattattccttttagaaaatgatttttatttcgggatgaatttatcaggacgtgacaaatccaccccccttacaagaatctcgtccccgagattcgaggaggctagcaagaagataggttgggcggtcttctcttcttatctgacttcttccgtcgcgtcttctataacaaacttgcctagcaaaacttctccactctgtactgcttgtctcgatctcctgttgcagatggaatcttctcttcacctgacttgtccctggttgaacctttagctgacttcgtctgggttgcggcacttgaagatggggcttcagttccagaacttcgtatagttcatatttttggcgtcaacctcatagaagttacccatttcacgttatgcgtcgagatcagctcgtcattactaggataccatgcttgtcatcatgagaatatcatgcttgtcatttacttctaagttgccacaaactgcctcatattagctttcctggtctccgggtgctagctacttctgttattcgatgcgagggtcgataattttcgcctttcaattatgtttctcaacagagtcaacttatcccacttgacatgctttgacgcctttccagatgacttcactgctggacttgttatggtttgatcgttaccctgccaaatctgaagcttcgctgttacatgtgattttaatctgacctctgtaaactatcttcgaacatatcacttggttcataactgggaatagctcccatgaacaagcaactcggattcactttctttacattcagtttacttcccactattctcttcatgttgtcctcagttagcattcaacgtattcctttacacctttgaccttgatcacctttcgacctttgtcaactaagtacttttcactccgagagttgtggatgcttctggtgacgatgtggtacttgagcctgctgcctttcagagaaaccttcaagtggttcgtcaaaagctagactagcggttgttgcctttgatccaaaaaagacacatctgaaactcttagtccaaacaaatgtctctttggttaatcgcttgattttcttttccatcatcaggttggttattaactcgaggttagaacatagttcctctgaaatgagaccctaggtctcctttgacagtaaacaattatacacataatcccatatcagcatcttccgaaataatcctcatagaacttgtttttattacacatgtctcccttattacatgaatacaaggccttgccttaaacaaaaagggaaggtgcttaacatcggtacattgcatcctcaacatgaatcatccataagcatagcaagctcactgtttatagacatgaatatatttatgtattacatgattgctgcaaactttcgattacacaatgataagtagcgaactgaaaaccacaaacatggctgctcattttgattctggagagatatagctggcattgttctagtgactgcatccttgattggttctgtgatgatgtgataggactgcatattgctatcattcacaggagaagcttccttctgattgctggttgaagcgaataacggtcttctgcttggtatcatcctcctgaggttgattgcccttcgctcggcctggagtaggtcggggagagacacaacttcttccatcgacgacaattctttgctgaggccgtcggtgcagagaatggttggtgctgaaggtattattgctatgatttattgcagagtcaggtgcagcaagaggagcattggtgctgtggatgatatcgtcgatgttgctgttggagctgactaactgacgagacaatcgtagggttgttcgttggatttctgcggtcttggtcaacaacacactgagttggcaatccttgggcacatggtttgtaccttcgcacagaaaacatgtgaccttgcgggtgggacattcacctggtggatggtcttcctcacaatgagggcagagtgtgaaacacatgctagcaacgtgtccaatttctccacaacgggggcatgcttttgattccatctcttcctcgccgagatgtcggagagactcatcttcataatccgaggagacttgatctgacccttcactatcagatactctgccgccatggcttaggaggtgctgggtcaactgtcgtgcacctcggaaggtatttcctctttgacgtctaggaatagttatccctgcgggaggccattcggtgctgctaatagccatcttacatacttctccttcagttcgcatcggcgcttttctcttctgattcttactcttcttgcctttggcttgcttagtacgtgaccccacgtggtacgaaaggctaggaggaaagcatttcccgggattcaatggattctctccattgggctctctactttgcacaataggctgcaagcttgacttggtgcgaggaggctggtttagcgatgtctgccctgttaaaccaaaggaaggggcttctttggcatatacccatggacaattcagggcatagtgtccttgttctctacaatcatgacaaaaggggacatcctcttctggcattggaagctcattgacatgggtggcaaatgctcgatcaaacatatactgattttggtcttgacttccaaccaatggtagctgtgaactaagcagcatgcttggaatggaccaagggtgtgccctggttaactctcttgaggccagtggttgatcgagttgaaaacttgagttacttggggcatacccgctgacattctttcctttttctctgttaaacatctgttacagggattgaggtgagagaggaaacaagctaggaaagaatagaccagaactagagacaggaccttaaaggaactactcttcttgatgatgtgttgtttgtttcacttattctgcaagttgattaagcaaacaacctagcatggttacatcacaacccaccgatgccaaccacgcgctacacacacaagcaaggaacacacgactaacaacactaccctacagggtggcttaggttctgcgacgggttcccaagatcttcactccttcacagctggcttcactgcttcctccacttcgctagcggatcctgcagtcttccggagcttcggcaaacaattggcgacatcttcttcttcgcaaaactaaccatctagtactagtggaaatccgaagagggaagaagggagtaaaccttttgcaaatagcattaggggaaggagaaaaaaggaactttcgcaaatagttttatttataaaatatgtccttaggttttatccacttggcttatcctacagtcgagatggctctgataccagcttgtcgcgaccgagaaaattgccttttcccgaacgctagtgtattaatccccgtcccaggaaaagccggggtacaccaaacaaacatgatataaaagacacatctttattatatcgataatatttacattattacaaaggcgcttcaagcctgacaataaaaaataaacagcagcggactagcgggcctacggctccatcttcacaggcgctcaactggggtataagccaggactccacctaggacatcttctccgaagcttctcttactgaaggggggaaagattgagcaagaatgagtacgaccacagtactcagcaagccacaccggcagatgcatgattaatgcaagggggtacaaggggataataatataggggttaagttttgcagtaaacagcatttaaaagtcacttagttgcccaaagccattttataaagacgatcctagagttacacagtattattaatcaaggccgtgaacccacacgaacctgccttaacccaaggcctacgatgattcagaccgaactggcaacccgaccctgggtcctagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccctgggataggtaggcaggactgagcccccagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccggggtgctacttcccacaactagcatgcacccaaaccccaccgaaaaacaggttttaggggctttgaaagaggaagagaggggtatgtccaattccacaataagccaaccattccatagtatccaagtgatatgagaattccccaagtctaaagttataaaaccacctaatgttgcctaattaaacagcgaagcatctacctaaattcatactagtggaaccatgaatagagtgtccgctagttggggttttgtttattctagggtgaacaaggtaataataacaatagcaataataataaggtcataacaaaggtaaatagacatggctaaataaaacagtgataacacaggaatttaaataaagcgataatgcattaatttaaatcaaaataattttataaactgggattcaatatgctcaaggatgatgtgacttgccttgctcagagagaacggacttccgaaccttcggcgacgaccacgaaccacgcttcgggaacctccagaacgacgaagactacgcgaagcacacaagcaaagctacaagcctataaagaagcaataacaatacataaaaagaaagcacagggttctttaggttataacaaacattaagagacttgaacgggtcgattcggagctcgtatgaccaagacaaggtcatccgaagtttaatgctgtcatatggagatttgtggattattataattaagctttgcaactataaaacatgtgtaagcgctagcctggaaaagacaggaaggctgcgccgttgacatgcggaccccacatgtcaacaaaaaggaccgcggaagaccgagtacacagagacggtccacgggtcgatggaagcggatcctgtgtgtcaaccgaggcgagtggccgacaaacggagtccactagacaccacacgggctgcacacgtggaaaccacgcggctaccgagcgggcacactaacacggtcaccacacgcacaagcgaacgactaccgacaccggtacacgggtaccggggtcgacaactgcacaacgagcacgggcgacaacgaaaggacgaggacggggcagcaagaggggagaccttaccaccacgcgacgaggcgtgggaacgacaacgacgaacgggcgcggcggacagacggcgagggaacgacttcggcggcgatccttggacgaaggtgagacgcggctggcacgaggcttgacgacgcggaggcgaggacgaagacgacgatggggctgcagcggcacacttgatggatgcggacgacggacaagaacggcttgacggagggacgaacgccccaacgagcgaaaccgggaatgacgagaggacgacgacgacgacgaccggagccggcgaggaggcgatgagggcagccggcagcggctgcacggagacgaggacggcgtgttccacgccgctgcaatgccgacgacggaggcggcgccgcgagatgacgagccggcgaggaggaacgatgacgacgacgacgaacaccggcggggttcggtcgaaggggaggcgaggccgagggcggcgtcgcggctgcgatgccgaagatggtggaggtgcggccgaccggtgcacgggtgaggagggacgggcggccgaacaactccggcgaggcggatggagaggttcgcggcgatgtgcggcggcttccgggcgaaaccgaggggtggacgaggtggagggctacgtcaccatgccgagggggttgcattttatagcggagggaagcgagccgagcacgggagaggacggaacggcgacgggaatggcggccgtcagccatggaaagcggccggagaaaacgcgggcgttcccggcgattgggggcacgatccaagggggaaattgggggggaattgaagaggaatcaatgggatttaaaaccccccaattaattttggaatccatggtatgatttgcgcggatttggaggag

SEQ ID NO: 20702 - DNA, 10272 bp, Oryza sativa
tcctgcagcccaacaattattatatgtgctctgaaaattccactaaaattttagggctccttttagaccaaggagaatttaacaaaaattctccgggccacattcgaatttttcttgtgcgtattttagtgtttgccaatttctttccgaattttaattaattctattattccttttagaaaatgatttttatttcgggatgaatttatcaggacgtgacaatggccgccgaggagggagcagagccttcggcgcccgtggccgaagatggaggagcaccattcgcttccacatgtgcgccatcacaaccgccttcggcccccgccacctctctgcaagtgccgaacgcggccgacatggcgaaggcggctgcggtggcaagggcactccagaccagggcgaagatcctttcgacaagccaactggtggtgccccaagccgctccatcgcagccggcagcggccccgactgcgctcgccgctgtgcaggcccaagtcagccctgaccccgaaacacaagccgaagccgacatggaagccatgcgacagaacatgacacggttccaagacatgcttcgccaaatgcaagaacaacaacaagcatacgaggcggcaaggcggaccaaggtcacgtcggctccaatccttcagtattcggcaggttatgtcccaccacaagtccatccgcaagtgacgacccagccctttccgcctcaagtcgcacaagcgccaatgtacttcgccgggcagcaatcggccgcagtcgctgcccaagtacaccatcaaccacccggccaagcgccacaaacagtggcggaaggggcttcggctctgcaggcgcaactccaagctttccttcagcaacttaaccaaccccacggcatttcaactacaaccccatcggcccacccagaggggactacaagtcaaggtgcgcctaattggttgccaccgattcagccgggcctgggagtttcgctgtgcaatcaaggaccgcaattcgacttcgtcaacgctgctcaggcgccaaccgttcggcagcaagctccaactccaggcttcggaacaaaccaagcaccaatccaagctgccatgacgtggtcacaaccaatttttgacccatccatggcggctcagcaagtacctccagttggagccgggcagccgaatgccatggcccaacctcgcgcacaagctgcgatttcgcccttcgccacaccgtacctgcagcagggtgcggtaaacagggcgggaggcgaaaaggggctaccgttgagtgggggaatcaagactcgtccaatcccaccccagttcaagttcccacccgtcccgcgctattcaggcaaaactgacccgaaggagttcctctccatctacgagtcagcgatcgaagcggctcatggtgacgaaaataccaaagcgaaggtaatacatctcgctctagacggcatcgcccattcttggtatttcaatttaccagccaatagcatttactcatgggagcaattgcgcgatgtttttgtccttaactttcgaggcacctacgaggagccgaagacgcaacaacacctactcggcattcgccaaaggcagggggagtcaataagggagtacatgcgtcgcttcttgcaagcccggtgccaagttcaagacataaccgaggcgtcggttataaacgccgcttcggccggtctgctcgagggcgaactcacaagaaaaatcgccaacaaggagcctcagatgctcgagcacctacttcgcatcattgacgggtttgcaaggggcgaggaggattccaagcgacggcaagctatacaagctgagtacgacaaagcctccgtcgccgctgctgaagctcaagcacacgttcaagttgccgaaccacctcccctcttcgttcgctagtctcagccggcgatccaaggacagccgccatggcaaagccaagctcccataacttggagaaagttcagaacagaccgtgcgggcaaagctgtgatggcggtcgaagaagtgcaagccctccgcaaggagttcgatgcccagcaagcgagcaaccatcagcagccagcccgcaagaaggtccgaaaaaacctctactgcgcctttcacggacgttcttcgcacaccacggagcaatgccgaaacattaggcaacgcacaagacccaaggccgcagcagggaacaactgtcgaacaacgccagatatacagcgaagggtaatccaagtgattacaaggctgacccaccaagccagttgtccaaacggcagaagaagatgcagatccgtatggtccacagcatcacttcggtgggtgaaggggcgccgcagtatctgaaccagctaatttcttttgggccggaagacgcagaaggagttatgttcccgcatcaagatcccctggtaatctcagctgagatagctggtttcgaagtccgacgaatcctggtcgacggagggagttcggccgatgttatcttcgccgaagcatatgccaagatggggttgcctacccaagcccttaccccagcaccagcatcgctccgcggtttcggcggagaagcagttcaagttctcggccaagcacttttgctgatagcctttggctcgggggagaacagacgcgaagagcaaatactgtttgacgtcgtcgacatcccatacaactacaacgccatcttcggccatgcaaccctgaacaagttcgaagccatttcccaccacaattatctcaagctcaaaatgcccggcccgacaggggtgatagtagtcaaggggcttcagccttcggccgcttcaaaaggcgatctagctataatcaacagagaagtgcacagtgttgagaccgaaccgcatgaacggctgaagcacacggcaagataacaaaagtgcagattgatgatgccgaccccacaaagctcgtatcactggggagcgacatgggcgaagaagaagttgagagtatcctagaggtgctcaaaaagaacatcgatatcttcgcctggagccctgacgaggtcgggggtgtcgcggcggatctcatcatgcatcacctagcagtcaagccggacattaagccaagaaaacaaaagttgcgcaagatgtctgccgatcgccaagaagcggcgaaagccgaagtacaaaaattgctcagggcgggggttatccaagagattgaccatccggagtggttggcgaatccagtgctggtgcggaagtcaaacggcaaatggcgcatctgtgtcgatttcacagacctgaacaaagcgtgtccgaaagacgacttccccttgccgcgaatcaaccagctcgtggattcaacagctggatgcgagctcatgagtttcctagatgcatattccggttaccaccagatccacatgaacccgctcgacatccccaaaacatccttcatcactccattcggcacatattgtcacctcaggatgccttttggcttaaggaatgcaggagcaactttcgccaggctggtgtacaaggtccttggcaagcagttggggcggaatgtggaagcttacgtcgacgacatcgtcataaaaagccgcaaggctttcgaccatgcgatcgacctgcaggagacattcgacagcttgcgcacagcaggcataaggctgaatccggagaagtgcgttttcggcgtccgtgcaggcaagttgttgggtttccttgtttccgaaagaggcatcgaggcgaatcccgagaaaatcgatgccatccagcaaatgaagcctccgtcaagcgtacatgaagtacaaaagattgcaagccgaattgcggcactcagtcgattcctctcaaaggcagccgaaagaggtttgcccttcttcaagaccctccggggcacaggaaagtttaattggacaccagagttccaagcagcattcgacgagctaaagcaatacttgcaaagcttgccagctctgataagcccacccccaggaagcgaactgctattatacttagcagcttcgccggtagcagtgagtgctgccctcgtccaagaaacaaagttcggacaaaaactggtctacttcgtctccgaagcactgcaaggagcgaagacaaggtacattgaaatggaaaagctcgcttacgccctagtgatggcttcgcgcaagcttaagcactacttccagacccacaaagtcatagtgccatcacagtaccccttgggcggaatactccgaggcaaggaagtcactggccggctcagcaagtgggcggcagagctatccccgttcgacttacattttgttgcacgctttgctatcaagtctcaagtgctagccaacttcgtagctgaatggacaacggtacttgcccccgaccccgagcccgccgaacaattctgggtgatgtgctctgacggctcgtggtcgcacaggggagcaggcattgcggcagtcctatttttgccgaatggtgtgccgattcggtacgcagcaagactgcagttcgacacaaccaacaataaagcagaatacgaagccgttctcctgggcctaagaaaggcgaaagcactgggagttcggcgcctgctaattcgaactgactccaagttggtagcaggccatgttgacaaatcctacgaggcaaaagaagagggaatgaagaggtatctggaggctgttcggtccatggaaaaatgcttcaccggcataacagtcaaacacttgcctagagaccagaacgaggaagcagacgccttggtgaaatccgctgcttgtggtggcccacattcgcctggcatcttttttgaagtcctacatgctccaagtgtgcccatggacagctctgaagttatggcaatcgactaggagaaactgggcgaagacccatatgactggcgaaccccatttgtgaaacaccttgaaactggctggcttccggtagacgaagcagaagtgaagcgtttgcaactcagagccacgaagtataagatagtctcgggtcagctttaccgctccggggtacttcaacccttacttcgtttgccgtttcggagtgccaaaagagttcattactgacaacggcaagcagtttgactctgataagttcaaagaaatgtgcgaagggcttaacctggaaatcaggttcgcgttggtcgcacacccacagtcaaatggggcggccgaacgtacaaatggcaagatcctagaagcactaaagaaaagactcgagggggcagcgaaaggcaaatggccagaggaattgctatcggttctctgggcccttcggacgacccccacaagaccaaccaagtttagcccgtttatgcttctttatggcgatgaggcaatgaccccagcagagttaggggctaactcaccaagggtgatgttctctgggggcgaagagggacgcgaagtatcgctcgaactcttggaaggagtaagagtcgaagcgctcgagcacatgcacaagtacgccacaagcacttcggcaacttacaacaaaaaagtttgacccacggagctgatgcctggtcatctcgtcctaaggaagaaggcgaacccagtagcggttggcaagcttgaatcaaagtgggaaggaccatacctcatcaaacacaagtccaggacagatcttttcgcctagcgacactcgaaggcgaggagttcgaccattcctggaacgccacctctctcaagcgcttcggccctactagccttcaggcgaagagcctccatcttcggctcagtaaggttgtagtagtcaatcagcaccgccgaatgggccttctccttctccagttcggccttgaggcgatcaacctcgcccctggcctctttccccttatccagctcagactgaaggcgtttgacttcagttttcgcctccttgagggtgttggccagggcctccacctccaggttcttgcggcttatttcgtcgtccttggcccgaagacggctcttaaaaccgtcaaaacgggcccatacggttcgctccgtcgaacagtgagccgcaataatctagatgaaagataggagcgggcgaaaagaacaaaagaacaaaaggttaattgtcagacgtaaaaaaaaaagggacgacgaggaaaacgaagaaggaagaaaaggcatacccgaaccgccaggcttttaatggcggaacactcctcgtcgaactcattaagttcggtgaacaagctcggggtgccggcaggcaagataaggttgctcaccccctccacaaagggattaaggtctacccgagtctcgaaatcaccagggacgaagtggggcgccgcaagggaatactccgaggcaaatgcttcggcggccgcacacttccccttcgccttgactagcggcaaaatagctggctcacgcagagggctcccgaaaaccctcgacgtagccgacacgatccgttcggcagagtccttttgttttagagatcttctgcaccggacctcccttcgccgccttgcccgaggagaacgcaactagggccttcgccccttccaaatccttccgtcgaaggagggagctgttcgactccaccccggtcttgttgtgaccgggacttggggtaggagtgtagccggacgcggtcttcgatcgcctcattcgcggccttatcggccacggcctcctcctcttcctcctctccttcctccttgccgtcgcgttcttcggcatcgtcctcgtcgtcggcgtcggagtccgacgaagcaggaacccttcgcttcctcggggcaagcttcacttgtcctcgcattcgctttcgcgaaggccctgcatcattgtcagctttgtgggggtttgcctgaggaggcaattcgccgttgtaaacccggttcgcccgcccagccgcttgtcgtgttagcaactggctatactcgacgaccgacatatcgccgatcatcctacgggcctcgttttcagcctggtcaagggtcaacgctgcaaaagtaaagtgtgtagctatgttaacagtcagacaaggcaagataacaaagcacagcagtgtatagcaagagaaccgtcttactgtccgtcccctcaggaagaaccaggttcggcaaaccgtcaacctcttcgtcttgatcaactgtgacttgccatgactgggagaggggaaagatgcgaagcatacagaattcctccaccaagtcacggcagctaaggcgggagcaaaccttccgcagcagaatgaaccgcgcctccatagcgccgtccacggcgatcttgggtttctggctaggcgcgatcgccctacgccggcaacggagggctttctccgagtcagtgccagcctcgaaggggatggtgtgatagaatcacctagccatccaatggcagtcccacttcgacatggcagcgttcaccggctagagatcggaccgctcgggacaaacgttaaagttcacgctcccgaacactgtctactttgttccagccggggtaatcaccgtcttcgagttcacggtggcgaaaatatggcactgaagagcttggcgttaggctcaaacccggaagtccggcacgcctagtcaaagatagcgatccgaacaagcaccgacgggctcagctatggaagttccacctagaagaggcgaaggatctccggcaacaacacgttgcagggaaaccgtagccctgcctcaaaaaagacggcgaataccaccgtccgattgtcgataggtttcggcaccacggccttccctggggcgaaagcctgcccctcgaccaatgccccagagctgaccagcttcgccagctcgacgtcgtccacaagagagacccccaaaaaggcggtgctgtcgtcatcgactcggctgggatccagccctttcgctgaagcagggtttggcttgcgaggggccatggcgaacggtgcgtttgtggtggcgaagaaagagaatgggcgaaacgcttgaggggtcaagagatgctgtggaagaaagaaacggaggaagagagcgcatgcggtaaaatggcaagtgtggcggtgaaaatgaaaggtcggtgggaatatatagctcgcccgggcgaccgttcgcctacccaccagcaataaagcgccacgtgtcgcaagggtaggtgaaacggtaacttcccaccattcgagcggcacattgaaaagcccacgaagggaaagcccaatactgttcctttcggctcgggaaaagaaaatatataaaaaatgtatataatatatatatatatatgaatatgccaccaaacgcaggaggcgaagcgcggcaaaataataccagccgcacaaataacaaacttcattcgcagaaataatgtaggtttcggcaggagcatcggtcgaaagggggtgccgcataccataccacacagtttgcacggtctcggccgaagctccaatctcacccttgcccgtgaggggcttgttggcggatggcatgaggcccttcgaccaaatctgccgaaacccatggcgaaggctatggagcaagaacggcgtgaggcgaagagtcgtacaagtgccttgccaggccagaggcgtctcaggcgaagggtgcaaggcgaagactatctaccgaaggaagacgacttcgccttggtaagttcgcccccgcgagggccgaagaaacctttctggcccatcaagcctaggggcaatagggccggcaatcgccagacggccaatcaggggcccatgagcccctatatcatcatgtacccctgtaaatgtccctttcataagggtaatcatgtaaattcccctgtataacctaaaccctagtagtaagaacctgtaatggggctataaatagtcccctagggccatgtaatgggaaaaaaggaaagaagggaaactcaaaatttaattcatccttttggcatggtttgagggggagtttatagctcatggttttatcaagcaataatatgacaatgaaaaaaattgagaaaagagagcttcgtttatgcatatggtattttcttgtgcatgccagcaatactttgaaggtttatttgtctctagcatagcttgtatgtgtcacaccctaaaaattcaaaatttataaatttttgtttaattggaatttttagaaatgattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtcttttttggctttgggccgaaagtcggcccaaaaccctctttctctctccccggcccaagtcggcccagtccgcagccgcagccgcccgcgcgagcgcgctgtcgctgacaggtggggcccgcctgtcggagtcgtcgtcaaccttcggccgccgccgcccgaaaccctagcgtcgagccgccgccgtttccttccaaatccggccgctcctttcccgatccgatgaaattgaaagaggggaaacaatctttgggatctcctccacctttttccgtctggaaacttcggctaaatcggtttggaaatcgttgtctcggattcgttcttcccgaagtttccttcgccgtcgccagccgccgtgggcctttgccgccgcctccgagcccctttaaaaggttccccgagctctgtcacgaccggaaataacccaacgggcattccttacgtgcgtgcattaatccttgtcccaggaggcaaggtacaccaaaagttgatacaattcagagtttaacaagcggaagcgtaattagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcggaataaatgcaagggagtacaaaggagttatactataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcggaccgaactggcaacccgaccctgggtcccagctcgtcccaagccaacccaggccaaccattccacattttagttgttaagc

SEQ ID NO: 20703 - DNA, 1930 bp, Oryza sativa
gattaatattgtttattacttaactgttttatcaaattctcaaatgtttgctaaatgctgcttttgcaaatgaaaccctactatgccatactttgttatcctgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagtcgtctgcgccgtttatctttttttccgctgcttagatctttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaccgacttccgtcgatttcgagggtaacttttatttccgctaaaagtttttggtttttgggtataccaaccattcaccccccctctggttggcttagttcttgtgattcgatcctacatggtcagttgtttttattttatttttaggaaagattgtttacagtctgatcaggacttatatcttttactttatctttaggaaagtgttaatagtgaaatttcgcaagatagatttggatttggagttggatatcgaagtggaatcaaaggaaattggatcttgacaaaacggactgcacatcagctggaaacaaagtcactgtttgatcgagccgatatggcaagaagccaatacagcttggcttgggttcagtttgggcctcgatttagataatcgtcattgccgcatagagatagagcttatttaaagcaattgtatctattaattaggatattaatgtcagtttaaattagagatatgttaagagtctgccatgtggacttatttgttattttatctttagaaaagtttgagacgtgttcataatggacaagttttatactcaacgtataaatataacaacaacaatccaatcaatacaactttcggcacatcgcaacttttggcgtgttgccacccttttcttttttacttttcgatgagttcttgcttcaagtcggggcatcggctgcgatctcttgacaagtggtcacttatctcgatagcttgcgctatcaaggctattatgtcgctttagatgcattagtccttttaatgtaaaaatgaaatgaaataaccaaaatccttttatgtaaaatttgagatatgccaccctatatttgcaaaatttgagatatgtcatccgtatctcaataacatgtaggacccacatgagtcaatgacatgtgggtcagggtggcatatcacaaattttgcaaaatttgcatggcatggttcaaattgtcccttaatttaggagtgtatatgtcacgcccggaatttctatccaaaattccaaatgcttacatgtgtgtgaaccctcgtccaggaatcagccgaggcacacaataacaaattgataatagagtacaattattactctaattaataagcgtataaaatgtcattacagaggtagatagttcctctcaatcaataaagatctaagcagtggaaaataagataaacggcgcagacggctccactccacaggcagcttgaccaaggctacacctaatcctccacaccatcagcttcactgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttaataaaacagttaagtaattaaacaatattaatccaacgctatacaacataccctgttgta

SEQ ID NO: 20704 - DNA, 8387 bp, Oryza sativa
tcatcggatgtggcattaaaagcagcaagaaaagacgacttagatgaagaagcatcaacatccaaagaggaagaagaagaaaccaaagcactcgatttagaatcaactttgcgagaaagaacattcatctcatgtgttttcaatttagtataaagtgaatccaaagtcaaagtagacatgttaacagactcctgaatagatgtaactttcatctcccaaatagacatgtcgagaccattcaaaaagtgacgagaaatctcagattgtggataattagcatcgtaagaagaatcaacagatctaagatcactcaaaattttattaaattgagaaagatagtcatccaaagcttctctaggtttcatctcaaatttaatgtactcctttttaaaaagatctcgacgaagctctttaatgttatttgtttcttgatgaaaattactcaaagcaacccaaatctcatgagcagtttgaagattagcaacacaatcataatccgaacgagaaataccactcaaaagaatgttgcgagctttgcaattttgttcaaaagcagttttttcagcagcagtattaatagcttcaggaatcacataagcatgagaaatttttctccaaatatcataatcttaagccataatgtaagattgcatcctactacaccaatgagaaaaatctgttccatcgaaaacatgaggcttaattgaaaacctagcgggagtagccatggcaaaagctctagatcgataaaaatccaaagaagaaaacaaggctctgatatctcttgtaggatcgaatcacaagaactaagccaaccagaggggggtgaatggttggtatacccaaaaaccgaaaacttttagcggaaataaaagttaccctctaaatcgacggaagtcggtctgaccgagattgatctgccggtctgaccgagtagatgctgccggtctgaccggtgttgaacctccgatctgaccgccgaagtcgcctgccgcgcctgtcgccgctgccggtctgaccgcccctatgccgtcggtctgaccgccgcgtgtcgccggtctgaccgctagtgcgccgccggtctgaccaccactcttaaagtggatgacgactttattacttctctctatgttcacaaagtgcaccaacaacactccttacaaaaatttcgacaaaactcgaaaccctaactcaaaactcaattcaattgctctctaaagcgataccgggaagcctcatgcttcccctctatttatacatgaggtaggcagcctaaagccacgaaccaaactcatactaggagtcctaaacaccttaggaaacccactagtacaagaacgaaactttacataaccaatcgtaccaaatttggactccttccaaattcaactccgcatcccatacgcacataataactccatcgtatgccatatggaatctccatcaaccatgtgcatcaactctagccttagtatcccgcatgatctctgaccaccacggacgtcgtcttatcccaagccgactcctggtccatcaccgcaaatactctcccgagacatcgagtcacctacacatggaacaaacaaagaaatcatattccgagaccaagctatcttcaacttgactcattagcagcaaacaatagtattacatacgtatagtatctatctagaagtcataatcatgaaataaactcggatatccaaataaacaacccgaaaccgaaaccgacacagtgtcggccggtcagaccgtgggctggccggtccgaccgctcgatcaccgccgatctgaccggcaaatacagcccggtctgaccggtcacataaaatgacaatcctgcgattcacctgtaattccaatcatctccaaaaccacttcgtgaataaattccaaataacaaaaccaataatctccaatgcccaattgttcatcacagaataataatcaaaagcacctttgattttacagaccctacctaattaacatattaattgcatgtcacatctttcttgaatctggcccactctatataagcttcacttaattgattaatttccttaaccgaatccatcaagaatcaaacggttggcggctgataatttccatcaactaactccaggactctgaagccgatactaactctaggccgatgaagacttgtgggtttatcaaattttgacattaatagtggcatatagtataaagttctctaacagatacactggtggagaaatcgtttgtagtcccggttcgtaacccccctttagtcccggttgtccaaccgggactacgaatccgggactaaagatagcgatctttagtcccgggtgaaataaccgggactaaagatctatgtaccatttttttttatttgcatggccctgtttgctgcatggttgattttatatatatatttatatacatatatatatacatatatatatatatatacatatatatatatatatgcgtatgtatatatgtataaatacatatattacacacatatttataatttaaagcacttaacattttatgtacatatatgttaccagaatatatattaacactaaagtaaatgtacgtatatatataaatatatatatatatatatacatgcatgtatagtacaattcatttgctcgctagctatagctacgacttccacccctggcttaccttcaaaaaaggaaggacccgcgtttccgaaattggtccaatcccgtccgtagtagaattcaccatcgggattaaggacttcttcattgatgaaccccatcagttgttcttgaacagccatgataaaatccttgtgtgggagtttttccctcatgtgaatacgctatcattcgaaaaataatgacatatcaatatatgaaattaataaacaacttaacaaatcgatacgcaatgaaattttgaatggtttatgtatacgtacatcgagctctcgtgtggtgtatatttggtttgataggcagtgggaaaactcgcatatgtagtagccgcataagttagttcccttgtcctgctttgcacactacatgagaaacgatgagagatttaatatactctttatattaactgtaactagagattcaattcaatataattttggatcatgcatgtactcactggaaaatgaaacctccgtccaagtttttatttccaagtcccgcggaccaattgacggaaccgatcccaagccctacatgtgcagttgcaagctatgattaattaaatattacccgagatcaacataatagcaacagagtcccgcgactttggaatagatggcattatattacctgtctatcagttggaagaccttgtcaaaaaccttctcctctttattcattgagtcgtatacagtgactctgcatgcgtccaagtcgaaaaagaacaggacccagtagaatctggaatatgcgtgagatgagataaatattagaatgtacatgtgatatgtatgggaatgaaatttgttcgaacgacaatagaaactcactctgtgttgtacggcaatagtatgaacgtcttgtaatgctgctgcgttaggagatggacgagattgtcctctgtgtctttctcgtacttgtcgagcatttcggtgttgattttccgagggtcgatgaacccagtatcgtaaaccctccgccgtcgggccctttgaatctccattctacaacaatgaaaggaaattattattgcttacatatatgccaggagctaattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctgatcctcgcgccgaacatctctctaccattggcgctcatttctatgtaccgttcatagaatttgtacatttgtgtcggtagggactgcagctgctcagggctgacaaacggtttaccgagttcaaacttgtatgccacttccgccttcgggattggtgcgcgtccaaccaactgagccatggttagaccggtgtccgaaatgaaatccgttatgccaaagtcttcgccagtcaccaacggctcgaccacttggtgtggttgttctccaagctgaggaactggtttggacttcttgtaataggctttcctaagtgttcggtcatagtccgatagctttaaggcctccttgtttgcggtggacattcccttgaagaaattcttcacgctcgggtcaataggtatcttcttttcaggactccgaggcttgagttgcctcttcacttctcctgccacataagcgtcaagctcctcttgactgcaaccgtacggcggctccttgtttttggtggtgtcaactttggccttcttcgttgcccttgtgctggcaggaggtggagcttggcgagaccttgtcttgggaggtgcaggcggacacggaggaggaggaggcggaggaggcggaggagccggaggagatggtgcaggaggagacggcggagccggaggagatggtgcacgagactccgcttgtcgcctagggaggatgatgtaccgcttgcgccatagtataatggcgtggcttgtgtctcgtagatgcgtctcaccgtctcctccttggtagtccaactcgaggtcctcgtacacggcttccaccagctcaacttcgaccctcgagtatactgctggaatcggcctgcagtggtaagtccctgaaatgtccgttgggatggccattcccgacgccaccttcacgtgatgagaggttatctattagtaatcaacctaagcagcaacttgcggaacgtacgagtcaaaaatcatatattacatcgagcataccttgattgataagttcttgaagggaatatgcagctcacatggtgtccaatgagtgatctcatcaacggggcaggtggtttcgtcctgggtttgcatggcgtccatgctatgtgatactacctgccccgttgaggcgcagctgctacgattgcctgatgggctgaccattggaggaggtatgtacggctggggatcgtgtgaccgatctgctgccatgcgttcatccaccttccgggccacctcctcttgcatgctgagctcgtagctcgataccctgtactcaagatctgcaatcttcgcctcggtatctctcttgctcctcatccgactcctatacgtgtggatgtcctccttgaatcccatcttccagggaatcacgcctttccctcgtgttcgtcctggatgctcaggagtctgtagggcgagtgatagctcgtccttctctctgtcgggtcggaacgtgtcctgagaagaggcttccactgcgtccgttagtcgattcacagcctcgcgtatctgatcgctgaagaccaaggagccatcaactgggctgagcgttccaccgtgagcatagtaccagaacttcgatcgatcaggccacttagcggtggccggatcgatacccctctcaagcaagcttgcctccatctcctcccacttcggcatcgcgacgctatagccgcctgaccccaagtggtgatggtacttcttcttggcggcattttctttgtttctttccatcatcgcctgcccttgttgacctgtcttgtaagcaacaaactcgtcccagtgatcccttagcttcgggaatacgtcgaagttccgtgtctgccccttcaggatgtatttccggtacagatctcccttgcaggtctggaactgttctgccattttcttaagagtccactgtttcactatgttctctgtacccgcagggagtgtgaacgtctcgagcattgtggtccacagcatctctttctctgattccgggacgaagctgtcatcacccccgcgtgcccttgttctgcgccagtacaccttgctgacaggcacgttatccctcacaacccaaccactgtggcgtacaaaattcttggctgcttgtgccggggcactaggtcggccgtctgcgtccacctcagttatgatgtgccgaccctctatcttcttcacggcacctcgttgtccgcgtgccctcttctatccagcggagggatgacttccactagcctcctcctcgttcccctccgcatccctctccacgttcccctcctcgttcccctctgcatccctctccgcgttcccctcctcgttcaagtactgatttggatcctcgttcccctcttcttcgttccagtactggctgcttcccgatgcgattgtatcgtacaatatctgttcctcatcgcgatcagccatctgttcatagaagaaatatttgctaagcgtaatattaacactctactaatcatatatgctaagtctaagtgtcgtgtatttgtacggtatataatcatatatgctaagtctaattaagtttcgaatattacatctctaataatcttatattaaatctctaacactcacatatgctaagtctaattaagtttcgtatattaaacctctaataatcttatattaaatctctaactatctctaacactcaaatatgctaagtctaataatctaataatctctaacactcacatatgctaactctaataatctaataatcttatattagaaatctaacaatcttatattatatctctaacaatcacatctttacatcacttgcctgcgcgaattccttcgagggctagctaccacttcggtttgagggacgacgacgacgacgtcttctctgcaacatgcaaaaaaatgtattagtctaaatgcaaaggaacatataatgtatttcacgtttccaagtatatataatcatatatatatatgctaagttcaacaatagtttaattatctcgttcgtacacatttcgctcgcgttcgttctcacacttttagttcaagtgcattcatgttcattaacgtttcaatcacgttcgtttgcgtttcattcacgttcgttcgcgttcattcactaacactcacgttcgttcacgtttcagtcacgttcgttcacgtttcagttacgttcgttcgcgttcgttaagcgttcgttcgcattcgttcatgttcgttcgcgttcgttcgcatttggtcacgttcgttaagcgttcgttcgcggcggtgggggcacggtccggcgccgtgggccggccccgcggcgtgggggcggcggctgcgtggcagcagcggcatcgtctcgcggcagtgggggcgcggtccggcggcgtgggagcctggcggcgtgggggcgcggcggcagcatgggggcccggcggcgtacatcggcgtcggcttcgtcggcgttcgtcggcgaaagagagagaggcagagagctacatcgagatagagagagagagagagggcgggggctctcacccaagagacgcggtggcggcgtctgcggcggaggcggcgaggaccgccaggcgacggtgagagatgacggcggcgtcggcgcgtggttgccctaggcagtggcggcgaaggagaagccgatgctcgatctcgatggaaaaacgtctaagtgttggtggagaagacgagggcgcaccgggaatatatatacccccggatctttactcccggttcttctcaccaaccgggagtaaagatattttcccgctatttccaaattcttttttaaacccggttagggttaagaaccgggactaaagttaatagcactgaatattgaatttcgttgcatatatgtttctaaaatagtaaataatgctttaaaaattctaatcaagatatgtaaatcccacatgcatgatttaaaacttttaaaaattataataatcatatataattagcatatgcatgatattaaattgttaaaaattgtaactaacatatgtaaatcccacatgcatgattcaaaacttttaaaaattctaataatcgtatataattagtatatgcatgatattaaattgttaaaaattgtaattaatcatatataactagcatattcaatacatccaaaatagtttacaacaattacggcaatagatcggcggtgacggttgtccgcacgtactttctcctcactattgttccttccttgtgatcgctacgtaagtaaggggtgtcttcgtttgataggaggatgctagggtcaaccgtcaccgtgaaagggggttgcccattgtcacaccctgaaaattcaaaatatataaattgttgtttaaatggaatttttagaatttattttaaaagcctagaagagaagatctaacttttaattaataaattccaatataaaatggggccagataaaatttcattaaatactttgcttaattctataattcctagatttttctgggatttatttgagctaaggaagtatttttaataaatggaattg

SEQ ID NO: 20705 - DNA, 1978 bp, Oryza sativa
aacacttggctttcctcaacttggtcccacaatagcggtgtccggcatttgcgtccatacaacgcttcatagggtgccatttgtatgctggcttgatagccgttattgtaggagaactcggcataggggagactcttatcccaggtcttcccgaaatctaggacacatgcgtgaagcatatcttctaggatctgatttagacgctcggtctgtccatctgtctgcgggtgatacgcggtgctgaaatttaatcgggtacccagctcttcttggagcttctttcaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggattttggaagtccggtgataaaatccatcccaatttcatcccatttccattcccgtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccctgtttcatattcttgaggagtccatgcatgtccgggtcgttcttctgagcctcacggatttgatcgagcaaggtgggcttggcttccaacgcagccaagaatccacgacccactatgcttagattcagggcttccatctgttggttaagtttgggtggaaagccacggacgttaagagtgttgcaatggctctttcgacttagagcgtcggcgaccacgttggccttaccaggatgatagtgaattcccacatcataatccttgatgagttctaaccatctcctctgccgaagattcagatccgactgggtgaagatgtatttcaaactcttatgatcagtatatatttcacagcgattcacaatgagatagtgtcgccagatttttagagcatgaaccaccgcggctaactccaaatcatgggtagggtagttgccttcatgaggccgtagctggcgtgaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttggaacgccttctcgcattgcgggcaccacacaaatttctcttctttcttcaacaactgtgtcatgggtcgagcgattttggagaagttctcgatgaacctccggtagtatcctgccaaacctaagaaactgtgaatttgagtgactgtcttgggttgcttccaatcagtgacggcggtgactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagaatgtcatcaatgaaaaccacaacaaacttatccaagtattccatgtacactttgttcattaagttcatgaagaaggcaggagcattggttaaaccgaatgacatcaccgtgaattcatacagtccgtatcgcgtggtgaatgcggtcttcggaatatcttcttcacggatgcgcaactggtgatatccggaacgaagatcaatct

SEQ ID NO: 20706 - DNA, 7967 bp, Oryza sativa
tcgcttgtacagaggagtggttcctggagcaagatctatccggaactcaatctctcgcttgggtggcataccgggtagttcttccggaaacacgtctccgaattctctgacgatggggatttctgacagtcctatctgatgaagttctgagctactgacagaggttgggggtgcaaagaaaacaaccggttgttccggccctcggtacagagtgacagtgcgtctcacgcaatccactactccttggaattgagccaaccaattcatcccaaggatcacatccaagttcttggtgtctagaagaatcagatccgagggaaaaaggaatcccctgaatttctatagggacggcaggactataatactttgctgtcataacccctccaggggtggtgatgaggagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtcgttcacccgaccccgaatgacatccttaccactgttgctggagcggggaggcgcttggccttgctggcgccgcggttttgggcatttgtccgcaaagtgccccagctcgaagcagttgaagcacagacgctgcggaccttgaacgtccttgcggccttgaccagactgcgcggctggcgtaggaggacggggcgcacgggtcccttgctggctctgctgttgctgcggctgtgggacgcgcaccacgaattgaggtcagggcgcggagcgtggttgctgctgctgttgttgctgctgcaaggaggatccccctgaatagggattggtgtagcggatcctttggttagctccctgttgattgcggaaattcgccaagcggcgcttgtgcgactccagttccttgtgcttggcttccaagcggatgctcttgtccaccagacgttggaaatccggatagtcaccggagactagacggacggacagctcaggatccattcctgccaagaacttctcctgcttttcctcatcttcccgtacatcctccggggcgtaccgggccaggttgttgaactcatgcaaatactccatcacggagcggttcccttgcttcaactctcggaattcccttttctcaagggccatgactccggcgggcacatgggtccttcggaaagcggcggtgaagcgggcccaagtaataggctgcccctctggctgcgtagcctggaaatggtcccaccatagagatgcgggcccctgcagttggtgggcggcgaagacgactttctcctcatcgctgcactgcacggtgtctagctttttccccacagcatgcaaccaatccaacgcatccacggggttgttggagctagagaaggtaggtggacggatgcggaggaactcggcgagtttagagtgttgtgggggtggtggtggagcattctgttgtggcggattttggatgtggtggaggaaagcagccatcatgttggcctgctgggcaaggatttgggtgagaatggcgttggtgtctggtggtggtggtggaggcggaggaggaggtggaggtgggctgccatggttgttgtggttgctgccctctggttggttgccatcaccgatattagcacttctcctggtcgtcaccatctgaaaaccccacacagaaccagcaaacagagagagctgactattaaaactaaccacccacgactaccataattcttgaatttattactgctattaaattggttcattaaagtttaagttgcttaagcaaataaaataaagacaggctccgacacagttataccacacaccggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttccccctcctgaggaaccacgggcgcgggcttggcacgaggggtctcaacgaagcaagtacacgccagggactgacgaacaagctcgggcctggaggtgctcttgcgggcggtgatcttctggctgcggcagacgcggcggcgcttggggcgacagacctctccctaggcgatcttgagctgatgcagttgcgcctccactgcgtctaggtcctttttcagctgcagattctcttgacgcagctccaggatcttcatgttgttctcgaccatcccacggcgcaccatctgatggaagtcgatacgagccgcgtcgtatggctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtaacgctggtgaagagtgccgatagcgaggagagcggcgttctggcaagcggcggaaaaagaatctccacccgcggtgactgccaacgaagtcctctcgggtgagccggtgaggatcactgcagtaacctcccaagcagcgtggggctctgcatcgtcaccctcctgctctgggagcggcctgccctggtagtccactccatgcggataccccaggacaacgcacatgccccgcagctccaagacgaaaccagtcaggtccagaccacgacggctgatgctgccggccatctacaaacaaaaacaaaaagagaagcaacatttaaatctggaccacgacggctgatgctgccggccatctacaaacaaaaacaaaaagagaagcaacatttaaaagtcagattttggcgataaatgaagcagcaggacagagagagactagaggattttcacaaataagaaaggatttttatttttgaaaatattgctaaggcttgggatctaaggctcgtactagggtcaagggggctctgataccaacttgtcacgaccggaattaacccaacgggcgttccttacgtgcgtgtgttattccttgtcccaggaggcaaggtacaccaagagttgatacatttcagagtttatcaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagagactcctcttctgggtttgggaagaattgagcaagactgagtacaaccaccgtactcaacaagacacacccacaagtgcataataaatgcaagggagtacaagggagttgtaatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatctccctcacgtgtaaccacgtgccacataccaccacggtatacagacggaagacgtgacatagtttccaacccatcctagccatagacaagagtaccgacccaatcccgcctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaatactccaacaactccacagtgtccaggtgatatgaacattcccaaagtctagagttgtaaaaccgcctaatgttacctaattaaaagcgaagcatctacctataatcgtactagtggtaccatgagtagagtgtccactagttggggttttgtttattctagggtgaacaaggtaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacagaaaagaaaaggcttttactctaataaactccatataacaagcagaacaaagcataaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatggatttattgcgtcagccgaggggaggggcgcgcggaccgggtccacgggggtggggcccacgtggcagccccacggcccacggtggaccgggcgcacccgggctcgcaccggccggcgccgtgggtcccacgcgtcagccgcacctaagggcgcgggcggctgacagccgggccccacacggcagccgcggggcgcgcccgaaggcggccacgccggcacagccgacgggaggcggcgcgcccgcgcccctatggtcgccggcggcggccataggcacggcggagcggcggccgagagaggggagggaagggggaaacgaatcggcggtccacggctcaccccggttcgacggcgacgacgggaacggcgaccggagcggaggaaggcggcggcgcggctcgggtggacgaggtcgccggggatgcggtgaagccgaaggtggcgacgccgaggcgggaggtggtccggggcgacgacggcggcggaccggagctcggcggtgacggcggagagagagagcgacggcgcgagctcgattccgacggggagagagggcggcgagtggcggaaacggtggagggaggcacggggagggtttatatagggttaagaaagggagggggtggccggaggagggggaaatgggcgcgggagatccggccgccattgatggcgccggcgaggttaggggagaggtttccaaacgaatccgagggagagagggagggaaaaatggggggaaagatggagggaatcacggggaatatttccccccactttattgcgcgcgtggacggcgggaggcggcgggatttgcggcggcggcggcgctagggcacgggcgaggcggcgggagcggcgggaggaaggggatgacgggtgggccccacccgtcagcgagggtggcgggcgggcccgcccgtcagcggcgcgcgctggggaggccggatgggccgtgggggagaggagagagagggagagagatgggccgagccggcccaagagggggaggggggaaaaggactttttagggtttttctttttataaaatcattttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttaattattctaggcataattttgaggatgtattttagagtcattttgggacgcgacacgtggcatataacactatttaatgacatctaataatctaagcgcctctcttaattacattactaaatactactccagagtgctgcagctgacatagagcaatcatggaaatgattattaaacccacaccattgcatatctctggtaagctagctacataataatatcgagacaagtacaagctaaagtctgcactcgaataattatataaatgaagtaagggaccgaaactatataaataagaatatttaattaatgtgtaaagtcttacaaaagatggaaaatctactagccatacccgaaatctcctagagacttgaagaactgaagaaactattctactcctccactagtgctagaacaacgtaaataaactagagagctcttggaatgatccttcttggtgtactttggaatggagggagtgaagtccttaaatatgctgccaaagacggttatggcagctgaaaatgtcagaaatgccccgcaactgtcattggggaatgatcaggagtgtccatgtggaaggccaggatgagaggccgcagtcagggttcggcggaacctgggctggccactgccctctagcctgctgcttcctcctgggcctcctctgatgactccttagcacagtgatatagttgttgggcccttttgcagatgtttaatatagtttataggcccatccagccacaagtctgccacttgacggacgccgattgattgttcggttattttccatctattctcctccatttatgtgaagatctatgtattcaaaattcctagtacaagtggagatagattatttctaataaaatgtgcattgcaagtatctcctttattctggataaattgacggtcgaaattggtctataacatctgtcaacacctatacatgccccttatggtctatttataggctcaggactggatcacgtaaccttaggatttctatgctcaagggaatttacatgactacccatgtgatagggacatatacatgggtaaggaataagttcaccgaaggtccctcaacataacagtgaaattttttaaggtcccttaaccccaaaaccagaaatggatgcacctaaactcacacaaaccgtgcataaaaggtccgaaggtagtatatatgggtggtttcgctgacgtggcatcctagtcagcaaaaaaaattaaaaaatttacatgggcccacatgtcagctgcacatattttttcttctcttttcttctcctctcttctcttttctctcttctcttcttcagggcaatggcgggtggagagacgatgggcatgcgcagatgcaggcggtgggcgagcgctgtggcggagcatggcgacagagcagcgaagcggtggcaggctgcggcggagtagacggcgggcgagcgccgcggcagaacgcagcggcagagcagcgaagcggcgccgggctgcgggcagagccgacagcgggcgaggcggtggaggaggcggcgctgggcaggggtgcctggggtggcagagtcgagggcggagtcgtcagagtcgatgtgggagaagagggcgtgggagatggcgatgtccgatgtggacgtggaagaggagggagagcgggaggacgaaggcggcggcaatgcgggcgaagagcggcaagtgggcgcacatgatggacgctgcatcccggtagatccccaccacgcccaggaactagagcactgtcacaccctgaaaattcaaaatatataaattgttgtttaaatggaatttttagaatttattttaaaagcctagaagggaagatctaatttttaataataaattccaatataaaatggggccagccaaaatttcatt

SEQ ID NO: 20707 - DNA, 4357 bp, Oryza sativa
cgcgggggagaggagagagagggagggagctgggccgagccggcccaagaagggaagggggggaaagaagacttttagggatttttctttttataaaacgattttaactttgtttatttcttctcaattattatttgtgctctgaaaattccactaaaatttatttacgcattttaggcttttaggaaatatacaaaaatcctccaagccttatttgacttttagctttgcacattttaattgttggaggctttcacatggattttacttattctatgcacaatttcgaggatgtattttagagtcgatttgggacgcgacaaacctacccccccttaaacggaatctcgaccccgagattcggaagaactggcgaagagatcaggatgggctgccttcagctcgtcttcacgctcccaagtagcttcttcttcggcgtggttgctccactggaccttgcaaaaacggattacccggttcctggtcctgcgctccatggtgtccaggatcttcactggcctctccacgtaggtcaagtcttcgcgaacttcaatttgctctgagtcggcctgctcggatggcactcgaaggcatttcttgagttgcgacacatggaacacatcatgcacgttgcccaaggaggcgggcagctccaattggtaagcgacttctccgcgtcgagcaacgatacggaaaggacccacataccgaggtgcgagcttcccttttgtccgaaacctgtgtacacctcgcaatggcgtgacccgaagatatacaaaatcgtccactgcgaattccagatcacggcgacggttatctgcataacttttctgccgggactgtgccacctttagattatcccgaatggttctgactttagcttcagcttctctcaggatatcagtcccgaacacttggctttccccaacttgatcccacattagcggtgtccggcatttgcgcccatacaacgcttcataaggtgccatttgtatgctggcttgatagctgttgttgtaggagaactcggcataggggagactcttatcccaggtcttcccgaaatctagaacacatgcgcggagcatatcttctaggatctgatttagacgctcggtctgcccatctgtctgcgggtgatacgcggtgctaaagtttaatcgggtacccagctcttcttggagcttcttccaaaagtgagaggtgaattggcttcccctatcagatacgattttcttaggaacgccatggagacttacgatcctagcgaagtagagttcggctagtttgttccctccataggtggtcttcacaggaatgaatcgagctaccttggttaatcgatccacaactacccatatagaatcatatccaccttgggtttttggaagtccggtgatgaaatccatcccaatttcatcccatttccattcaggtacttggagaggttggagaagtccggccggtcgttggtgctctgccttgacacactggcacacatcacaaagggccacgaactctgcaatttcccgcttcatactaatccaccagtatttctccttcaagtctaagtacatcttcgtgctgccagggtggatggaataaggactttcgtgagcttcctgaagtatcagctgtttaagttctctgttaactggaacgcatactcgatttccgttccatagggttccgtgttcatcctctgtgaaaccagcggctttaccctgtttcatattcttgaggagtccatgcatgtctggatcattcttctgagcctcgcggatttgatcgagcaaggtgggcttggcttccagcgcagccaagaatccgcgactaactatgcttaggttcagggcttccatctgttgattaagttcgggtggaacgccacggacgttaagagtgttgcaatggctttttcgacttagagcgtcggcaaccacgttggccttaccaggatgatagtgaattcccacatcataatccttgatgagttctaaccatctcctttgccgaagattcaggtccgactgagtgaagatgtatttcaaactcttatgatcagtatatatttcacagcgattcccaatgagatagtgccgccagatttttagagcatgaaccaccgcggctaactccaaatcatgggtagggtaattgccttcatgaggccgtagctggcgtgaggcataggccaccacatgaccgtcctgcataagcacgcaccccaatccttggcgcgaagcgtcacaatacaccatgaaatccttgcgagtatccggcaagattaacactggcgaggaaaccagcttttctttgagagttttgaacgtcttctcgcattgcgggctccacacaaatttctcttctttcttcaacaactgtgtcatgggtcgagcgattttggagaagttctcgatgaatctccggtagtatcctgccaaacctaagaaactgcggacttgagtgactgtcttgggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtatatcaggatgtcatcaataaaaaccaccacaaacttatccaagtattccatgaacactttgttcattaagttcatgaagaaggcaggtgcattggttaaaccgaatgacttcaccgtgaattcatacagtctgtatcgcgtggtgaatgcggtcttcggaatatcttcttcacgaatgcgcaattggtgatatccggaacgaagatcaatcttggagaatacagtggcacctttaagctgatcgaacagatcatcgattcggggaagaggatacttgtttttgatggtgacttcattgagagctctgtagtcaacgcacatccttttcgtcttgtctttcttctccacaaaaatcacaggagcaccccagggggaagtactcggacggatataccccttttctttcagctcttccaactgttccttgacttcggccagttcatttgctgccatacggtagggtcgcttgtacagaggagcggttcctggagcaagatctatccggaactcaacctctcgcttaggcggcataccaggtagttcttccggaaacacgtctccgaactctctgacgatgggaatttctgacagtcctatctgatgaagttctgaacttctgactgaggttgggggtgcaaagaaaacaaccggttgttccggccctcggtacagagtgacagtgcgtctcgcgcaatccactactccttggaattgagccaaccaattcatctcaaggatcacatccaagttcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacatggttcacacgaccccgaatgacgtccttaccaccgttgttggggcggggaggcgcttggccttgctgatgccttggcttcgggcatttatccgcaaagtgcccgggctcgaagcagttgaagcacagacgctgcggaccttgagcgtccctgcggccttgaccaggctgcacagtcggtggaggaggacggggcgcacgagtcccttgttgattcgtctgctgctgcggctgtgggacgcgcaccacgaattgaggtcgaggcgcggagcgaggttgctgctgctgctgttgctgctgcgaggaggatccccctggatagggattggtgtagcggaccctttggttagcaccctgttggttgcggaaattcgccaagcggcgcttgtgcgactccagttccttgtgcttggcttccaagcggatgctcttgtccaccagacgttggaaatccggataatccccggagactagacggacggacagctcagggtccattcctgccaggaacttctcttgcttctcctcatcttcccacacatcctccggagcgtaacgggccaggttgttgaactcgtgcaaatactccatcacggagcggttgccttgcttcaactctcggaattcccttttcttaagggccacgactccgg

SEQ ID NO: 20708 - DNA, 6340 bp, Oryza sativa
aatggtcccaccatagagatgcgggtccctgtagctggtgggccggcgaagatgactttctcctcatcgctgcactgcacagtgtctactttttccccacggcatgcaaccaatccaacgcatccacggggttgttggagctagagaaggtaggtgggcggatgcggagaaactcggcgagtttagagtgttggggaggtggtggtggagcattaagttgtggcggattttggaggtggtggaggaaagcagtcatcatgttggcctgctgggcgaggatttgggtgagaatggcgttggtgtctggtggtggtggtggaggcggaggaggaggtatttgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatgattaagtcaactctctggaattttctcagattttttcggagctcaattcctaatttttaatcatacaaagagcatttcagtaattacccacatattaaattaatcattaaatggtctaattataattttgttaagtactttgagtgtccaagtatgttcaagatttttcttggaattatttgagcattggaagtatttttaacaattcaaagatcatttcattgattaatttaattggaaaagtaataataatcctcttcctagtcttgggccctttccggcccatcccccctcttttgtgtgcacagccgtgcagccctagtcggcccagccgagtttcccccttctctttctttctttgctttgttttcagccagcccaagacgaaaagtctaatttgcctccctcaacactgtttatcttctacctctagcagccgaactgagaccgatttggctcggtttttctcctccaaatctgatctttccccttgtgtttttctaaaattagttgaggggaaatattcctcttatcctcctctatctttacccccaaaaatcggagcaagttgagtatcttatccgaatcgaactcgttttcgagtttatctccaaaaccgagtttttgatttttccggatcgatttcttgtgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgccgccgcctccgtcgtcgccgccggtcgctgtcaccgccgtaaggtgcgccgaggtgtggagaagcccggccgcctgacccccgaagccgcaggtcaccggagccccgtcaccgccgtcgaccgaagccgcgccgccaacagacctcgtcgccggccgtcgtcgttcgtcgttttgttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttctttttcctgtttttctaatagattaaatcttcgaaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacatctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgagtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcaatcaaacctcagttgaagataaaggatccagaaggagaagacgtttggcttataccccagttgagctgcctgtgggagtggagctgaagccatcgctagaccgttaattccgccgctgttttcttttctttgtaagtatgtaacgttattattaagatggatttgtatattaaaattgtcagtttgtgtacctcggctgattcctggacgaggattttatgcacaaataagttcggaaattactagtgaatttccgggcgtgacagtggaggtgggttgccctgatggttgtggttgctgccttcaggttggttgccatcaccggtggcagcatttctcctggtcgtcaccatctgaaaaccccacacagaaccaacaaacagagagagctgacaattaaagctaaccacccacgactaccataattcttaaatttattactgctattaaattggttcattaaggttcaagttgcttaggcgaataaataaagacaggctccgacacagttacaccacacaccagcataactgtgccctacacaacccaacaagaagacaaacgagaaagaacacacgcgcaagcctactaactgctcgtctactgctgcgacgggccaggacggaaggtgagcaacagcgcatcctccgtgctaccaacgccggaggcttccccctcctggggaaccacgggcgcaggctcggcacgaggggcctccacgaagcaagtccacgccagggactgacgaacaagctcgggcctggaggtgctcttgcgggcagtgatcttcagactgcggcagacacggcggcgcttggggcggcagatctctccctgggcgatcttgagctgatgcagctgcgcctccactgcgtccaggtccttcttgagctgcaggttctcttgacgcagctccaggatcttcaggttgttctcgaccatcccacggcgcaccatctgatggaagtcgatacgagccgcgtcgtacgcctccaccatacgcgccaagtgcacgatggtagcgtcatcctccgagctagcatcccggaaggtggcgtggtcgcgggctcctccgcgacgagggtggtagcggtagggcgagtgctgcaactcgtccgggtagcgctggtgaagagtgccgatggcgaggagagcggcgctctggcaagcggcggggaaggagtctccaccagcggtgactgtcagcgaagtccgctcgggagagccagcgaggatcactgcagtgacctcccaagcagcgtggggctccgcatcgtcaccctcctgctccggaagcggcctggcctggtagtccactccgtgtggataccccagggccacgcacatgccccgcagctccaagaagaaaccagtcatgtccaaaccacgacgggtgacgctgccggccatctacaaacaaaaacaaaaagaaaagcaacattttaaaggtcagattttggcgataaatgaagcagcaagacagagagagactagaggattttcacaaatacaaaggatttttatttcgaaaatattgctaaggcttgggatctacggctcgtcctagggtcaagggggctctgataccaacttgtcacgaccggaaataacccaacgggcattccttacgtgcgtgcattaatccttgtcccaggaggcaaggtacaccaaaagttgatacaattcagagtttaacaagcggaagcgtaattagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcggaataaatgcaagggagtacaaaggagttatactataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcggaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttactcacaagacacatctccctcacgtgtaaccacgtgccacataccaccacggtatacagacggaagacgtgacatagtttccaacccatcctagccatagacaagagtaccgacccaatcccgcctatggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatttttggggattttgaatagagggggcggtgtgaatccaattccacaatactccaacaactccacagtgtccaggtgatatgaacattcccaaagtctagagttgtaaaaccgcctaatgttacctaattaaaagcgaagcatctacctataatcgtactagtggtaccatgagtagagtgcccactagttggggttttgtttattctagggtgaacaaggtaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgcttgctttcccaaacaccggcttcaacttccacgaagagcggatcttccgaagctgcagcgtctacacgaccaacggaaaagaaaaggcttttactctactaaactccatataaccagcagaaacaaagcacaaaaatgggttcttgacttcttaaggaaaaattagagacttgaacggtccaattccgagttcaaatggccaagttatggccatttgaagtttatatgctctt

SEQ ID NO: 20709 - DNA, 694 bp, Oryza sativa
cgcgtgggacccacggcgccggccggtgcgagccagggtgcgcccggtccaccgtgggccgtggggctgccgcgtgggccccacccccgtggaaccagtccgcgcgcccctcccctcggctgacgcaataaatccattttaaattaaaatttaaataaagaaattcgcaaatattcatttaaagattaaatcggattaaaacacttaaattgattttaattgaattatgacgcaataatgaattatttttgaaaaggaaaaggaggattattgcgtcagcgggctagggttttggtggaccgggcgcacgggcgacggctcacgcgaacggacggccgagatcgacttgatccaaaacggacggccgagatcgaacggtccacgaccggctcacagcgaacggccccgatgacgtcggcgatgacgtcaccactggcggcggcggctcggcggctcgggtttgcacgctcgccggcgaacgacggcacggcggcgcgaacggaaggcaccaacgggtagagcgcgacgcggcgaactcaccggtgaccaaaagagcggcggaagatcaacggacggcgacggcaacgaggaggaagcggcggcaaacttcgggtcgacggcggcgacggtgctccggcggtcttcggcggcggcgaaagagcggacgagaacggcggcgacttggcgatcacga

SEQ ID NO: 20710 - DNA, 7327 bp, Oryza sativa
  unsure (1)..(7327): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacgcatgcatgcatgaagttggtacgtatagtacgtagctagctctttcaaattgttgtggaacgaatccatccttccgagttgaattaggtttcgacctgcgcgcgtcgagagaaattaaaatttaagagaatatcaaataagatatagttcaaattgttgtgtatcgatcgatcggtatatcaaataagagattatagttcgttagctagtacgtacgtcgcggatcggaccgcgttgctcgatcactatatatatctgtcgatcattttgctcctacgtcgtactcaaaccaaggcaaaatctagctctccatccatctctctttctgcttgcattgcgtcctctctctctctctctctcgctgcttgcgatttcattcctttcctgcttcaggcagctgcaattaatatcgtcgacaccaggatataaagctccatgtacgtatatccaacaaacatctcagtaaagctgcacgcatgcgcgttcggatcttacattttctgtacgttttttatcttcagggcaaatgctgatggcatttcctttggagcgggtaggggcagtcaaagcacgaggcagcacaatgctagtaattctcattcctaactatatatattatgttgcttagtttctgaattctccgggcaatttattttgtttttcagtccgaagtgctacaggtgggcagtttactatgccttcaggtatgacacggtccgatcaaagccagatggcccggttgcccaattctcaacgtcatgggcacaacgagatgacagaacgtaagaaacatatcaataaacatactccatcggtatgtaaatatttaacgctgttgatttttttaagcatgtttaaccgttcgtcttattcaaaatcttttgtgaaatatgtaatatatatatatatatacacaaaagtatatttaacaatgaataaatgatagaaaaacaattcgtaattacttaatttttttaataagatgaatagtcaaatattttttaaaaagtcaacggcgtgaaatatttagagagagatatagtatttattaacctatctatttcattttagttactcaatattcctaccttgcataaccggtttattttattaattcttcagtggaaaatgtagctcgagcctcggcgagtactgtacatggtactggccccgaatcacacagccgtcaaaacaaccaggaggtgccgccggcgtcatcaggcagggactacgacaccggtttaactattttatacacttgatgactatgttttgtgtgcaagctagtcatatcgtttgtatatatcattgactaactcgtttctctttttttcccttgtctatccagatttcaacgatcgaccatttaataagaaatctaaaaagaagagtacgtctcattgcattttttaagccaagtacgtcattatcttcaaacacagtatgttatcacatagatagttgatgcatgcaagtttacggatcgatctacacacatgtgtgctgacgaaacatttaattttctttctcattgacattacgcaggtgatttgtgactagtgagaggatgcaacaagtaaacctttaatcgacgacctctctgcatatatacaagctttgtgagcataatggccggaagttaattatttggctgtcagcaaacccccccccctcccccccaaaaaaaacacatacacatacacacaaaacatacacacaaaacgtagaggacatatccggtgaaaatgagctaagtgttgaaaactcgtgaaaatcatacctaaaagtttcgtaaatttatgaaaaaaatactagagataggtgtagatataaaatacattctcaccaaatcttaactccaaactcaagttcgttatcagaaacaaaaaagacaaatttcaggtgatttcaggtgaatagtgtcctgttactattcacctaaaatttgtcttttttgttactcctaaacgaagttgagtttgaacttgagatttggtgagaatgtatttcatatctatacctatctctagtatttttttcatgaatttacaaaacttttaggtatgattttcacgagttttcaacgcttagctcattttcaccggatatttccctgcttactttctacttgtgttgtccggccattttatattatctgttctgtcagggttaagtgtagtagatacaacagatgggtaaaatgagctactttctccgttccacgatataagattttctaacattacccacattcatatatattgatttattaatatctatatgaatatgggcaatgttagaaatattgatttattaacatctatatgaatatgggtaatgttaaaatgtggacaatgctaaaatgaaataggtgccggttctaaacatggagccgagcatcccctcgtctactctactcattgagaacaagcacatccgcatcacattcatcaagaacaagaatgaacaagaacattcatcacagcaagcacatccacatccaacattcatccacaacacaagatttggactcaaatttatgcaataaaaaaaagaagggattcacacctcgtcgtgccacctcccgtcggcgagcccgccgcctccctccggccagcccggcgctgcgtctcctctgtgaacccgccgtggcaccgcctgccgccacctagtcccggcgagcccgccgcctcccctcccgccagatctggcggaagggaggcgtcgcccgccgctgccgcctcccgccgccgcaactgcagcctccctcctaccgccgcaactgtagcctctcctcccacccttgccgagcacctaccgggccgatgccgtcgccgccgcccttcctcccgccggatctggcggagggaggcgcctccgggccgccgccgctccttccgccgcgcaccgccgaagccgccgacgccgcccctccagccgccgtgagcgagaattataggggagagagagcggagagaacgggagtgctggctcctcgacactatctcctcgatcttatctcgatgctagtggtggggcccgccgtctcagctcatcccggctcggctcaattagctggtgccgcatctataacaagtcataggtgccggtttttaatattaaaggtgtcggtttttaatattaaaggtgccggtttttttaaaaaaaccaacccaaatgtaataggtaccggtttttatttagaaccgacacctataattactaaaaggtgtccgtttttacgatttcagcccgcactattggaacctatagtggcgacacatatttgatattttgtagtagtgcttctataatccaaaaataagtccaccatctgcctggcacactatggggtataggtatggcatacaggtcagcccccgtttgatttttggttcctataggtatgtccgttacgcgtggtgacagtttggccacatgccaatcgtcaccaatttgagaaaataacttttcataaaaatataattgtggcctctcacatgcaatcacatgtcatccccttatatcttcttcttcctcactctccctcctcttctctctcatgccaccgcctcatcatgcaacctgctcgcctgtgcttgttgtggaagaaaaggaacctccacgagtgcgcctggccaccgtcgagctcttcacgcgaccatcctccacgagctagccagctccactcatcactcgtgtcctttatgaactcgatggcagcagcccactcgctagcacaagccaatatatcaagctcctaacctgatgaggaacacgcatgcccacgtgcattgagcaggctagaaagaaacaaacggtccagagcacatatttgttgaatagtatagggagataggatactatgaatattggagatgttgtatctgttgtttttataagcacataatgatttaatttattccataaataaatcataacattgcagatgtaaactagcatcaacacatcattagatttacatatgtaaactaatcagtaaaatatgaacaaatcaaatatgcgcaacatgttgaacacgtaccgagggttccggatgaccgctgccatgccatgcgaggcaaggcgagcacgtgtgtgttccccctcttctctccacctcacatgcttaaagtggtaaggagggcatcctcccttttaaggaggtcccctgtctagaatgagtaaggaggttctaaactcaccatgcatgccatcccatgaggtgggcttttgtgattttctaaagaattaatcttcgagtgggctaaggcccatctattaattccaacagtattgagcctccgaagccagtatatatagaagtacatatggagtagataaggaaggattacaaatatggaagaaatctactacagatgaatcatatcctaatatgactctaccatacactctaacaatattcacatcaaacagttcgaatggctagaaaataggctcaaagcggcgaccatgcatgtcttcttagactaccgctgccatggaaggagggtagcgggatctagctacaacgaggacgtaaggagatcaagcggagagagatgggatacaaatggttgtgtgcagtgctaaagagggaaggatgccgacggagacgacgagctctgcgcttagctcaccggtggccctctcctccacgtggctatccgatcgggtcctacccccaacagggacggtagcgaggcagccaagcgagtaggcccattatttatttataattttagagctgattgtatatcacatggaacggaaatcactttggagtgaatcaggggtataatttgtccagttaaaaaagtttgggggtatgaaatatcttgtattagactttaggggtataaatcgaactacgcaaaggttagggaggtaatttggatttttttttccccaccacaattccatgagccctgctgcaaaagaaaaaaaataaagtgggacctgccataatatttgttgatttcgttcttgcttgccagtgataagtgatcccccaactccaccatctccagagatgccattgtcgtcctagtcgaccaccgtagtctttagcacccaaagaagggatccatcgcgttatgccacccatgcaatagttgatgccccccgtatgcccagtagcctgctagtggattgggtgggaatgggtttattggattggatttcctcttggattgtgtttggatggtttgtaatgggctgaggaaatgtgggttggtgtggtttggatttggtcgccgtttttctggactagaaatggtttcaatccatgggtttctattggatggcagaatgggcacaacccaaaatggttgccgtgcatcgtcaatccccaattcctcttctcctcgacagccaagtcaacacgacaaatcgctcgatgcaccgccgctgtgcttgccaatgctttcctcgctgccgtggctcgccggcgagacgcgcaatctggggcaagcacatgtggtggcgaggtgagggcgatggagcgtgcgcggggggcgtggaaggaggtggagctcctggacgagcggcgtgactagcggtcactgctgcaccgacggtccagccaccgcagctaccttttgctccgcctcttccgcgccggcaggcagccgttgccatcggtgacgatggcgccatggagttttgcttggaggtaattgtggcaccatggattagcctatgccgcgcgaggaagacgattggttcgtcaaggtcagcatccttgttgatggtcaatggattgaaatgggtttgagtggtttggaaaggtggattgaatccatatgaggggaatggattggcttggtttggactgaggtagaaaatgggttggaatattggtttgggttctaaaagttgatttgtggactggattggtttgggctactttaactggttgtcatggtttggactgggaatggtgcgggttttgatccattggcaggctttattgctcacatcccatcaccatcgatgagttgctgccatttcgccaacctcctattcaagcttccccgcgtcactctcctccatctaggagttgattcttggatgctccgacacaattgattttttggatcagttttctagttttcaaggatctagtagcgagaaaatatcttggattggcttcttaattagcaacatgatttagaatattcaaggatgtgttcgagagaaggggaaagaagaaaattgagaagatatgcataacgagataaaccattaatgcatgatctattacatattaattattttaaacataaaaatgattaatataatttttaaaacaatattttttttattttttctaaaaaaacacattgttagtagtttggtaagtctgagcgcaggacaccagctatttctcgtatcgttcaaataatctgctttgggtgtgtttagttcacactaaaattggaagtttggttgaaattaaaacgatgtgatgtaaaagttggattgttatgtgtgtagaaaagttttgatatgatcgaaaagttgaaagcttgaaaaaaaattttgaaactaaagtcagctttattagtactctgctgataatctgaatctgcagcttaaggtgacctatgtgcttgctcttgcccgccgccaacaggagctactcctactcgacgtgtgcatccttctcctgcgcctcaacaacagtattgattgagggtgtttttgattcatggtcatgtatggataggatatagccatctatattttattgaatatggtgatttaattttctgtttggtttgtatggatatggcgatccaatttcttgtttggttcgagggatatagcatagatgagaaaagccaaaagttagtaggacccatttgtcatatatatatatatttatcaaaatataatcatccgagatcttgttttaaagatttaattacaaatataatggtgtaatcaaatcataaattagataaatggtttagaagaaaaaatcatttggagcttgcttaagaggacaaccacagccaatcggaataggacacttcacccagtccaaaactggatggcttcatccagccaaatcggccggatgcactcatccagcatagtaagggaatactctctattatgtaccgtctcatccaccctgacctccaaccaaacaccacagaaactcgagcggtcatctcccatccagactc

SEQ ID NO: 20711 - DNA, 19623 bp, Oryza sativa
actttgtctttgtcctacgtggcagtgacatggactggaagtaaaatgtaaatttttaaaaaatgtgggtcccacatgtctgtcatacaaaacataaaattagtggggcccacatatcagtcaaacaaaacacaaaaaaggtgaggcccacatgtcagtgggtcccacatgagcaggtggaggagatgccatggggagacacccctgatttccagctgcatgtagccgaggaatgttagaaggggtcggagagacttctacaggttgtcgagcacaatctcggcggtagacttgatcggggatgtttccggcgggaagaacaggtcgtggatcttcacaaggacgaagaagggtatatggttctccaggaggtagaacacgtcacggatgtgctcgatgttgtcctgcgcgcacatctcgccgccggaggagctgcttcctcccccgaatctgccgataccaaagcaatggaggatgtagaacccatcgaccaacaacagtttcgacggcgtcaggtcgtcgaacttattggcgccgtctgcgtagtatctcctcacttcggcaaggaagttggcggcggcgatctcacccaggtagcggtgcagcgtggaccgctgctcctgctcgtcgccggggagggcgccgtggagcgccgcaagcttcacgggttccatccgctggtcgggattgcggtggtaggggccgacgaggatcgagtcttgggtgtactgggaactgtcgacgttgcgaatgcctctcttcaccattgagatgtggtactctgaagaagggacgattcccttaaccttcaaatcaaattgcgcatgctctcgtacaaaccctcaaccaatgccttcatgtcgatgattgtttgcggattggggtttcctgcaaatcaaattaaaagagcccgttgctaccattttagaccagagaggcagagactatctaatgatatttacttatatactatttacatcgtcagatttttttctttttcacaataatattattgaacgtctacaaattatatggtaaactattatatatacaacaaattaacgcttggacacactgagagataagagttagcacgggcattttaaaattgaacaagtgaatgttattttcaaccctcccaccccctccccccctcccccgggcttaaccatagaagtcaaaagttcatcatgtacaaacgtagacgctcatagcgcgtcatgttaattatagccacaagtcatgctttttgttccttgcgtaatttctgtgcatatgttttcaggcatatcattaacatctgatataaccacaacgtcattcattttatcataagaccacatataaaaaaatataaattccttttggaatactatactttgttggattatcacagtacatatttttaggatgtgtcactattttagtaaaactagatatgtatcctgcgctattgcacagaccctgctatttttctaaatgttaaattgttttttggtaactaaaatttattagtaattacatatttatatccgatacgattttttatatataaggcaatcatacgtcatttaataaatccatcgaggcttgcttgcaggggaagaattggagttcttgtttgcatgcatcaagtttaatatatactactaaaattgagatcttagataatacaaactaattattatttgaaatttgttttttcaatgttttccttagcgactagcgcatgtctcatggctgatagtggtacctaattggttgttcataacattaatatcaattccaataattttaactagatatggagctcctcggcccttttcaaataaagatgatactaataataatatatagatatacaaagttcaaaaaaggtttagtcatcacaaattagttgtcaagggattccattgttgtcatgtgttggtggctcgttgtgatctttgctggactcatgtagtattgtggttggttgactagaaacctaatgcaacttgaccctagtcatcgtcttctacaaccctactctccttgtgacggcttaatacaagcttgcacgatacctgtatgttttttttttctcataacacacttgtaagacttcttttccctcagtatgatggtctagctataacatgggaaaacacatacaaattaagccatataaattatccgacaggaaatttcatacaagttaagtgtttgttattctacctttttaaagaatatatagtgttattatctcaaatttattaacggctttaagaaatttagtaggagggttatatagcaacgtttaatgtgtttaaaaattaataatttataactattgcaaataaagttatatagggtgatataatcattgttgtcaatcatcatatatataacttcgtatacctacataactaagccgtgccggggaaaattgaaccaaagtgatagtcgaaaaagttactatgccattataaaattgtaataagcaaaaatatcaaaacaactttcaagtgttcttacttttatttattatgaatatttttttaatatataacttcaatcctctcttaggtccaatctgttcggtcatatcgggctcggtgattgctatacaattatacaatatattttattaattgatttgtactttttatgatcgattgttttgatggcatgcacatagctagaatataactcgagtaacacatttttacaacttaaaacatagttaatatggatattaaattattaatttttttatctcatctaaccaagaaggaaaaagaacaaaaaagatggtacgtacataaacacgtacgtgcacatccacataagggagatgggaccatttctccgtgtggtttttaagataaatctaattagaaaatcttaaaacggatctaagtggtagctacaaaataggagaagttagctactgatcccttcatccaaaagtacatatttctttttatcaccaagatatgtaattaactcatccatcatgtgataaaaccaacgaactatacacatgcatgcaaccaagaatagatactgatatgacttcttaggtttcggtcaaaaatttaatttagcatgtagagattataaatagttcttagactttctaaaaacaaaaaaaatatatttcttaatctttcggatggaggaagtagaaaatagggaaggggagagttggagggtggccggagggtgggggcagtaagtacttgcacaaccagaaattttttttccgataaagatctattggttaaaattaatgggtccaccaatttaagaaaaaatcaatggttatatatttatcatacctttttctaatttactagaacatcatgtggtggcttattaggagcgtttgtagaagaccatgacggtttgaaagcgtttatgcatgggaagtttaatggacttttagtatataataaatagatagatgtgagataataattataaggccacccaagaccatacgctagtcatacgcatgccaacactgcaaaaataaattaacctaccatccatggtgttaacaaataaatagctttaatatatagcgcgtaggaatgaaaacaaacgatcgatatgcgataaatataagagaactagatataatcatactatatgtttatgtaatttcaagacatgtaacgtccaagactccaagcgcttggctgatgacaaacaaaggaagttcgagttcgcttgtacgaataatggcaaattagcaaaaccattgacataatattaagagatgaccaaagatgatggagaactttccgaaaattgaacaaatttaacgaaaacatttggcagcaaattttgttaataactacgtaactgatatatatatcatggacgtggaacactacattcataaataagagataatataattaatgacgagatgtatgcacgatctacacgtaagtaccttcctccatgagtgacctctagccagctagtttctggagctctagcacttgcttccttgtactccgatctgatttgcctctgcgcatgtaataccgtgcatgcgttctcgctctatatatagagtgtcagcagcttccatctcttgcaaccaaactagctactcttaatttccttctcatttcattcccgacaagctcggagaaacaataaactagcgcatgtgtgtcatccactatccaaagcatttgcctttccgtatggaagacgaattaaaatgcaaattttatgcaaaagcaaaataattgaagttgctttacctctttccatttgtaattgaaattaattaatgattaaagcaataccgttaaagtaggtcaattacgtaccacaccattcgctactactacggttttatgttttaacaggtacattttctgtgtgtactacttccttcgtgctctcacttattctgaacatgcatttttccttcatttggtagtctggaaaagctagctagcttcctaattggaaatgtgagcatcaccaacaaaatatttatatcattccctatccaaaaatatgaggatttatatatgttaaaaatttgctccaacatattctctaatctcattccttatcccgggattatcgttctctttttctaaggaagcattttggcttccaatcgtggcacttcacgtgcaggaagagattgcacacgtgatctagcatgagctggcgtgaggaaggagagcaaaatatattttttttccggtgaagattttatcttggcccaccttttaaattattaggaaaccaattttacctaatctcttggagagaggaaaattttaacaccttaaattattattaggattcccataataaagaaattgggaatgaaattttaggatgctgttggtcatgctctaacttgcttggtgagcatatattaaagtttacccatctataaaatcagacaataatgcccctcccggctatcacatactgggtatatgtagatcaaccctattttcctaagtgtgaaaaaaatatcaaaaaataaaaaaaattgcacatctctctctcctctacactagagatgacaaaaaaaataggggggggggcagccacattggcgcactcccctaccacctcaatgtcgacacgctatggtggcaggaggatggcgccagagaggctggtgctgtcctgttggacgacggcgccagcgactctagctccaaaaaagaatcttttgtgtgataagtttttttaggggtctatttgcgaaataagttctttaaaaagaacaaattgtgaaaaatcctgttttcctgcatggtgattttttactatatacagaaaatagcattccccaatacttagtctttaaaatggtttcaataaaacagatggagaattgatatttcttgatgtccaacacgtggagaccttgatccattttttaccccccgtccaatgccgcctctatgttctctctctctcttgcatagtagctaatatactaatggtgatatatattaattagatacttgttgaatcatttactaaatatatctattgcttcaaagaaacgttagtgatttttgtttccaacagtcacgtataagccttttctgtggatgtgtttgcgtttttgcatctgaatcatctagttttcgccgacaaggcacccaaaagcaagagtgtaaaaaataattactaataagtaaaaatccttctgtttgtatgtcaaaattgtaaaagctgcagtgaaatgagcatagctcaattagttgcctaccatgcatggttcaagtcttagacttgatatgaatattcgaatttacgatcaattattcttttagtggtaggtaatgtacccgttaacactaatatgtgtctatcatgactttataaatatcaaggcataccagctcaatcttttgaagatttttactattggggtagggtatacgtgtctacgttgaaaatggtgagcgtgagtgcgttgtgggcgtctgcatttgtattttgtttaaaagaaatacaaaaaccgccattaaaaccatattttactacctaagctattccagctggttttaataaagggtgcacaatatctaatttcatagttctacgctcgatcgggaaatagttgagaaggttaattaaaatgaactttaactacttttagtaattaagttctaacccatgcatgtacaaatgtgtgcatgttcgccgctttttccaaaagctaacggaagtttagatgcaaaatttgtttaattaaggcaaatactttacaatatatttattactttaaatttaatatggcgtgtgcttttaattaagtcatatgaaattgaaagggctagttttggggatactatactacacctttccagtgcactggtgaataaatcaatatttaattcgaccggacaactaggatttatataattgttattttgatgtaccagtgtgtaagattctctcctccgtgtgccatttgttgtgggttggttggtgactgtgcgtgaaaacagtcgagtgtgctacttagacgctgccgtagttactatcgtatcggatatttggacactaattataaatattaaacgtagactattaataaaacttattctataaccctggactaatttgcaagacaaatttattgagcctaattaatctatgattagcctatgtgatgctacagtaaacatgcgctaattataaattaattaggcttaaaaaatttatcacacgaattaactctcatttatgtaattaattttataagtactctatgtttaatactttaaattcatccgatatgatagggactaaaatttagtgcctcgatccaaacaccatcttagctaacactacttacggttcgacgacgtgcatctaaaacagagagtaaattttaaacaacaaatcgataaatgtaagctacgaaaatagtgcatgctgaaagctcttcaccagtgctaataaagatctatctttagtcccgttggtaagataaaaaaaaaactctatccttttgaaccgggactaaagatatctttagtcccggttttattgcaaccgggactattgtgtattttggccgaccgaccaaagatggtttctccaccagtgattgttccatgcggcaaaatatcaatttttgcatctggacaaacgatccgcattcacccaaaatctgaaaatcggatctttgcaatttacatgcgaaaatccgattttcaaaataatgttttcaagacatggggatagacaaagcaggtcattgatgtatataaatacaatgttttattttgtccaatcaaaatataccatgttttgttttaaaaataagaccatgcgaatattcgatgaacatgttggccacttgataaccgtgtcatttgggtctttacaaggtttcatggattgatcattacttcaacctttgctttattcgcgtcttagttaatgggggaacgtatcatgtgaaaaccagggaagctgtgcaaacttgcaaactctcaatcaacaccacataatcaccatctgatggctagggatagaggtgggctaattttgcacttaagcgcccaccattagccatactaatcttgcttttttcaaatcacctcctcccctaatccccagtgcgcacgctgcctgttcgtttctcccgtcccgtccacgagttgcccgtgagtcgctgccaccgtcgtccgcgtgtcgcccgtgagtggctgccgccgtggtacgcgagtcgccgccgagctggccctcaagtcacagccgcacgccagcgagtcggcatggagtcctcgcccacaacgccagcgagacgtttttcaatgtttcacagtttcagtgctgatcagtgcttagaaaaaacagcatgaatgtttcagtgttttagtgattgtaaacaccttgtaaaaaatctggtagaagcaactgagatacaatttttcaatgtttcagtgtttcaatttcacacacaattgctgaatcattaaaatacacaagttcattacataggaggcaccattgctgaatcactaaaaaaatcagcatgaattttcaatgatatgagtcttctggtacaaacaactgagatacaatttttcaataaattttacacacaatgctccacacacaagttcattacacaggaggcacaattgccattgcagagccattttttcaggcattacagccccagacgaggacgcccttttgttcaggcacaattgccattactcagtttctgatccagtactgactgaagccgtggcaggactgcccttgggtgcctgctacacatgtgtgacaatagcaaaccactgaccatgaaccttgaggtactcatcctgccacacatcgagcctgacctgtaggaagttgtcgtgctgcctctcactcctgatggagtcctagtaatcactggcagtgaagccccttctcattttttgctggtgatgcgcaggtgccggtgaagcgttgctgccgatgatgatgcgccacgctgctgcccatggctccaattcatgccctacagaactgggcagaggtgccaccatcgaggacatcctgaactggaccaccaccgtcgaggacatctccctggcggccgccagcaaggccacctccgaccaccactgcatggctggcgcagcccaacgcgggactcatgaggcggcgcggctgggtctgagatggcgtggcggatcatagtcggcgactggatcgcaagtcgtggggagacgatactggcgtaggggctcgggtataaaagtcatgggaggcggatggcgcaaggggtgttttgcaaaatagacagaggggctggcgggcggttatttgcaaatttagcccacctctatccctagccatcggatgctcatcctgtggatgtgatcgagagtttccaaggttgcacaggctccctggtttccacctgatatgctcctagttaatgaactacaaagtagctagattagtttttatttttacccataagcacctgaggatgtttcatatttccacgttcccaaattaatcatcatacgatgaaaaccaaattttcttaaaaagcgatcataatgtaactgcaactatatggacacatatttcatcgaagtacagttaatgtaacacgaaaaaatatgtgcatgttaaggtgtaattgtgcaatgtgtttttaaactatgcatatgcattgtggcaagatgtatgcatattgtacgtgacgtcttaatcaatgcggattaaactattcttgatcttgatgcacagaacattattatgattatgatggtcaatttaggttctaagagagtatttaaatactccctccattctataatatataatataagacacagccacttttttctagatgttccataatataacgcatgcatgtatgtaggcaattaactatgatccttctccattaaattattactttttttaaatcctccactctcatgttctttaattctattatatgtatgcattgcatttattaggatgatcgaaactacaagatgataataaatatttttttggtctttgggttaggggtggttagaacaagtttaatagtatagcctactactaactccaattcatatatagttaatctaatagccaattcatacaatagttgcttactatactattaatatatgaccccacctgtcatacacatattgtttattggagtccgcgctgcagctggctacagatctgtaacccgctactcttctctctcatcttttatcttaataaaatatgtttacagctggctaatagtctgctattgtacctgctcttggaatggagggagtaccttagttaccttttgttcctaataaatgacttggttcaaattgcataacatggtttagaatctttttgggtcgtaatagctgctgctaacttttttgtccataactcgcgtgtccccgggggaaagcatgccgagcagtagcagcctacgttgggtcctatctcgtgatgacgtccagtcggggtcgtcatcagcggtacttcagcagcaaagcatctttcgatctgataattttgtttgccgttatttccaaactttttctttaaactttcaacttttccatcacatcaaaactttgctacacatataaacttagatacgactctcggtcgggcgatccatcgggagagggttaaatcgggcgctgacgtcagcatgacatcagcgcccgatttacgtgcaaacttactttaaactgatttttctcttaaattacttatccaaatcatgatccgattataccattaaattcgttgcaattaaatcttcaaaacaagaccacacatggatatattccgatgaaatttttttacctaattattgaattatttttaaatgttacacgatgttccaccaggtatatcggaattgttgcactaagtagatcgaaaatgttttgctcatttaaatcgggtgttgtttcaccttatataaaaacgatgtttcagcaaatagcgaaagaatgtttcagttcactgcaatatttgatccatacatagtgaaacattgtaagtacactaggtgaaacatttttcggtggaacaaaaaatgaaacgaattcccttaataggggtttccaaaatatatgggttttttgttgcaatagaatgttttagttcactgcaacattagatctatatatagtgaaacatagtgagtacactaggtgaaacatttttatagagaaaaaagaaataaatttccccaatagaagatttctaaaatatgtgagttatttgttgcaatgacgcgttctataatatcaaaatccaccacaacatttgatccgtatatagtgaaacatcacgagtacactagttgaaacatcgtaaaactactggttgaaacatctaaagaaccatatgcagcatttttaaaaaaaatatcaataaaaaagctaaaatattttttttcgaaatataatcatgtgtggtcttgttataaaaatttaattgcaacgaatacaacggcgtgatcggaccgtagattggataattagtttagaagaaaaatcgttttaaagctattttaaatactcagcatgtggttcgaggcgtccgatttttttcggccgctcgggcgcccgacgcgcaatatttccccataaacattcaacttttccgtcacatcgttccaatttcaatcaaacttctaattttggtgttaactaaacacaccccatttatacccttactttcatttacattttcatttacatgttcaatattaattttattctcaacttttacggtttatatttttgccgttgctattttaactgaataaggtgtttgcccttgtttttaccgaagggagtggagaaagagttatatattgcggtaaaaaaaacagagaaagagaaataatgattttctaaaatatggattgacttttttgccctagggagatttagactactgtctgcctgcactccagaagatttttttttacttttttatgttttaattttattaaggggcaattgtgttcttacctttactttcgattgcaattgtaattttatccctcttttttagactttgctattttgcccttgctttttgaaattgaagcttaggtttgcccctgttctgttaagtgaacttaacggaattaatttggttataaaagacaagtttgccctggtagatttgcctactacgaggcagtgaagaatttgcaggacatgatccgattaggatttaataaaaaaggacaacacagtgaatgaattatatcactgtttgatgtgaaaacaatttgctcgtagttttagatccttccatctctgaagaaccagaattattaatacgtaaggagcactggagggagcacctgcgtaggagcagtccctaattaatgagcttaacaagaaaagaaaaccaacaaaatcaaacaattaatgaagtagccgtagccttcggcctcctcttcgaagactaggacgccgatgctgccgacggcacaatgcatggttttgtaggaacagcaggagttgcagccggggcagcagcggctcttgcaggttcgacgggttttcttctcctccgtcccgacgctgacgatgtccgccatgaatttcctcactcaccaccgtgccacacgcggaccagtctgctccgcttgcacaccaacgcgccgctgccgtcgcttgcccgcgcgctcctcatgctgcctggctcctcacgtgcgccgctcagctacaccactaccactccgtcgcccaaccacagccggccgctgtctcgcccgcacatcgccactgtcttgctcgggttaggggttgggtccgattggtgaataggcagacagatctggatggactccatgctattacttgcttttgagggtatacttactggtcctttctacattttctcagaaatttcttatttttttaattcacttaatctgggcccaccaacatggtcatccaaaacaagggcaaactgtagcttcattaaaaaaaaaagataaaatcactaaccctaaaaactgtgggcaaaatcacaattacattctaaaacaagggtaaaaacacaattgtcctattaaaagaccttttcaacaaatatttataaaaactaaaccttttaaccacgccagcagatgttgtcttgccacgcaagcagtggaggcgtgacaagaggctggcgtgacagggcaacactgccgcaccagctatgggtggtgtgatagagttatttggccacgctataaaaggtttagatttgaaaatacatttgggaatagtctactagtaaaattaaaacataaaaaataaaaaaatttcactcgacaacatcctgactcgaacattccttgaccctggcgcgacgacctgtgcttgacgacctctgcttgcgacggtggttgcggtggcaggtggcatcggagggatggccaggcgtcggggagcagcagccgttggcggcgccctgaccagcggcgagctggaggccatggcggtagagagtagcgggcaagggggtgacctgacctagccgcggcgaggaggaggctaagcggcgcagaggagttgaggaggccgtgcgacacggttcggctccaagcaggcggcaagggatgaggtgcgtggaggcggcggctctggtgagacgatgcagcggtcgatatagatggccatctgggccgcccggcacgagacggcccaagcccggccgtgcatcagccgaagaggcttgtcgggccggcacggcccgaccgacgcaccgggcggtgccgtccccgcccacgctcggcatacacggcccaatactactcggaccgtgccaggccggcccgaaggcacgaaggctcatcgtgctttctcacagaaaaagtctaatttaggtccctaaactctgcgggctatatttaaatggcttgaaaataagtctattttttatacctctcgtcttgggccttgccttatacgattatataagtctattttacatccctatatattttttatttgatcggccgtgccaggcctgcccaccgtgccgagggtacagcccaggcacagcccggctgccgggtcaggccagcacaggcacgaccccaatcgagctgtaccgtgcttgggccaggccaaaatcgcgggcttcgggccgggccgtgggcatcgggccatatggccatatatagcggtggcgttgtggtgcatcgaagcaaagggtgagggtgcgacgggtccccgtccagccaccgtagcggggcggctttggcgtgccggccgctccatcgaagcaagcctgtgaggcggcggcgcagcctttcttgttcggcgcgccgcacgacgacgatgaggcgttgtgctgttgtctctctcatggccttgcggcgtcgtcgtccagcgccgaacgaccactgatccgccgacactactacctgagcaggccgctccgtctcagtggttgtcttgctcaagaagtgagtaggagctgctgcttgctttttttttttttttgcttgtgctacttcttgctacgcttgaagcctggttggctgctgttgctgtccttgaatctatcaaaatttcattgatgattggaatctggaaaaattcgaaacgtgcaataacaagggtacgcatgtctttctgcaaaaaattatcaccgttaacatgtccatctaaaataggtaaaaaaacagggtaaaaataaaaaccctaaaaacaagggtaaaattaatattggacatcaaaacaggggcaagaacaaaattgaataatacatcaggttcattcatcaaatccaatgatctatatcatccaatccaacactccacgtaatccagatcacctaacgacttggtcttcctcaccttccctctgatcccgtcgcacactgctcccctcgatccccctcctcagcctaacctctaacccttgtcatagctagtgcagtcaccgcagcgctgtcgacgatcccccatcctccacatatatgtgtagatttaggtttgatttgttagttgtataaatgaactttacttgcgagttagtacaggattggtctttcaaacaagtaatatactgtcacaccctgaaaattcaaaatatataaattgttgtttaaatggaatttttagaatttattttaaaagcctagaagagaagatctaattttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttaaaaagtctcttttggctttgggccgaaagtcggcccaaaaccgctctctctctcctcggcccagtccggcccagtccgccgccgcgcgcgcgcgcgtccgcccgctgacaggtggggcccacctgtcagggtcgtcgtcaacctccggccgccgccgctcgaaaccctagtttcgcgccgccgccgttcccttccaaattcgatcgatcctttccgtttccggccgaattgatagaggggaaacaatctccgggatctcctctaccttttctcttttggaaacatcggctaattcgttttggaaatcgttggaatcgagttcgaatcggattcgtctctctcctccgaaccctaaaccttccttctcgtcgccagccgccgtgggccttcgccgtcgcctccgagcccctttaaaaggttccccggtgtctcctctacccgtcgccaccttcgccttcgcctctcgtcgccggaagagctctagcgccgtgcaacctagcgccgccgtcgtagccgtcgctccagccgtgcgccgccgccgtctcggtcgtcgtcatcgctcgggaaggccaccgtcgtgatcgccaagtcgccgccgttctcgtccgctccttcgccgccgccgaagaccgccggagcaccgtcgccgccgtcgacccgaagtttgccaccgcttcctccttgtcgccgtcgccgtccgttgatcttccgccgctcttttggtcaccggtgagttcgccgcgtcgcgctctacccgttggtgccttccgttcgcgccgccgtgccgtcgttcgccggcgagcatgcaagcccgagccgccgagccgccgccgccggtggtgacgtcatcgccgacgtcatcagggccggtcgtggaccgttcgatctcggccgtccgttttggatcaagtcgatctcggccgtccgttcgcgtgagccgtcgcccgtgcgcccggtccaccgaaaccctagcccgctgacgcaataatcttccttttccttttcaaaaataattcattattgcgtcataattcaattaaaatcaatttaagtgttttaatccgatttaatcttcaaaaattcataactaattcatcttagctccgatttagttggttcaagtctctaattttttctaaaattgagatctacatgttaaaaatatccacatgtactgttcaagcttatttatgtgctgttttggtgattttgcttctttatgtttacattctgtcgtttccggagagtccgttttcgccggagaagagtttgaagagttccaaagcaagcaaggcaagtcacacagatcctaaacaaccctttgagcatgttgatcctatttaaagctattgtttctattcaaatattgcatttattttcgaatgtcattgggtggaattaacctattgggtggaataagttattccttgataccttgggttattataatttgactagttgagctctatatgttggttcaactagatgtattagatataattgcttagccctgcttagaaacattagcacactattgggataacttatgaatcactataatttaatgatggcttaatgatagttcacgatggccaatcgtgatttgttaattaattatttgccaactaaaacctgaaatgatgggttgtgagcacatggttttgatggtcgtgctcatgacaattaaggaccggttcacgagtttcagttgtgaaacattaaccgtgccaaccacaagccagcgtgggcaacggctttatcttttgtatagcatggttcattgcggggcaccagactgagaagtggcggagataagcccacgggggtcgctggggagtccatgccttggttttaaggggggtgatatgatacaggaaggtgcgctgcagtggattgtgttatgcaaggggtattgtcacaacttctttcggaggtaccgtggtggtattgaggcacgtggtgacatgatgtggggttgtgtcttgtgggtacagtggtacacctctgatcagagtaaaactattcgaatagccatgcccgcggttatgggcgggtctaacaatgtctttcgtgattagtctcacccttctcatcataataaaaggtgctttaattggtaataatttgattagctcctagtttggaatggtatattcctggtttggagatagaactatgcagccgggatggttgttcagaatggttgggcctatacaacagggtatgttgtatagcgttggattaatattgtttaattacttaactgttttattaaattctcaaatgtttgctaaatgctgcttttgcaaatgaaaccctactttcatttgtctttagatgccgcgcttcaagcctgagtacttgtttggtgttgagggatttgtccaagagttgcgtacaatgtcctttgtcattggatttgggactgcccctttttatgcccagatttctcatgatcgtcatgaagagaagtgccgagtcaaagtcaccttgaacagtaatagtgaagatatcccctcagtgatgttcgaagctggaggaagaaactacatccatgcatgtcaggaggtggcaaggatcgccataggagagctccgcgatcgctatagtgatcagttggccgacacggagtatcgctatcatcctcgtcaaccccagggaagtgaccgtggcagctaccttgagactgaaggaattgagaatgatgctaccacaaggcatttggttgagatgctgtgggctatggatgaaacccgtgcggagactgtgttagcggctcaagatcgtgaagaccggaatcgtggtaagatttacaagctagaagacaaggtggatcgtttggagaaggagctagctacgttgaagggagaagcaccgccgcagaaggccaggattcgtctcaccgcaaggaagagagctctatttgtcccttgctatcaattggcgccaaaggttcgtgtggtggagaaagaagttgccccaaccctagcagatccttcggtcatcatcataagtgacgatgaaaaagaagaatccaagcgcaaccattccaagattgagtgggtagcaactcaagatgatgaagacgagccgaacgagccttcaatcgacctccgatgctcggaagaactagagtgccatgtctaaccgttgtcttagatcgttgtgttagtttgcttgttttaagtttgcttgtgggtgtctcgcatgtgatttacatcagtggtgggatgtaagtgcatgtgtttgtttgcttttgagtgttaggaagttggtgagtttggtggtgtgagagtcttcagtttgtaataatgaaactcagttaagatcaataaaagttaaagtaattccctgtcctaagtagtttcccccggtttctcttcttgtgccctgtctatgccagatggtgaacacacgcagcaacgggaatggccccagtaacaataacaatggagagaatcccactcttgctcaagttcttttcaacagactcagcttatgaacatgatgatgcaacaacttcagaaccagcaaaaccaaggaaataaccatgcacctccccaaaacaagttagcagaatttcttcgtgtgaggccgcctattttctctagtaccactaatcctgttgaagctggtgattggctgcataccatagagaagaagttggatttgcttcagtgcactgatcaggagaaggtctcatttgcatcacaccagttacatggccctgcctctgaatggtgggatcacttccgcctgaataggactactgctgaacctatcacttggcttgaattcaccgctgctttccggaagacgcatataccatcgggagtggtgtctctcaagaagaaggagttcaggtcgctcacccagggatctcgctctgttacggagtatttgcacgagttcaatcgtctggctcgttatgctccggaagatgtgcgcaatgatgaagagcgtcaggagaagttcttggaaggacttaatgatgagctttcttacccactcatgactggagattatcatgatttccagaagttagtggataaggctattcgtcaggaagacaagtacaatcgcatggagcagaagaaacgccggattgctcaattcaagacacaacaggggaataattagaagccgcgtcttactttaggaccccagtccatgccacagggaggttcttcgtctgttgttcgtccgcagcgtcagttcttcaacaacaatactggcaacaacattcgtaatcaagctccacgtcctgttgcagctccaacacagcaacaacctgccaagagggagcaaggcagcaagcccgtggtgtgtttcaactgtggagacccaggacattatgctgacaagtgcccgaggcctcgacgtgtgaaggttgtccctacccagagcaactctaccgtaccagcatcaaaggctcgtgtcaatcatgtcgctgctgcagaagctcaagatgctccagatgtgatttctggccaatcttatcctgctagaatccaaagaccttgatgtcatcctagggatggactggttagccagacataaaggtgtgatagactgtgctaacagaaaagtaactctcaccagcaatgatggtcgagttgtgactgttcatgcattgtcttctgagtctttaaggtcaagactgaaccaaataactttggaagagattcctatagtccgggagtatcccgatatgttccccgatgatttacctggtatgccgcctaaaagggatatagagttcagaatagatttggtaccagga

SEQ ID NO: 20712 - DNA, 26935 bp, Oryza sativa
acaacatccgtaatcaagctctacgccctgttgcagctccagcacagcaacaacctgccaagagggagcaaggcagcaagcccgtggtgtgtttcaattgtggagacccaggacattatgctgacaagtgtccgaagccccgacgtgtgaaggttgtccctgcccagagcaactctactataccagcatcaaaggcccgtgtcaatcatgttgctgctgcagaagctcaagatgctccagatgtgattttgggtacgtttcttgttaacttagttcctgcaacagtgcttttcgattctggtgctacacattcattcttatctaagagttttgcgggaaatcatgggatggaagtagaagatcttagacgtcctttgatggttagtaccccgagtaatcaagcactctctttgcaacgtagcccctttgtcagaatagaaattcaaggaataccatttctggccaatcttatcctgttagaatccaaagaccttgatgtcatcctagggatggactggttagccagacataaaggtgtgatagactgtgctaacagaaaagtgactctcaccagcaatgatggtcgagttgtaactgttcttgcactgtcatctgagtctttaaggtcaagacagaaccagataactttggaagagattcctatagtccgggagtattccgatgtgttcccagatgatttgcctggtatgccgcctaaaagggatatagagttcagaatagatttggtaccaggaacaactccgatctataagagaccttatagaatggcagccaatgagttggcagaagtcaagaggcaagtagacgatttgcttcaaaaaggatacatcagaccgagttcatctccatggggagctctggttatttttgtggaaaagaaagaccatacccagaggatgtgtgtggactatcgtgcactaaatgatgtgactatcaagaataagtatccgctgcccagaattgatgatttgtttgatcagcttaaaggtgccaccgttttctccaagatagatcttcgatcagggtatcaccagttgagaatcaaagaggaagatatacctaagacagcttttaccactaggtatggattgttcgaatgtactattatgtcttttggacttaccaatgcccccgctttcttcatgaacttgatgaataaggtgtttatggagtacctagacaaattcgtggtggtctttattgatgacattcttatctactcccgaaccaaagaagagcatgaagagcatcttcgccttgcattagagaagctacgagaacatcaactgtatgctaagtttagcaagtgtgaattttggttgtctgaagtgaagttccttggtcacgtcatctcagcaggaggagttgccgtcgatcctagtaatgtggaatccgtaaccaactggaaacaaccaaagacagtttcagagattcgcagtttcctaggccttgcaggatattaccggaggtttatagagaatttttccaagattgctaagcccatgacacgactgcttcagaaagatgtaaagtacaagtggtcagaagaatgtgagcagagttttcaagagttgaaaagtcgcttaatatcagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgaattagctgcagtagttcatgcgttgaagatttggcgtcattatcttttcggtactcgtacagaggtatacaccgatcacaagagtttaaagtatatctttactcagccggatctgaacatgagacaacggagatggttggaattaattaaggattatgacatgggaattcattatcacccgggaaaggctaatgttgtagcagacgctcttagtaggaaaggctattgcaatgctacggaaggacgacagttgccattgtaattatgcaaggaatttgaaaggttgaatttgggaattgtcagtagaggtttccttgcatccttagaagcgaagcccactctaattgatcaagttagagaagcccaaattaatgatcctgatattcaagaaatcaagaagaatatgagaagaggaaaagctatcggtttcttagaggatgagcaaggaactgtatggttgggtgagagaatctgtgtccctgacaacaaagatttaaaagatgcaattctgaaagaagctcatgatactttatactccattcaccctggtagtaccaaaatgtaccaggatctcaaggaaagattttggtgggcaagtatgaagcgtgaaatcgcagaatacgtagcagtatgtgatgtttgtcagcgagtcaaggcagaacatcagaaacctgccggtttgctgcagcctttgaagattcctgaatggaagtgggaagaaatcggtatggattttatcactggtttacccagaacgtcatcaggccatgactctattttggtaatagtcgacagacttaccaaagtggcacatttcattccggtaaagacaacttattccggaagtcgcttagcggaattgtatatggcaaggattgtgtgtttgcatggcgtccctaagaaaatagtgtctgatcgaggcagtcaatttacttcaaatttttggaagaagcttcaggaagagatgggttctaagctgaactttagtactgcttatcatccgcagacagacggacaaaccgaaagggtgaatcaaattttggaagacatgttgagagcttgtgctttagacttcggtggaagttgggataagaatctaccttatgcagaattttcgtacaataacaattatcaagctagtcttcagatggctccttacgaagcactgtatggtcggaagtgtcgcactctgcttttgtgggatcaaacgggagatcgtcaggttttcgggacggatatcctaagggaatcagaagaaaaggtaaaggtcattcaagaaagattgcgagtggctcagtctcgtcataagagttatgccgacaatcgccgcagagatctaagttttgaagaaggagattatgtgtatcttcgtgtcacgcctcttcgaggagttcatcgtttccacaccaaaggaaaattggcaccgcgttttgtgggaccttataagattgtcagtagaagaggagaggttgcttatcagttggagttacctcaatctttggcaggagtccataatgtgttccatgtgtcgcaactgaaaaagtgtttaagggtacctaccgaagaagctaatcttgaacagatagaagtccaagaggatctgacctatgttgagaaaccaatccgtatcttggaaacagatgagagaagaaccagaaatcgagttatccatttttgtaaagtccaatggagtaatcactcggaagaagagtcaacttgggaacgagaagatgaattgaagtcagctcatccgcatctgttcgccagttcttccgaatctcgaggacgagattccgtttaaggggggtaggtttgtcacaccctgaaaattcaaaatatataaattgttgtttaattggaaattttagaaatgattttaaaaagccttgaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaaccctttttctctctccccggcccagtcggcccagtccgccgcagccgcgcgcgccctcgctgtcgctgacaggtgggtcccgcctgtcaggttcgtcttccccgagccgccgtcgcccggccgaaccctagcacgccgccgccgccgttcccttccaaattcggcagctcctttccttctccggccgaatcaaaagaggggaaatgatcctcgagatctcctctaccttttctcctttggaaacttcggctaaatcggtttggaaatcgatggattcgagttcgaatcggatcggcttttctctctccgagctcgagctttccttctcgtcgccggccaccgtgggccttcgtcgccgcctcctagcccctttataagcttccccggtgtctcctctacacgccgccactctcgccttcgcctctcgtcgccggaagagctctagcgccgtgtgccctagcgccgccgtcgccgccgtcgctccagtcgtgcgccgccgccgttccagtcatcgtcgtcgctcgggaagaccgccgtcgtggtcgccaagacgtcgccgtcctcgtccgccgcttcgccaccgtcggagaccgccggagcatcgtcgccgtcgtcaagccgaaaagcgccgccgattcaacctcgtcgccgtcgccgtccgttggtcttccgccgtcgctttggtcgccggtgagttcgccgtgccgtccgctacccgttggtgccctccgttcgtgccgaagcgccgccgttcgccggcgagcgtgcgccgtccgagccgccgagccgccgccgccggtggtgacgtcaccgctgacgtcatcgtcgccctttcccgtgagtcggtcgtggaccgttcgatctcggccgtccgttttggatcaagtcgatctcggccgtccattcgcgtgaaccgccgccgtgcgcccggtccaccgaaaccctagcccgctgacgcaataaatccctttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactattcatgcttgtttatgtgctgttttggtgtttttgctcttttctgtttagattccgtcgtttccggagagtccgttttcgccggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattactttattccttgataccttgggttattataacttgactagttgggctatgtatattgattcaactagatattagatataattgcttagccctgcttagaaacattagctcactattgggataactcatgactcactattacttaatgatggcttaatgatagttcacgatggtcaatcatgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcactgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataattggtaataatttaattagctcctggtttggaatggtacattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgatgctgatggtgtggaggattaggtgtagccttggtcaagctgcctgtggagtggagtcgtctgcgccgtttatcttttctttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagctccttgaccctaggttatgccatatggttacccatagaagccctctaaaaatattggaaaaatagaactgttctcctctccttctcttttaattaaaccaaactaatggcacatgcacttcataatcttttttaagggttctcattcaaaatttattccagtgttattagtactgtacatctattactgtactaatggctcatttaccagcaaaagttttacaatattgttttatttaatcttgctgcaataaaataaattaagcaagttgattttataactttcttttatttcttttgaaacctgatgttcaaaagtacaaaatttgtaaccttgtttccagctgtttcaacttatcttgcaagcttggtttaccgtatttacttacctttttactttgatttctaactttattcaaattaatccaaaaacttgtgctattaattggataaatgtcttaactccctcctttcacttgtctttagatgccgcgctacaagcctgagtacttgtttggtgttgagggttttgtccaggagttgcgtacgatgtcctttgccataggatttgggactgcccctttttatgcccagattcctcatgatcgtcatgaagagaagtgccgagtcaaagtcaccttgaacagtaatagtgaaggtatcccttcagtgatgttcgaagctggaggaagaaactacatccatgcatgtcaggaggtggcaaggatcgccataggagagctccgcgatcgctacagtgatcagttggccgacactgagtatcgctaccatcctcgccaaccccagggaagtgaccgtggcagctaccttgagactgaaggaattgagaatgatgctaccacaaggcatttggttgagatgctgtgggctatggatgaaacccgtgcggagactgtgttagcggctcaagatcgtgaagaccggaatcgtggtaagatttgcaagttagaagacaaggtggatcgtttggagaaggaattagccgcgttgaagggagaagcaccgccgcagaaggccaggattcgtctcaccgcaaggaagagagctctatttgtccctcgctatcaattggcgccaaaagttcgtgtggtggagaaagaagttgccccaaccttggcagatcctccggtcatgatcataagtgatgatgaagaagaagaatccaagcgcaaccattccaagattgagtgggtagcaactcaagatgatgaagacgagccgaatgagccttcaatcgacctccgatgctcggaagaactagagtgacttgttaagtcgttgtcttagatcgttgtgttagtttgcttgctttaagtttggttgtgtgtgtctcgcatgtgatttacatcagtagtgggatgtaagtgcatgtgtttgtttgcttttgagtgttaggaagttggtgagtttagtggtgtgagagtcttcagtttgtaataatgaaactcagttaagatcaataaaagttaaagtaattctctgtcctaagtagttcccccggtctctcttcttgtgccctgtccatgctagatggtgaacactcgcagcaacgggaatggccccaacaaccccaataacaacaacaatgaagggaatcccactcttgctcaagttcttgctcaacagactcagctaatgaacatgatgatgcagcaacttcagaatcagcagaaccaaggaaataaccatgcacctccccagaacaagttagcagaatttcttcgtgtgaggccgcctattttctctagtaccactaatcctgttgaagctggtgattggctgcatgccatagagaagaagttggatttgcttcaatgcactgatcaggaaaaggtctcatttgcatcacaccagttgcatggccctgcctctgaatggtgggatcacttccgccttaacaggactactgttgaacctatcacttggctggaattcaccgctgcttttcggaagacgcatataccatcgggagtggtgtctctcaagaagaaggaattcaggtcgctcacccagggatctcgctctgttacggagtatctgcacgagttcaatcgtctgactcgttatgctccggaagatgtgcgcaatgatgaagagcgctaggagaagttcttggaaggacttaatgatgagctttcttacccactcatgactggagattattctgatttccagaagttggtggataaggctattcgtcaggaggacaagtacaaccgcatggagcagaagaaacgccggattgctcaattcaagacacaacaggggaataatcagaagccgcgtcttactttaggaccccagtccatgccacagggaggttcttcgtctgttgttcgtccgcagcgtcagttcttcaacaacaatgctggcaacaacatccgtaatcaagctccacgtcctgttgcagctccaacacagcaacaacctgccaagagggagcaaggcagcaagcccgtggtgtgtttcaactgtggagacccaagacattatgctgacaactccccgaagccccgacgcgtgaaggttgtccctgcccagagcaactctaccgcacctgcgccaatggcccgtgtcaatcatgttgctgctgcagaagctcaagatgctccagatgtgattttgggtacgttccttgttaactcagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcttgttagaatccaaagaccttgatgtcatcctagggatggactggttagccagacataaaggggatagactatgctaacagaaaagtaactctcaccagcaatgatggtcgagttgtgactgttcatgcattgtcttctgagtctttaagatcaagactgaaccaaataactttggaagagattcctatagtccgggagtatcccgatatgttcccgatgatttacctggtatgccgcctaaaagggatatagagttcagaatagatttggtaccaggaacaactccgatccataagagtccttatagaatggcagccaatgagttggcagaagtcaagaggcaagtagatgatttgcttcagaaaggatacatcagaccaagttcatctccatggggagctccggttatttttgtgaaaaagaaaggccatacccagaggatgtgtgtggactatcgtgccctaaatgatgtgactatcaagaataagtatccgctacccagaattgatgatttgtttgatcagcttaaaggtgccaccgttttctccaagatagatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaagtgtttatggaatacctagacaagttcgtggtggtctttattgatgacattcttatctactcccgaaccagagaagagcatgaagaacatcttcgccttgcactagagaagctacgagaacatcaactatatgctaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgcagtttcttaggcctcgcaggatattaccggaggtttatagagaatttttccaagattgctaagcccatgacacgactgcttcagaaagatgtgaagtacaagtggtcggaagaatgtgagcagagttttcaagagttgaagaatcgcttgatatcagctcctattttgattttacctgatccaaagaagggtttccaagtgtattgcgatgcatccaaacttgggttaggttgtgttctgatgcaagatgggaaggtggttgcctatgcatctcgtcagttacgtccgcatgagaagaactaccctactcatgatcttgaattagctgcagtagttcatgcgttgaaaatttggcgtcattatcttttcggtactcgtacagaggtgtataccgatcacaagagtttaaagtatatctttactcagccggatctgaacatgagacaaaggagatggttggaattaattaaggattatgacatgggaattcattatcacccaggaaagggtaatgttgtagcagacgctcttagcaggaaaggctattgcaatgctacgaaaggacgacaattgcctttggagttatgcaaggaatttgaaagattaaatttgggaattgtcagtagaggtttcgttgcagccttacaagcgaagcccactctaattgatcaagttagagaagcccaaattaatgatcctgatattcaagaaatcaagaagaatatgagaagaggaaaagctatcggtttcttggaagatgagcaaggaactgtatggttgggtgagagaatctgcgtccccgacaacaaagatttaaaagatgcaattctgaaaaaagctcatgatactttatactccattcaccctggtagtaccaaaatgtatcaggatctcaaggaaagattttggtgggcaagtatgaagcgtgaaatcgcagaatacgtagcagtatgtgatgtttgtcagcgagtcaaggcagaacatcagaaacctgccagtttgctgcagcctttgaagattcctgaatggaagtgggaagaaatcggtatggattttatcactggtttacccagaacgtcatcaggccatgattctatttgggtgatagtcgacagacttaccaaagtggctcattttattccggtaaaaacaacctattccggaagtcggttggcggaattgtatatggcaaggattgtgtgtttgcatggcgtccctaagaaaatagtgtctgatcgaggtagtcagtttacttcaaatttttggaagaaacttcaggaagagatgggttctaagctgaactttagtactgcttatcatccgcagacagacggacaaaccgaaagagtgaatcagattttggaagacatgttgagagcttgtgctttagacttcggtggaagttgggataagaatctaccttatgcataattttcgtacaacaacagttatcaagctagtcttcagatggctccttacgaagcactgtatggtcggaagtgccgcactccgcttttgtgggatcaaacgggagaacgtcaggttttcgggacggatatcctgagggaagcagaagaaaaggtaaaggtcattcaagaaagattgcgagtggctcagtctcgacataagagttatgccgacaatcgccgcagagatttgagttttgaagaaggagattatgtgtatcttcgtgtcacgcctcttcgaggagttcatcgttttcgcaccaaaggaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccagaaatcgagttatccgcttttgcaaagtccaatggagtaatcactcggaagaagaatcaacttgggaacgagaagatgaattgaagtcagctcatccgtatctgttcgccagttcttccgaatctcgaggatgagattctgtttaaggtgggtaggtttgtcacaccctgaaaattcaaaatatataaattgttgtttaaatggaatttttagaatttattttaaaagcctagaagagaagatctaattttttaattaataaattcaaatataaaatggggccagataaaatttcattaaatactttgcttaattctataattcctagatttttctgggatttattggagctaaggaagtatttttaataaatggatttgcatttcatgaataatttaaattgaaaaaggttttaaaaagtctcttttggcttcaaaaccgctctctctctcctcggcccagtccagcccagtccgccgccgcgcgcgcgcgcgtccgcccgcttacaggtggggcccacctgtcagggtcgtcgtcaacctccggccgccgccgctcgaaaccctagtttcgcgccgccgccgttcccttccaaattcgatcgatcctttccgtttcctgccgaattgatagaggggaaacaatctccgggatctcctctaccttttctcttttggaaacatcggctaattcgttttggaaatcgttggaatcgagttcgaatcggattcgtctctctcctccgaaccctaaaccttccttctcgtcgccagccgccgtgggccttcgccgtcgcctccgagcccctttaaaaggttccccggtgtctcctctacccatcgccaccttcgccttcgcctctcgtcgccggaagagcactagcgccgtgcaacctagcgccgccgtcgtagccgtcgctccagccgtgcgccgccgccgtctcggtcgtcgtcatcgctcgggaaggccaccgtcgtgatcgccaagtcgccgccgttctcgtccgctccttcgccgccgtcgacccgaagtttgccgccgcttcttcctcgtcgccgtcgccgtccgttgatcttccgccgctcttttggtcaccggtgagttcgccgcgtcgcgctctacccgttggtgccttccgttcgcgccgccgtgccgtcgttcaccggcgagcgtgcaagcccgagccgccgagccgccaccgccggtggtgacgtcatcgccgacgtcatcggggctgttcgctgtgagccggtcgtggaccgttcgatctcggccgtccgttttggatcaagtcgatctcggccgtccgttcgcgtgagccgtcgcccgtgcgcccggtccaccgaaaccctagcccgctgacacaataatcctccttttccttttcaaaaataattcattattgcgtcataattcaattaaaatcaatttaagtgttttaatccgatttaatcttcaaaaattcataactaattcatcttagctccgatttagttggttcaagtctctaattttttctaaaattgagatctacatgttaaaaatatccacatgtactgttcaagcttgtttatgtgctgttttggtgattttccttctttttgtttagattccgtcgtttccggacagtccgttttcgcaggagaagagtttgaagagttccaaggccagcaaggcaagtcacacagatcccaaacaaccctttgagcatgttgatcctatttaaagctattgtttctattcaaatattgcatttattttcgaatgtcattgggtggaattaacctattgtttgttatagcccttttgttcttgattaccttattccttgataccttgggttattataacttgactagttgagctctacatgttggttcaactagatgtattagatataattgcttagccctgcttagaaacattagcacactattgggataacttatgaatcactataatttaatgatggcttaatgatagttcacgatggtcaatcgtgatttgttaattaattatttgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttttaagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcatcataataaaaggtgctttaattggtaataatttgattagctcctggtttggaatggtatattcctggtttggagatagaactgtgcagccgggatggttgttcagaatggttgggcctatacaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagccgtctgcgccgtttatcttattttccgctgcgtagatctttattgattgagaggaactatctacctctgtaatgacattttatacgcttattaattagagtaataattgttctctattatcaatttgttattttgtgcctcggctgattcctggacgagggttcacacacatgtaagcgtttggaattttggatagaaattccgggcgtgacaagcaccaccggctcgcactccattggattcttcgattgaggattggatttgatttggattcctcgtccgctacgctgtctgtagcttattaatttggtaggtagctaacgaaacgagatgagatgagcttgacatcggattcgggattggggaattttggagtagtcgtatgtaagcaattggttggggatgcgaggtctcgaacacgacggcgtcggtcgagtgcgtggtctgcctcagcgccgtcgacgagggggacatgtggctcttgtcccacgcctcgtgccaggtctgccacgggaaggccgcgcgcatatcggtgacgcgcgacgtagttgtgccagcctcctcgccgccgtccgctccgcctgtagcccgacgccgcttcgctgctctgccgccatgctccgccgcggcgctcgcccgccgtcggctccgcccgcagcccgccaccgcttcgttgctctgtcgccacgctccgccgcggcgctcgcccgccgccggcatccgcgcgtgcccatcgtctctcctcctgccgctggcctgaagaagagaagagagaagagagaaaagagaagaaaaaaatgtgcagctgacatgtgggcccatgtaattttttaaatgttttgctgactaggatgccatgtcagcgaaaccactcatatatactgccttgggaccttttatgcacggtttgtgtgtgtttaggggtatacatttctggttttggggttaaaggatcttaaaaaatctcgctgttaagttgagggaccttcggtgaacttattcccatggggaattacaggcaattaggccactcattcttgggccgcctaatgggcttcaccgaagggtctgtccaccctgggtgccaattagttcacatatttcgcgaagatcccttgcttcacccttgatcttgcgcttcgccttcggcttcgcacttcgcccttggcttcgctcgggatattgacgatgtgtttcagcgggctcagtcaaaggccctcgtgtcattcctctaacaatttatgttgtataaaagagtaaaataaatgtgaactataactaacctactaacaaggagtaaatatattgcttctgaattttgaatcatgacaagcatatatgaaaacaaatgcatatatcaaagcatttagcaggcgcacacaacatcatcaaacaacatcaattagcagctaggaacatcatttagtagcagctagcagcagcaccaagcttcagtattagggaatctaaatacatgtgaatccttattctgtcaaagtggttctccaaagaaaaattcgactccaatggtgctgacattgtgaaagattcaaaaggagaggtcatctgctcaaaccaagattccaaatgcatcacatttcaaccgatcgaggcctatgtgggatagagaagacaactgggggctcatccgggacggttgtgggaacggcgctgcatccaatgatcaagtggccaccatgttcatgccacatggggaccattaggaaaagaaaacatggcattcatatatatcaatgacaatgatctgctttgcagtgtcatgcctaaaaagtgtgcattcaaaatttccaatagggaacaatttctgcttttgagactggtacagatttattcccacccttttgatatttaaaatttgttgtcagttttcgtatgtcgaatgtgagtactccagtagagagtgcattgcacattcgtactcgactgtcagggcatgcacagtcgacataccaacccaccagaacgattggaacggagaaatttagtacacatgcaattagaccataggaccctttgtcattattataaacattcaaaaaatgttttcaagtagtgctgacactggtgcgcgaatataaattttgaccagatcacgctgtccattatataataaaatatgagcttatttcccagtgcactgggaaggtgtaatagcctcggaactgggcattttaatcatatcaaagaagaattatttataagcccacatgttagaaaaactaactgccttagttgtgttattagtaactttgtacaggcatacagtatggcacatttcattaggcgaaaatctgtcagggcattctaaatactcaatttatttgtcgttcgagcaaatacacactaaattactaggtatatggctaattacatcgctatatcctcattaatttacatcctagctagaagctgatgtaatatctcaatacggattataaaaatgaagttattacgtagtagcaaaatgaatttgatgctatatgtaattataaagctaattacatatatagtacctttattttttccgtaggacctttgagcaactataacagctagctaaaactcgacaagtatgtgaaagagagagacaaaataaaaaaagagtaaatttcactttggtctagttcttttgatccaagtttcacaaagaatcagggctaacacaaagttttcacttaacaccatatgtttttacatttgattgcactttggaagcaatttgaactggcccatctacacaagcaggcagaactgcagctgctagccatcttcttgcctttgttctgcgctgtcgtcgcctcggccaaagccaagccacagccatcgccaaggctatggaccacaacccagccaccacatcacgtccttgttggaacaatgacctagctaccaccatcaacatctctttgtctggatccaatgtctccacgtccgcgacccattcaagcccgtcgccgatctctttgttctgtgaccggtgacctcaacaatctccaagcacattcttgtcgttcgagatcattgcttctcccacttgccgcaccttctcggatgctctttctccccgcatatgctcagctgttatgcacgtgcagagctcacccacatccttgttgcttggcggtggccagatcagcattgccggtgccgaaaaaaagagggtgttgcctgctaacgtggatgggccacagccaacatcctatcccaaatcaccaacccctagtccaaagtgcaacctagtgcaaaattatatggtgttaagtgaaaacctaatgttaggcctggtctattgtgaaactctggtaaaaagaactggtccaaagcgaaattctcataaaaaaaaacctggtcttcacatgctccaagaaaattgtattacatatatagatgagcaaaatagagaggtaattaaccttataaataaactattgtacatcttatattaggtcaaacataagcttatagctaatagttggttctagtattaaaacttatgctatttatttaagcaatgttgatgttaaaagttttttggaaaaaaatggtactacttttgatgacatgacacaaacaagctggcctgtgtaagctacaacgaacgcgacatgcccggcacacggatctaaataaaatggaattggcgccttattacaatttacagaacccggataaaaattaagtactcccaatgttaactactcttaatggagtgaaaggagagaaaaataaacctaacaaaaggcgggtagttcgatatttaaggtttgccagctccacatgtagatgttatggtcggcgcttgaaggacttgactgcatagattgcctgtataagttcacagacaaatccaaccatggcagccaccagcaccgtcagcacgaacggattgctcaagtagcggtggtagagctgcgctatccacctaatcacgcgggtcttgtacatacgttcgaggcccttcctcgtgtcgagcaggtagttgtggctgcgctcgtcggccgggttgatggtgatgccgacgcagagctcgccgagcatcctggcgacgtcgccgtcgctggccaggaggctcacgatgatccccttcttggcgaggagcgcgacgtcgctcgccgtgccggctagctgcgacaggaagtagcagtaggccgtgacctggctccccaggctcgggttgtgctgctccagcatcatcaggttccggaggaccgtggacgtgttcatgtccaccatgagcggcgggatgctcagccgcagcgtcagcggatggaacttcacgtccagaacggagcgggcgccgccgccgtcgacgaaccagcgccacgcgccgctgctggcgccgtggcggaggtggcgtttcatgaagatcacgccggtggcatggtagaacgtcgctgcgcgccaccggtacaaggtgggggcggctgccgtagctgatctccggccggtgtcgacgacgtcgaccggcagccgaacagcatcgccggtaggaataggatcgtcctgtgggacgaagtgcttgtgcagcatgtgatgcaggtgccagatctcgcggggcacttgggtcctaatggagtatccgaaatgtttgagaagtgcctggacttggacggccaacgtctcatcgagctccctcgccatcacccccggcgtggttctacattcacggagcaccccgtagatggcgcggaggacacagaagggtatctggttatccaggcggtagaacacgtcgcgcaccaattccatgttctgcatcgcgcttccagtaccatgttgctgctgctggctcgtccccgcaccgttggccctgacgggtaagaggtcatggagcacgaacttgccaaggatgtagcatccgtcgaggagcagcatctgcacgaaacccgcagtacgtctcatggcatcgcaaggcacctgctccatgtaataatgctccttcgcaacgctttcgagggcagtgaccgcatccactaatctcctcagcacggcagccttgtgctgctcgtccaccaggatcagaatgccgtagagcatcaccttcttctcctgctccatcaggtggtagaagggattgtggtggttggggccgatgcacaccgcagccggcctctgcggagggcataataacggaatcttacactcgggtcggttgctccctgtcctgcttctctcccagcaggccgtcaagttggtgagcagagtttcaatgcaaatttctgcttggccttctgctgaataatgtttacagtcagtgttgcaagcattcaaaaaactaagggatatctgccgtactagcagacttaggtttgcatgatgacgatgtagcatagctaaaaaaaaaacactgttcatacgcggcaggaagaaattaattagagagtaattaaattgtgtcgccggtatacaaacttatgaagtgactgtattttagtacataaacttttaaattgcttattatgatgtgcaaacttgtctagtatgtagtgcgaaatagttcaaatcgatatatttgtgactaatcatgttgagttagtctgatatataatttcgtgcacaaacgatcaagggcatgacaaatgtcgtgtttgtaaatgggtaacaattatttcttctattattttgtatatattcacctttaatatgtataattaacatgacttttatatatttgattgaacatatgtgtatttaggtaacctcatcttgacatgaaagcctatataacaatcctaatcagtattcaacttagtgaaattagttatgatgtattattttgggtttggattgtacacactagacaggtttatgcatcaaaataagtgatttacttgtttacgtactaaatcgcacccacctcgcaagttcatatgccagcggtgtaattattgaattaattaaaagaccacaaagcaagctgaggaaataaaagtacagatatattgttcacactaaattcagcatcgccaaacaatataacaaaattgtcacttgcaaattgcaatctactgcaaatctgtgacagctatattaggttgttctttctatacgactgaggggggccttgatacatatttaaatgtatataactatataattaaacacgttaatactgtttttaattgaacaactataacttgacattatccgaaaaaatgtactccatccgtcccaaaatataacaaattgtacactttacaatttatcttaaaacgaaacaatttttccatcagcattctcttcctaactaatcacaccttccaacattcaatatccctacctatctccaggtttcaacaaatgtcaaccttcctctattaaatattcctactttcttaataactgtatctaactttaaaaattcttatattctgggattgagatagtagatttcacgttcactatttggttcatattggatcatcaagtgcaatatggaaacaattaaaaaaatcccctgattgattactaaaaattaattggcttttagcgttaataaatgataattgaacccatatcatattaacagaatggttttcctaccgtaccgagtaagaaacaagtctatcctatatatatcctaatccgttggcttagtctgattttttaacttttagctttaccctgaatcaaattttaaaatttaaagtaagtaattaatggctcagaaatgttgcatggacataataaaactttaagcattatgaagaatagaaggaagaaagacccatgaaatacagaaaaaaaatagaggacatttgagaatagattacaacagtgctcttctaaattgaaattatatgcgtcttgtagcatgctatatattggctatatattggacggccggagcgtagatctaggttttggggccggatacgtcagagtttcaggcgactgataatttatacagaacacaacagaatcatgtttatgttcaaaactattctgaaactgttgcacagtaaaatcaatatgaccccagtgaccattaattaattacatagatacaaatgcactgaagaaacaagccgtaataactattctgaaactgttacagtaaaattaaattaattaatatatgcttcccagtcgacatttctcttagcaaattacgttttccggatcccagtgaccattaattacatagatatatatgcactgcagaaacaagccgtaaatgtgacggacgtatacatagattacatcgtacgtacgtgcttaattacttacctgcaagctccatatcggttgtctcctggtggctatccataagctcgtttctctgtatgctatgcgtgtctagcttgcttctgtcttgctcggtagaattctgcaccactcacacacacacacatatatatatatatatatatatatatatatatatatatatatatatatatatatatatatatagtctaagtgacagccaccacgattcaaaaatatcacatcacatgcgaatatgcgatatatcgagcacgctacatatatacaatgtaaagtgtaatcgaaaccagtgaaagtgaagtaattaaagttcgtgcagcaaccactcaataaaggtgtccaaggcacgtactggccggccgtattggggattttcttgacctgcaggcgggcccaatcaaggcagtcgttggatggggtaagtagtcggttacagtttagaacttggagttgtaataggtattaggactagagtatgagtcggactctatcccaggatcgtctctcataaatagaggggcgtgcctattgtaactgcatggcgacttagcatagcgagagggagcggctgccagcggcgaccggccgtgagttgttgtaactctgatacgctgtatatgccggaccggggaggagcgcccgtaatcagtgccccagagatgtaggctacggctgaactccattaccaaatatcgtgtctcggtgtagtcatcgttttggatctcctatggtgttttcttccgcgtttagctaccgatgtcgatttcggggctggttttataacaagtggtatcagagcctgcgggaggtccatggtagaggcgcgatggaggtgccccacactgcgtagcttgcttgtaatgtccaggaaggggcattggcgcaaggtggagcacggcggcgatcaacgaagtcttgatcggtggatcgaacacttctggaggcgaccggaaccgttgatggccgctttcaatagggagatgaccagacgtggtgctcgggttgatggccgcggaagcgattggcgaatcaatcggtggatcggacacttcaggcgggtggctcgaactttccagtgagctactctcgacagggagacgtgcggccgcatgctcgggttgattgaagctagaggcgatcagcgttctcgatcggtggattcgaatactctgggcggggtggtctgggcctttcgatgagctgcgttcgacagggagatggctagacgtagcgctcgggtcgttcgatggctggaatacggcatacgacttgtcggcttcgactcgtgacttgattgatggtgttcaatcggaagtaggagcgggtggtttctacgtgctgttttttgatgtgctgacgatgtggtgcgtgatggattgctattgtggcggcgcacatacgataagcggcggaatcaggaagacgggcagccaatacagaccgtcattgctctatttaatcgtgttagcacagcaatatgcattggatgcaactgaccggcggtgttcatcgccggcgaggttcagcgggatgccgggaggctgcgctagaggtcgtacgggtgcgtgaaggctgaggaggtcacgggaggtggcgatgtgcatgtgttggtgtcaaagtcgttaccatgtaacgtgaccaaagcccagctagtagggaggttcggtttttttaccgagattgcgcaggtcttgatctgggtgtgtcatggatggagtcggcctaggactcgtctctgttttggcacagaagagcagatcgaggggaaaccatgtcgggcacggaacgggaatcggaggaggacaacgattcgttctgcaatcggactctatttttcccaaaataaaagcagcagaggaccacgggattgcatcacaaagcaatcggaacaaatcacctagcagagggcgagattcgtacccaattttcgcagaggtggaggtgctttgggcagcgaggtcccaggtgcggcaggaggcccattacaaggttttcgggctaatgccacaaaattttgggcaacgacgtgattttcgttgcaatacataggggttattgctaccgaagtctaatttagttgcgatgggggggcatattaccactaattatgtagtgttgcgattctaatttttttgttgcaataactaggaagtatcgcaacgaataaatctgcgttgtaattagggtgatgatattgccacgctttatgttattgttgcaatagttatccatgtcgcaacgaatttagagcgttgttataaggttcatgtatatagcaacgcaaaactactttgttgcaaatgagtctataggtattgcaacgcaaacctaaattgttgcgaattagtctataggtattgcaatgcaaacatgaatcgttgcaatcattctttgatattgcaacaaacaccgaaaatcgttgcaactaacaaggttctctcgcaacaatatttcgtcattgctatagtttaacgaatcgttgcaataggtgagattggtggtgccacttgcagattgttcatgggcccttgtattgttaaactttaagttgtcttgcatcattattgtggcccgggccaggggtcatgaattacgtaattaagtcggccggccaactagctgggctgaatcgttgaaaaaaacaggtatgattaaccctacccttagcaatcgatagatagataaccctgatcagactagctagcgccggtgaccctagtatatcttgcacaatcgccggcgacaccgaagcactcgacgctggcgagaccacaccctgtccctgtctcccaactcgatatctcgacgccgtccgaatcgatcaatatatttatatatattcaggtacctcttcgatcacgagtgcaatgaaaactgttgattctttttttctatatatctatgtaattaaaatttggtttatttcattgcatactatcccttaggcaaatttggtaacggattttctcacttggaatatggcatgtgatgatgatcatagttggatgctattgtctcagtcagatgatgcgtggcaagttggattcgagaaattcattgaacatacatttgaaggtacctatccaggagagactgcggcctgtccatgtactaggtgttgttgcatggcgtacggaacgaaaattgaggttcaacaacacttgcttggtagagggtttgataaggatttcataaaacagaaacgttctgttagtaaacctatggttgtggatgatcgggagattagtgaagccgaagttgatgatgtcggctctgtcgataatttgctttcttcgctaattagtggtgctatacacggggatatcagagataataatattaaggtgccaaatgagtcagcaattttttcagtttatggaagaagctcggaaagaattatacccagggtgcaaggaggctacaaaggtatctttcattgttaggctatttcagattaagtgcatgtacggtatcagcaacaatgccatggagcaaatacttcacttattctgtcttttgctccatgagggatattgtgtcccaaatactttggataaagttcgtaaggtagtccgagatcttgggttggactaccaaaagattcatgcttgtgtcaatgattgtgtgttatttcgtggagagtatgataagatgaacacatgtccaacatgtggggagagtaggtggaaaaatatagattctggaaaactcggggaaggaagtggtattggaggaccaaagaaaaaggtccttcgtcctcgtaaaatacttcggtattttccacttattcctcgacttcagagattatatatgaatgagaccacatcgacatatatgcgttggcacaaggaagaattggttgatgatgggaaagtgcggcacccagcaaactcattagcatggaagcacgtaaatgaaaagttcagggatcggtttgcatctgatccacgcaatgttaggcttggacttgcatcagacggattcaatccatttgggatgttgaatgtgacttacactacatggccggtgatcctaattccttataatctgcctccttggttgtgcttgaaacaatcttattggatgatatcgattctgatacctgggcctagatctccagggatgaacattgacgtatatttgcagccgctgatcgatgagcttaaacagctatgcactgaaggagttgaaacatgggatgccaaggtgaaaaagaattttacgctacgtgcaattctgctctggacaataaataattttcctgcgtatgccatgttatcaggttggagcacaaaaggcaagtttgtgtgtccttattgtcacaaggatactgaatacttgtggttaaaatacggcaagaagcactgctatatgggcc

SEQ ID NO: 20713 - DNA, 1448 bp, Oryza sativa
  unsure (1)..(1448): unsure at all n locations
caagatgccagatggttatgcctcaaatatcaggagatgtgttgatgaaaatggttggaaggttagtagacttaaaagccatgactaccatgttttattacaaaaacttttaccgttggtggtacgccatattttgcctgaagatgttgtgatcccattgatcgagctcagcaggttttttaatgaagtatgttcaaaggagcttgaggtgactgaaattgaaaaactatgcaattcaattggagagaccctttgtcggcttgagatgatattccctccatcattttttgatattatgatgcacttaccagttcatattgcttcggaggctagaattggaggccctatttgttatagatagatgtatcctgttgagaggtacctacgtacccttaaaggctatgtgaggaacaaagcgtgcccagaaggatcaatagcagagggatatatatcggaggagtgccttactttctgtgctcggttctttgaagatgttagtacaaaggtgaataggccagaacgtcaagaaaatagccaagtcagtgcaccacctgctggtctaagtatttttgggagcatgctgtacagtaagaacaaatttcatatcgagactgcatcttattcagacttgcatagaatgaggcactacataatatccaactgtgatgaggccatgccatgggtaaagtaagatatatttatgcctgttatgaatgcagagtgacaaaataactcatcattctgctaatcttttcatttttattgcagtgagcatatagaggaattgaaaaaaaccaacaggggaaatgttgataaaaggcacaaggaacaatttgtatcatggtttgagcgtaaagtgagtgttttttttgtatcaatttcatcaaactaattgaaaatgtgactgatcatacgttcgaagtttttctgagtgcagatgaacattcttcatgcagatggaaaaatagatcaagatatatattgtctatctcgtggtccagatcatcgagttcgtgtagctaacaggtgctccatcaatggatttctgttccgcacaaccaatgtggagaaaaacctaaccacacaaaacagtggtgttgttgttcagggcgaaggcatggactggtatggagtgattaaaaagatcatcaccctcaattttcccaatgacaaagaagtcttgttgtttgagtgcgactggtttgatgttccgggagcaaccacgaactaatccagagggtacaataaagatcaatatggaattattgatattgacaccactcgatttcgctttaaagacgagccttatatactggcgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20714 - DNA, 1299 bp, Oryza sativa
gctcaagcaccatgtagccttgagccgccgtcgctccagcagtgcgccaccgccgttccagtcgtcgccgtcgctcgggaaggtcgccttcgtggtcgccaagtcacagccgtcctcgtccgccacttcgccaccgccggagaccgccggagcatcgtcgccgtcatcaagccgaagaccgccgccgtttcttcctcgtcgccgtcgccgtccgttgctcctccgccgcttctttggtcgccggtgagtttgccgcgtcgccctctacccgttggtgccctccgttcgtgccgaagcgccgccgttcgccggcaagcgtgcgccgtccgagccgtccgagccgccgagccgccgccgccggtggtgacgtcatcgctggcgtcatcgtccccgtctcccgtgagctggtcgtggaccgatcgatctcggccgtccgttttggatggatcgatctcggccctccgttcccgtgaaccgtcgctgtgcgcccggtccaccgcaaaccctagccgctgacgcaataattccctttttccttttcaaaaataattcattattgcgtcataattcaattaaaatccatataagtgtttcaatccgattaaatcttcaaaaattcataactaattcatcttagctcggatttagttggttcaagtctctaaatttttctaaaattgaggtctacatgttaaaaatatccacatatactgttcatgcttgtttatgtgctgttttggtgattttgcttctttctgcttagattccatcgtttccggagagtccgttttcgcagcagaagagtttgaagagttccaaggccagcaaggcaggtcacacagatcccaaacaaccctttaagcatgttgatcctatttaaagctattgtttctattcaactattgcatctattttcgaatgtcattgggtggaattaacctattgtttgccatagcccttttgttcttgattactttattccttgataccttgggttattaaaacttgactagttgagctctatataatggttcagctagatgttagatatgattgcttagccatgcttagaaacattagcacactattgggataacttatgaatcactattatttaatgatggcttaatgatagctcacgatggtcaatcgtgattggttaattaattaatttgccaactaaaacttgataatggtgggttgtgagcacatggttttgatggtcgtgctcatgacaattaaggaccggttcacgagtttcggttgtgaaacattaaccgtgccaaccacaagccagcg

SEQ ID NO: 20715 - DNA, 1541 bp, Oryza sativa
ttttttaaaaaaggggaaaagtttttttttggatttttgagcatgatgtgtacatttgtacgaagtgtgctttttaccacttttgtttttttttccaaacaccaaaacaattttgatgagtttgccaatgtgttcatgaagggggagattgtaaaatcaaaggtgtttttgttattattctgtgatgaacaattgggcattggagattatttgttttgttatttggaattttttcacgaagtggttttggagatgatcggatttacaggtgaatcgcaggattgtcattttatgtgaccggtcagaccgggctgtgtatgccggtcagatcagcggtgatcgagcggtcggaccggccagcccacggtctgaccggccagcccacggtctgaccggccgacactatgtcggtttcggtttcgggttgtttatttgaatatccgagtttatttcatgattatgacttctagatggatactatacgtatgtaatactattgtttgctgctaatgagtcaagttgaagatagcttggtctcggaatagggtttctttgtttgttccatgtgtaggtgactcgatgtctcgggagagtatttgcggtgatggaccgggagtcggcttggggataagacgacgtccgtggtggtcagagatcatgcgggatattaaggctagagttgatgcacgtggttgatggagattccatatgacatacgatggagttattgtgtgcgtatgggatgcggagttgaatttggaaggagtccaaatttggtacgattggttatgtaaagtttctttcttgtactagtgggtttcctaaggtgtttaggactcctagtatgagtttggttcgtggctttaggctgcctacctcatgtataaatagaggggaagcgtgaggcttcccggtatcgttttatagagcaattgaattgagttttgagttagggtttcgagtttagtcgaaatttttgtaaggagtgttgttggtgcactttgtaaacacagagagaagtaataaagtcgtcatccactttagagttctttgatttgtgtttcaccgggtttcgtcggtctaaccggcggtgcaccggcggtcagaccggtggcatatgggtggtcaaaccggcggcggcgacaggcgaggcaggcaactttggcggtcagaccggaggttcaacaccggttagattggcggcatctactcggttagaccggcagatcaatctcggtcagaccgactgtcacaccctgaaaattcaaaatatataaattgttgtttaattggaaattttagaaatgattttaaaaagccttgaaaagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagttcttcttttggctttgggccgaaagtcggccca

SEQ ID NO: 20716 - DNA, 641 bp, Oryza sativa
acgcaataatgaattatttttgaaaaggaaaaggagggttattgcgtcagcgggctagggtttcggtggaccgggcgcacgggcgacggctcacgcgaacggacggccgagatcgacttgatccaaaacggacggccgagatcgatcggtccacgaccggctcacagcgaacggccccgatgacgtcggcgatgacgtcaccaccggcggcggcggctcgggcttgcatgctcgccggcgaacgacggcacggcggcgcgaacggaaggcaccaacgggtagagcgcgacgcggcgaactcaccggtgaccaaaagagtggcggaagatcaacggacggcgacggcgacgaggaggaagcggcggcaaacttcgggtcgacggcggcgacggtgctccggcggtcttcggcggcggcgaaggagcggacgagaacggcggcgacttggcgatcacgacggtggccttcccgagcgatgacgacgaccgagacggcggcggcgcacggctggagcgacggctacgacggcggcgctaggttgcacggcgctagagctcttccggcgacgagaggcgaaggcgaaggtggcgacgggtagaggagacaccggggaaccttttaaaggggctcggaggcgacgg

SEQ ID NO: 20717 - DNA, 479 bp, Oryza sativa
ttcctgcagcccgaatatatatataatttacaaataactaaaatttgatattaaaaatgattaataactaacacgtatataaaatataatatgaaaattcagaaataaaaataaataatattgggagaagagcatagaatctatatagaaatataatttatagaaaattcagaattaaaaaaagaaatattaaaagacaagtctagagtccatataggaatatatataatttacaaataactaaaattttatattaaaaataattaataactaacacgtatataaaatataatatgaatattacacattaatagttttgtaaatttattgcaaaatttaaaattatgttgtcattttaatatatttgaataatataatgagaaacatatatgctattatatgagagaaaaaataatgatgctagccgcgcaatctgcgcgggccaccatgctagttaatagtatgtgataaatcactct

SEQ ID NO: 20718 - DNA, 11838 bp, Oryza sativa
gtcgggctatgtgcttacatatgtgggaataaaatcatattgccctctcttaacttcttaactatgcgttgagcttgattcgctctcattcacaaaatcacatataaaggctcccttaactactattataatcatgtcaattgatctccctctgctattttaaaagagtttttggttgatgtgtgatggctacgtgtcacattaaattctaatctttatcctacatggtgcttatgtggtatcaaaattgaaaaaataaatataggaaccacttgtaagtcaccaacctttatcttctttctccatctgtccaacttttccctatcctatattctctcttccctctctcccctctcacctttagacgggcaaaggtggtagaggggcggtaggataggctgagagggcgacaattggtgttcctcttcagtcgtgtttggcccttgtcatgctaaccgccgccttctcggccgatgccttaatctaccactgtgtcatcctagtaagagaagagagatggtgctcactgacatatgactccacactatattaaaattcttgtttatgattataatgtcttataagcgtcacgtggttgtcacgtaggatgaagattggtcaacgtaccacgaaaacgtcatgccagccgaacctgctgtaaaaacagtcgagggaggtcaattaacctggttgtaacaatttatggagtccgtgcatctgaatttatggctgagggagttaaaatgaacttttttgcttatgggatttgtgatcgtttttgcctgcggagcccatcgtgtatatgtggttggtgtctatggattgacatagaaccctttcctgattcctgacttgaatttgtttcatgtgaaaaattttagataatcgcctcctcttgcactgtcccaagtctcccagacgacgagattagagttgtctttctttacttgtacagcagggaccctatcgtttcccccaatatggaccaactgcggccatgtgtacaatcgtgccatgtcaacccatctttatgagttacgagtacctacactgttcatgcatgcaccaactagctagtactaccagtagtactctactcacaaaaccttctacgaaatctgcgccaaaaacgagaaccaattttcgctttcactggaaagagcgcgccgggccggcgctttgcgtgagacgaaatcaaccagatgcacatgccatccacggcctcctcttctcccttgtcaaaccaatttacttaccctgaacctgaaggccatccagtactccagcagtatgtacaagtgtcagctttggcaaagcagatgatacacactacacagaataggatggacacaagtgagcaagtgagaatgacgcgataggtaaaaaaaaaaccgaacgaattataagctttcggtggtcagatacgtacgcagcgaacgtccaaaaaagggcccaaacgaggtggtagatagcaccgcaccggccaagggaggtgatgtactgatgtgcctacgaatccatccaacgggagccggtccaaaacatttttacagcagagtggttggatctaaatcccgtccttgcaatcaccacctcccagtccccagtccccagtcccccacacatgagctaccagcagagtggctgctacaactacagcataatcctttcaccaactctggcactctggctgacacgctgggcccactcccagtgaagttatactcgtaaaaaagaatcctaagacgccgggggaggcatctgaccatctgttctttacatgtgtgtgtttttgccaagattctgatgatcacgtgcagctttttttgtttaacactggttattactagtagcacggttgcatgcaccacatttgtgtcactttgtgcgcaccagcatgcatgcctcccttatcataacattgatcgattgattcaccaccacaagggcacgatcatcttgctcaccaaaacacagacaagattggaaatcacgtgtaaagaagaaagtaccgggtgctttgaactaattgaaactgctcctgtttcctcttcttctaagagtcctgcattacaaaattcaaaagaaaaaaaaatgtgctacgaaagaaactcctcagagtctgcttctaagggggaaaaaacactaaaaatctcaaaaaaagaaaaaagaaacttaagaagctgagaaataaagagtaaccaaaaatgcggtttgcaggacaaaaaaaaaattagctgtttttatcgctgaattattcctgggctaatgaatagtttcctaggtagcctggcgccggtagtccgggcttatgcggttatggatcaggaattcgtccgcgccggcgaagagcggcgccgacgacgtcggcccgtcgaacagcagcgggctcgtcacgtggagcagccctccggcggcgccgccgccgcccgcgcccacgtgcggcggcggctgctggtggtggtgcaggagctgcatctccttctggcgccgcagctccaccaccttgcggtgggagttggagtgcttggacaccacgaacgtcgggctcgccgccggccggtactccggcacgagccgcccggacttgtaccgcaccccgcacgcgttgcacagcgtcttgggacccatgggccccgtcctccactgcggcgtcttgtccgtctcgcagtggaggcacctcctcccctccgccgccgcctgcgcggccgcgttcggcgccggcgcgggggacggcccgtccttcttcttggcggacttcgccgcctttttggccgggaatgccggcgccgcggtgcccgactcggacggcgagatgaccgccgacgccggggacggcggcgacgccggcggcggcggcaggaccatcaggcgcgacgaccagctgcacggcgcgacgcgggaccgcttgctccgcgccttccccggcacgggcgcctccgtgggcagcgcgccggcgcctcctgccggcagctgcaccgcggagacggccagagcgggcggcgcgcgcggcgcggcggggatgccggagatgagctgaagcttccggagatcctccgtgggcaaggtctcctcgcccatgtaggtggacacccattccagctccgcgagttgttcatactgcgtagaaatttcacatcagacaaccgtctcagcaatggcgctagttgttaaactcagtaaattaacaagatattgtcatgaaaattagaataaaaaatacagtggctaagttggctaagtggggcgagtggacataggatgctactatttttggacgcagatttcctcggttactatttactcggcaggatgctatttatgttccctttattcatgggggagttttaacgcggggtggtgaattttggaaacgaattacgggtgaattgtacacagttggccaaaattcattgaaaaatatgtgccatatttgcgacgccgcgacagtaatcaaataaacggaagccaaatttagccctcaccggctcgcacagcccgccggagaagtccccgtcggcgaggccggagaatgagttgctgcagctgtcgacggccgtcaccgtcgacgagtcggccgacgcgttcccggccgcgcggtcatccccgccacctccgacgacgcccgctcccaggccggcgccgccgccgccgtacgccccgcacaaccccgtctcctcctcctcctcgtcgcacggcaggtcgaggaggtcatcgacgaggaacatgtccccgctgccgccgcagcctccggcctccttcttgacacggaccccgccggcgtagtccgccgccgccacctccatcgatccctacttcaccaccacgcagttcttgaaaaccgaattcgtctatatctcctctcctttctacctcaccttttgctaatgcttattctttcatgattttctttttctcttctgtgcgtgcgtggagaaggaggcggagataacgtgagggcggagagagagagagagagagagagagagtagggtttaattgggaagcgttcgcgttggagagcggagtggaggacgacgaggaggaggggaggggagggagggcgagagaacggtggtcaggtcagctcgaatgaacgattcttaaggagtaaataaagccagagccactaccccttggggtgaaaacatggacgagtttaaaagccggttaaatccaaaatcccacatttatagcagtaatccttgggagaagacgacaactgtagtgtacaccaaaacggaaccatgtgatcgttgccaatgcagcaatgctcattgcatagtgatagtgctactatctctatctttactactataaaaattaaaaatattttcatccaaattttaatacatcttatccatatttgagtctaactttactattataaaaattaaaaatattatgtttgagtgatttttttaagttggttgtacgtcgtctgtatccaattcatcatgaaactagattatctattatacacctcctttcagtccaaccctcctcttagctcaacccaatcgaaccacaccatccgggcaccccgtcatgtgcaccaccacaacacactgcgcacccctctcctgttttttctatcttttttctcgttttctttttatcttttttcttttctcccaatcatcctgatcctctcctgctctttctaatggcctctctttactcgtccttttctctctgttttctccttttcttttatgttctaattttatattttcataaatatttttcttttaaaattataattgtttaaaatgtgtatgcgataagtttaatactttgcaaatgtttttcatttatagtaaaaaaaagacttttactaattgaacaattaaaattccaacctatggtcgatgaagtataacaaaatacccatgtatcaacttatgacattgccacccatcaatttgtgagactatggaatggtgtatataaggtattcttcgcgtgatgacgcatgaagcgaatacaaccgggttcaatactatatatttcgtgtgtttttctattgttttgtttgtcttattttggtttgtcgtataaattggtaaagtttttttcaatcgtaaaattgccttcacctgttacaatacacagaattttttttctagttagcatatatatgaggaattaatttgttttttagggtaggaattaatttgttgtagtgggaaaaaaatcctatacaaagacgtgtacacacgcgtttccttaacacatgctagagagatagagactatagaccgctgatatcactaaagaagcctttgtttggcacttagttaggggtaaaacaaaaaaaaagttttcatataaaattaaagagaaacaactcaacctccattgttggcataaagttgtatagcggatttcaggcttatctatattacacaaagatttgaaaagtgtattacggagtagttgttagagtatcgtgagtttgaattgtatttttcatatattagcaaaacagaaaaaatgtgtaactttgctactgtcctcaaaggagaaaaaaaaagaggggaacaaaaccattggcctactaagcaagccttcgcttagctcttagttagaagaaaaaaaatccaagtatattaaagaggaaaacaaccgaacttctattataagcataatgtttataaattataacaaaattttaggcttgtctgtattagccaaaaaattgaaaaaaagtgtgaattggggttatttgtgaggatggtgggggagaaagttctctacacagtgggtgcaaattgtatttcacattttttttcaaaaaaaaaaatctattcacgtattatcataacagaaaaaagaagtaactttgctactagcaaaaaaaaagaggggacaaaacaaaaggtaattttgctactgaatatgaccattgagcaatttcgttttcattaacgtgtggggctgactggtgatgcacaaaattgagcatggctgagctattgtgttttgtgcacttcaaaagggaacataatcatataaaaagtagcatcacatgtttggccatcatatcattcagtactatcatagacttatctactccaaaatgcacctatcaaattttgtgaaaaaaaaataaataattacttaaattttttgaataagaaaaaaaaattaatcaagcctaacgtggtatgatctgaagcattagtcagtgattactagctttcaaacaaagcccagtaaaaaaaagtattctactgtactatccatactacttcctccgtttcacaatgtaagttattctaacatttcacatattcatattgatgttaatgaatctatatagatatatatgtctagatttattaacatcaatatgaatatgggaaatactaaaatgacttatattgtgaaacggagggagtacgatgaatcatggaagcagtaagcattgttgcacgcagcacctgcacttttccatttactgtggtacggttaaaatagcttcaaaaaaacggtgtttattagcccccaacattagtagaagggaccagcgtccaggattttttagtagttgtagactggaccaacgtccaggatattgccacgtcgcgccacccatccgtaggatttcgccttcgtgggagacgcgcatgtcacgggcctgtctcgtgctaccacgtaggcaccacgtgggccgcccccgccgctaggcgctccgtggccgttggatgcgtacggcccaccacgtggccggcatcagagtgggctactgggctggattagataagagggtccgggccctgcaggctcaccgatcccgaggtggattggcctcgggagacgtgacaaatgctggggccggttttgttttctgtaaatttataattcctgacctcgggagcggtgatccaccagcatgttaccaccacgaacctctcaacctcatggctgaatcatttgcttaaaaacagtggcccaaaatattaccactgtgcagcacatttcatgtcttgtttacattggaaaagatcctaggaagtcaaaagtattcagtttttgtaaaaaaaagtcccagaagattagtatttggaacaaaagaatgatgatacacccaattcaattgtattgaaataggaattgccattgaatataaattttcaaggagaacaattgtgagatttaaccacttgttttttcccattcaagctgacaatttctccatgcaacttctaaaactttcatgtactcctttgttggtctagcgtgttggtatgttcacggttcagatacacttaatttttcaaaattttagcaacatttacacaactatagtatatttaaaatattcagtaacaaacgacatgatttttactctatatcttcctaggctctcacctagttttgttagggtagatagccaaacaagctattttgaataagatgtcgacaactttgtcaatttggtattgttccaagtgtgaaattgtatacaagtgtttagaatgttcctactacttatatgttctgaagatactgcaactaaacgcattaaaattaactctaaaattaagtactaaaatttattttttaattgcgtatgaaaagctaaagagcaagtgatgaagctgtaattgtactggtagaaaagatgtgctatgctagagtactctctctctctctctctatccattatataataataaaccaatttttatataataagtctaaacatatcccctctataaaaaacaatttatgactacaaatctaattgtaggttatatcgaaatctgtagctataaattttggaatagacgaaactagaagaactgtcacttggattaaattcaagacatctcgtaacggtggtactgtagaaaagtacgtactagtagtacaacaccttgtgctttgtaattttaaaatctaccgtcctcgtttatgtaccaggccgattatcaacgcactgcaaattagaagagatgccctgacaaataaaatcacgcataattttgtgggccgttgacattgtagtagcactgtttaaggtggagtggaaaacatccacacttctaaacaaaaatactcatcacttgttaccctacaacgtccaatgatgcatggccgcacaaggaaaaaccaagagaacgatgggaacataatattatcgctgtccctaagcttttctctcatttttttatcttttctttcatttctttgacttcttttattcgagggcttttcccctttctctgacaaagtggactacacgggccaaatattctatccgctcccacgttctccacggcacggcccatttataaagcgaggtgatggggtggtgtgggtcccgccggccacgtgagtgctagctggcgagccgtgtcaggagtcatgtgagcggcggggtccgaccgaccgacgcgcgggggcgggccgcaccacccgcaccgcacggcccgcacccggctccggtacgtggtcaatgccacgtcgcgcgccacctctcgtcgtcgtcgtcacgtcacgcgaggctccaccttcccctgtgccgccgtgctcccgtgtacagacgcagtgattggtgaaggttgatagggagggcaaaaatatctccgacgcgaacgcgacgcgagagcccgtgaacctgtctgcgattttctgatgtgcaagcgctgttcgagtcgtgagatgagaaatgatttttgataaacagggggcgtcgtgcagtcgtgctcgttagtactttgcttggagtggatgctgcgtttgaagactttctgggggatgaacgaactgttccaattcttcagacccaaaaaaaaaagaaaaagaaaagcagaacagaagacgtggggggtgacagctgatttattgcggttcgtgaacatcagttttgggtgtgtttagttcactctaaatttaaaattttggttgaaattgaaacagtgtgatgaaaaggttaaaagtttgtgtatagggaagttttgatacaatagaaaaattgaaagtttaaagtttgaagaaaaagtttgcaattaaactcggcctttgctttgcgagcttatcacaactgtgaacgcgtgcacgtccaagaaagaggcacgtattcggtattccatctgagccaaactatcgacgacaacaaagcaagggcgtactctgaattccggtgcaaaaaagtagtgctttcatttgccgtgcagcgggcatgtgcccaacttaatttttcgcggcgccgggatgcctggccaaatcaggaggccccgcgtacaacgcatgaagctgctaagttctctgttcttgtatggaaagcatcgtgctttcgttactgggtcaaccttcgagctatctcggagcatacagctcactctaaaccatgttcgtaccactacactttgtactagtagatagtgagagcataattgaatttgtacaatattcttcctgctgtttcggatcctatttagtatcttatttagatcctacttggttgattgagcgttaggaaaacatatccatactaatccaaaatctataaaaggaaaagaacatctcaagtaataaacatgatgatattttccaactttatgattctgcataaagaataagggagtaactatatttacgtcgccacattttttatatgaaaaacatatcaaaccaagcaatatcaccatccatctttacctgaagggtttcgttcaaattctaactaaccgataaggcccaaacatacaatacggcccactggcccattatccttacgagacaagtaaaccatcggcccatctggagatccgttatcgccaggcacacaccctgccccgtcctctcctcccccttccccccacctcgacgaaccgacggtttccccggccatggctgctccgccgccgcggcgaaccccgaaccccgagcgcggcagcaggaggaaggtgagagcaccgccgctcgccggacttactgctcccgatccctaaccccgctcgtctctctgctctcgcagggcgaggacccgtggctcgcggcgagccttcgcccggggaatttcctcccggggctcgcgattgggttcctcctcggcctactcgtcgacttgacctcctcatggaggccccaatcgagtccaccgctggctccggctgccccggcgccgcggggctccaagcggacgggtggttcgtcgtccgctggcgggggcatcggcggcgaagagcttaagatggtagcttaaaactttctaagatttcttctatactggattgcatctcaatataccaggaattgttcgaaagaactcgtgtgatatcggactgtctgctggtgtaattccgcaactgtagagctgaactttgttctgagttttggcactccttttgcaggttttggtcgtgcgtaaggacctcaagatgcgggctggaaaaatagcttctcaatgtgctcgtaagctcaacttcggaacattagtagaagcatttttgtttcctcaattcctttttttttttttacttatcctcgaagtgtaggctattgtgctttgctcaaatagaactaatttttgtttgacttatcctagaagtgtagactattgtcaacagaacagcaacaaccaaattgtaatgaaagctgctccagtttaagtcttctatcgactaaaatattcaaacatttttttttggatagacctattttcgttgcccgatcgttgaatgtttccatctcttgtactatgaatcacctacaacctacattattttgtttgcagatgcagcaactggtctgtatgcagaactgatggcaaggtgctaacgcggtttgcaatttttctcacttaggtagttctaattgaaatatgtagtagactatctgtacaaacatattgcttacctatgcatctaaaactgtattgacactgcttacaagtatcggttcatgttttggttatcatgagtttgatattttgttttatttgtatgaaagaaaatcacatagcatccatgaggtttgagttgcactggattcatatagctcttgtaagactagtctataggtgccagtatcaaggagctatgtcctgaccttagcagtgttgaagattttccaatcaccattcatctgatacatctgtttgcagcaaccggggtcttttgagacagtgggagcaatttggacaagctaagattgttttaacatgcaagaatcagcaggaaatgtaagctgttgctttgcctagcacacatgttcctttgaacaatatttactggatgatgatgtagcactccttttcttatcatgcattacaggaataggattaaggaaaccgcagaacatcgaggtatcccaacatttgttgtcgctgatgcaggacgaacacaggtctgtttatagtgcttctacaactctactttcttattcatagggtggaatttttcatacttgtagcatttgtgactttccagcataaccaataaattgtggcagctatgctatgaaactattgctacattatttcctctttttttttaggagacaatcttatttacccgtgactgtgcacatccatctggatgtagaggccgggtttttcattatctaaaagaaaaatcttatttaccctgatccttgctatttcttattcttaatgtaggtacaagctgggtctaagacagttcttgcagtagggccaggttggtttctcactcagaatgtcacgtttgtgtctcttagctgcaaatgtctcagatttgtgcgtttgaagtttgaacggtatatatgagttggaatctatctcatagttttcatgtaaaaaaaagtccatctcatagtgttcttattttgtttgttaatgcaaca

SEQ ID NO: 20719 - DNA, 1723 bp, Oryza sativa
tggattttactttgggacaatgaacaagtatctgtagtttcgaagtagtaggttatcaccttcctcaaagtaacggatcatatgtaccgtatgtccagaggaagcacaaaatgcgtagaggtgacttgtcttgtcaaacatccttggtgtgaagcctcttgctgtgaaagttctgtattcccaagttcccaactagtccatatctactgggaattgaatctctttcttgcagagctggaactttgtgcactagttccaacaaaattagattcttgcaaatatggaaatattgtattgtaggagtagttccaacaaagttcgatgaaatttctcgccctttgaacaagtctgtcggtcagtgcttttcatgtccgttggtgaagagccccgttgtttcgcttattcatatgtttaatccattgttttgcttattcatatttttaatcccaaattgcttattaataaataaaaatcatatgttagtaaaacttttatatatatgtctctttagtaattcaaaagcaaatgttgtaaaataaactacgatgagaaaaacaaaaaaagttaaatttaaaattaagttataaaatttaaattttgttctataatcatagatgacatatcgggttaaaacgaggtaagtgtggggaactcgtgaaaatcaaatataattcatgaaaaaaattattagaaatatatgtagatatgaaatacattctgacctctcaagttcagacttaactttattagagtaaaaaagataaatttcgaacgcatagtaacatggcactattcacttgaaatttgctatctttgtctcttttgaataaagttgagtttggacttgaaatttgatgagaacatatttcatatatatatatattataataacatatttttataactttataaaaattttaggtataattttcatgagcttttaacccttaactcccttaactcgttttcacgagatatttccccaataatcataatcatgagcgaaataattaggccagaattcgggctggacctcgcaagttgccagacacgcaagcatacgaagtggcccaataaagcaaccagactcgagtcagaggcatccgctccgctccccgcaacgaacacccccgctcctcctcctctccagctcggtcggttgcaggtgggaaaggggaagagagactcgccagctcgaagtccaaaccctcaacccccgcgccgcgccgccccgccccgcccatggccgcctcctcctcgcgctcccccgcctccacctcgcgccgcggaggcggcgcgcggcagtccccgttcttccgggacctcgcctccccgatcccgtcccaccgcgcggcctcccgcttcgcctcctcggcggcggggcccaccgccgccacgacgccgccgccgccgccgctcttcaccctcgacgaccgcgccgccgccgtggacttctcccccgacgccgcggcctccgaactcctcctccccgtcgcctcctccccctccccgcgctccgccgcggccgccgccagccgctccccgtcatgggaccgctcccgcggcagggcctccgcccccggatcccccatggatggggtcgtggagccgccccggaaggaggtgcttgctttgccgcctccaccgagccctggtacccggcgcctccgcctccggccgccgaggcacagtcgcctgttactccggcacctgtgtcgactgg

SEQ ID NO: 20720 - DNA, 1654 bp, Oryza sativa
tttgcggcatcactctggtccacgagatggtaattggatccacatattatatctggtaatgataactataaacaggcttccattttattttttaccttttgattaccttgtaaacagtcatagtgccttagtgatgtagttctctagtggcttacatatgcttgcaagttattaagtttcataacatactattcgtaagagaataattttgatttgctcgtatttcaggcttttaaaaaaataaattttccaagcaccttatgtcatcaagtagcattgttgtggcagtggtagtttttatttacatattaatagcctattggactttgtttgaatattgatctctttgaaattttgtacaagccattgtctaaccaaccttttttttacaaacctttatcccggatgtgctcatgctgatatttcatagaatttcacattgttgatatgacaaaactgacaattttcagtcctggtctgggtcttatactgacaataatgtttgtgtacttggctttgaagcactcttatgatgctcggaaagcccttcaaaagaatggtgtccagctaagcagtggcgtcattattggggtgaagcctattgatccaatgcataggcagcagctcgatgagaggttcgctggaaacaaacaaggaggcttcatggtttccttgcctccaaagtctcttgttctgaagggtaccggtgcgtcgaatcagttgggagccttgccacgcccctatgatcctaaagctaacacaaatgttatcagagacgctaaccgtcgtgcaacaggtagcgttgctgcaccagcaaaatctcttgtaacgaatgtgatggatttgatatttggcatttaacctgccattttgaggacctatgacctcaacctttccatgtttcttctatgttactagtcctcttggaggacgtggtggtgagcaagatgtcagcgtgccaaaggtccaggagcaaatttgcctaagatttagagaaattggagagggaacttatctttggcgatgtaaccttcatattttgcaaccttttcttttttggctgcacttctatattatgattcactgagagcagttgttgtatgctggttgctatatagctcgggatgaaaaaaaaaaattccatagaaatgatgaaaatacagagattttttgggattaatttagggaaaattaggtgatttcagctttaaaaatgatcggggagaacaatttgattgagtatccatactgttgatttatcaatgccagttgattaaaaaaaattcttgctggaggctgctgaataaccgaaattgtgttgaactggcactcgaaaatatttatactacataatttggtggttgttgccaccatcttgaatagattggctgaattcaccagttatttggattcatgattttttaattgtgttgcataatcttctgcttttccccaatgtcccatttcagtttatagaagttacatttattcatttttttttaagaataattattaaatatgttgctgcaacctatgataaattgataatgaagctgtggcaattaatacgtgtaaaggcaatggctcttgcctactttaaaatcacagacaggcttagtttagttcgaatctcattgtgagccatttttttctt

SEQ ID NO: 20721 - DNA, 8172 bp, Oryza sativa
  unsure (1)..(8172): unsure at all n locations
tgcgagccaggcttgctccaacagcactggttttgctcaccttgtggtagtaggaagcagcaaggctgtctcccttgttgttcctgaaatttgcaaatcactctgttactaccaaaatcaaagcatgttagaataacctattgcagtaacttgttgcaccaatactagtccaaaatactccatctgtttcacaatgtaagtcattctaacattttccacattcatattgatgtaaacgaatctagacatgtatatctatctagattcattaacatcaatatgaatgtgggaaatgctaaaatgtcttacattgtgaaacggagggagtagcatatggatgacacagaagatgataagcaaacggcccaagaaatccccagaaactactgccaaatcactttgtgctactggaaatggtagctctggacaaaggttcaaccatacaatcccctcgggtccggctatggtaggttaatcacacgctaatggaccactccgttttgtgtgtttgggggagagttcccaactcccactaaagaacggagcctaagtccacgcccctcgctctgccaacttgaggatagtaagctagggtttcctcatatagcatagtaaccacaggcataatctttgggctcacataatttagctccttattccttgatgaagcacttgaagggctagcaatgttgtcacatggagccatagatagtttcaatgaagagaacttgctaggaacatcccacatctggtaatgcacttctgacgaactccagggcaccgtcgctgcactttagagtcataagtgatgcctgatcaagtgcatacaagttttcaatcgcttgattaaatggattatataaaccaagcttcctcccagtattcagtagaacccttccatctattggatcaactgcgagaggcactacaacatttgtcgcaagcgaaaaatctggccagagttttaaattgattgtgtatgctatagtccacagaccatgatcccacttccatatatctaactcatctgcaactggatctgagaggcatacacacaacatcctctgaagctcgaccacaaatgcggacagcgactttcattgtcccacattgcaatgcatgaagggcaagggataacatcaaagatcttagcagtaacatcaaaagagacaatggcccgctcataactccaacccaccttggctcgctagtcgctcatccagtacaggaacccatccagagaagcaggtggcatgtcattcacaggcagaggcggcccaggaagatgcatgctgtatccaaagccacaaccaaacatcacgcatcttaagtaatatccacgagttttgtagtctctccagtcatagaaaatcgcgacaacaacatgatcctgaatcacctggctgaatgccaagccaacattcttattgtcaatagcaaaaggattgccttcttgttcacagcaactgataggcgctttccacattgggtgcagctgcagctgcagcagctctttgtgcctgttccaatagatcatgcggtaaccagtacacgggttgaacagacagtccttctcctcatgctcaccagattcaacccatggcaaggcttggagcaaaccatctttgtgtctagaaacagtgtcttgattagatgcctcttggagccatttacttaagggaacaaagctgaaaagagattttctagagcccttacccacaagcatgatttttggctcgtcgacctcattagacatttagactggacagatactcgattactgagttgcacgcatgacccactaaatgtttctaccaaattactcttcttttgaatgagtttaccatgaccgtaattaatttatatggacaactatatcaaaggtaaaattagggtcctaatttgcatgttgtcccggggcaccaaaattgtgtagacgccctgcctataaatggagtatatgtcttcgtatgtaagagatgattttataaaaaggacttcgtctgtcccaaaacattataattcaggatggatttgaaccatactagaacaacatgttaccacttaaatttagcactatagcaagaataggaaaacatgaacaaatttgaaaaggacccagacttaccatgcgagtccagtctaacactgtcgtagggctagtcagatcaacagcatatagacgatcaaaccgtcatagcccaactccggccctgtttagttccaaagtttttttttccaaacttccaactttccatcacatcaaacatttcatacacacacaacttttctgtcacatcgtaccaatttcaaccaaactttcaaacttcagtgtgaactaaacacagcctccgagtaggaatccgttggtgaacacaccaaacttaataaataagtatttggtatcccaagatgtattacagcttatgtattaatattatttttaaatttttcttatattgtttatataggttgtaagcacctaaaactagtttgaaattgagatatcaaagatcaagcaaacgattgtgaaacattgaaatatttttgaacttgataatgttgtcatccatggctttataaacttgcatcttaaaaatacaacttatagagaaaaaaatattattagttaataaagtgaactatttaaaataatttatagctataatgaggaaaaaatagtttagcaggtcaagtgacaacaaaatagactcttcttttttcaatgtcaaatgatgtttcaaaataggtacagtaattagcattttccataacatactgttgttagaatacaataatgtccaaggtcctacccgcgaaaatcccaacactggactggaagcgccttggtggtgctttgccttagcgatcgcgatttcgcgaggtcttcgcttcgtctccgccccacacccccaaacccacagccacgacgcggccgcaatggcggagcccgagtcctccacggccgcggccggcggcagccgcctccgcaacgcctgcgggggcgtgctgtgcgccttcaccctcctcctcatcggcgtcctcgcgttctcgatccgcctcttctccgtaagatctgatccgccccctccccccactccacctcgcgcggcggccagatccggctcgccgttcgtctcgcgtttcggaattgtgcattcttaatcggccccttcgttttttttttgtgcctcaggtgattaagtacgagagcgtgatccacgagttcgacccctacttcaacttccgcgtcactcaggttggattgcggggagcttccatcttgtgtgttattatttttgtggagtatgcggatttaaggaatttagctcgaatcataggggactgcaatgttgtgttgatttcagagtgttggtgtcagtgggttttgggttttgcaaagtgattttggagtatattttcgtttactactggatgattagtggaagtatggagcaacagatggttacatgcttgctggaatcagttgtggattacatcagatctaaaatttccatcttacctattacagtttttgtcgaagaatgggatctacgagttctggaactggtttgatgacaggacatggtaagagccttacgtcagatgaataatttaatattccctccatctacttttgatagtcatatttcatcttggcacaatgaccaaggataagtaattctacttatcatccatttaaacatgctactagttattccttgtaaacaagcgattcattaatatttacatttctcgatgcccatgtagccaatcttgtgtggaagaatgtagagtcacgcattaaatcctagaaagtcattaagatgataggtgattgaattgaaatatgcctatcaaaagtaaatttttcagatttgggaatatgcctatcaaaagtagatggagggagtattgtgtaatcatgatgtaaaatagaatgtgtaatacgcctacttggctgattcccttgctgttgcttctgttttaggtatccccttggccgtgtgattggcggcactgtgtatcctggtttgacattgacagctggaaccatttggtggtatgttatcaaaggaaagcacttgtctgttcctcattaatgctgtggatgtgcctaaaatatttgattggttttgcaggttgctaaattctctaaacattccgttgtcagtggagactgtttgtgtgttcactgctccaatattctcagcaaacgcttcctgggctacttaccttttaacaaaggtgttattttttcctctcccggaagcactagttctcacactattggtactcatacaaataattgtgcttatttcttttaaccttccataggaagccaaaggcactggggctggattgatggcagcagctattttggcaatggtaatctgcactatggatttttctactaggctttttttttatcatgaaagattactatagtattttgactcgattatgatccatatattttcttttccacattacacttgtcatagtaataggaagctatgataatgaagccgtagcaatactgaatccacattccacattacacttcttttccacactcaaatcacacatcatttattacaggttccctcatacatctcaagatccgttgcaggaagctatgataatgaagccgtagcaatatttgctttgatattcacattttatctatatgtaaaggtaatggtgcatgggttgtttttgttgcctctttaacatagcgttatgaactgacctgttctcaaatgatttgcagacactgaacacaggatcactcttttatgcaacgctcaatgctctctcatatttctacatggtaatatctgataatttgaacccatgttttccaatgtcctttataatcaagcaacaaccttgtgcaggtctgttcttggggaggttacacattcatcatcaaccttattccaattcatgtactgttgtgcattgtcactggtcgttattcttcacggctttacattgcttatgctccccttgtaagtgcataacatcatccttttctttcttcattttgaacaaacaaaataaaaggagttaaacgtttcagtgatactgtttgtctggaaactgacctaataagataattatcattttgcaggttatactgggaacacttctggcagccttagtacccgtggttggttttaatgcagtgatgacgtctgagcactttgcatcatttctggtatatacattcattggcttatgcacaccttttcttccttgtggaattttcttcattcagatcatttacccactttgccctattagaataaataaccagtgaactttatctcctaacttcatcggagaaaattgctataagccaccaataatttcattgataatagtatactttaattgcaggtgttcataatccttcatgtggttgctcttgtgtattacataaaaggacttctaactcccaggctgttcaaagtagctatgactcttgtcataacagttggcttgtaagtctcttgctttttttattgtcaggtgcatgagaaactagacattgagcttgtttattccttggaccaataatcaccatctatccatcagaatttaaacatttaatttctttatttgagatggtatcttaacccacatatgctaatggcaacatccttcctccagggctgtttgttttgcagtaatagctatactcatcgctttggtggcatctagccccacaaaaggatggagtgggcgcagtttgagtctacttgatccgtaagtttttttaccatggaaaataaatattatgttattttgctgtaccgggctgggaatcattacatgaaataatacttaattttgaccagctgaaataatacaaactatgcccctttttttatgcttactgttttagacaaggaaagcagtctttctgatgcatgattttctgaatggagtatatctcaatgtcctattggtgtttattttccgtacgggctgggaaccattacatgaaataatacttaattttgaccggctgaaataataaaaacaatgcccattttttatgcttactgttttagacaaatgaaagcaagtctttctgatgcatgattttctgaatggagtatatcacaatgtcatattggagtttattttcttctggttctctttctgcatcataacttcacgttttttcctgctttttttttacagaacctatgcaagcaagtacatccctattattgctagtgtcagcgaacatcaaccccctacctggccctcctatttcatggatatcaacgtgttggccttcttgattcctgctgggatcattgtaagcagtctacattttcaatccgaattgaattagcataagtatttgttcttactagttaatattgacattgtcaacagtcatgcttcttgcctttatctgatgcaagctccttcgtggtcttgtacttggtcaccgcagtatatttttctggagtaatggtaagaatatgtgtaatgtaaaagcatctataaagcaatgtttatctagtatttatttattaacttttctttacatatattctcttttaggtgcggcttatgcttgtccttgctcctgctgcgtgcattttatctggaatcgctctttctgaggctttcgacgtcctcacaagatccgttaaatatcagctatcaaaattatttgatgacagccctgctgctgtacggttgctttcttcattgtttttctttactctgttaataattacctggcttcatccttaacaaacttattgacaacttatttcttctgaaacttaagtcaggggatagtagtgcagagagttctagcgctagtactgtctccacaaattcagcaaaaaatgagactagacctgaaaaaactgaaacagccccaaaggaaaaaccatcaaagaaaaaccggaagaaggaaaaggaagtggctgaaagtgttcctgtaaagcctaaaaaggaaaagaagcttttggtacttcctatggaggcatctgttttgggcattttgttgctgatcgtgttaggtggtttctatgtggtaagttaaatattcttagtcttacagaaagaacagtcataccataagtgatgtctggatgtatcttaggagatgcatttttgtaggtccattgtgtgtgggcagcagctgaggcgtactcagctccttcaattgtgttgacttctcgttcgcgtgatggattgcatgtttttgatgatttccgtgaagcctatgcatggctcagccataacacagatgttgatgacaaggtacgctcatcccttgccctctatttctaagtgctctgtgtttttctgacagtaagacggtccactgcaggttgcgtcctggtgggattatggttatcaaacaactgcaatggccaacaggactgtaattgtagacaataatacttggaataatacccacatagcaacagttggaacagcgatgtcatctccagaaaaagcagcttgggagatcttcaattctttagatgtcaaatatgtccttgttgtatttggaggttgatgctttgtggacttctttagaacaaatcaataactagtggccccagatccctgacgttgggtgtttactttacaggtcttgttggctaccctagcgatgatattaacaagttcctttggatggttcgcataggaggtggtgtattccctcacatcaaggaacctgattatcttgtgagttgtgaatctttttagggatggtgccttacacatcattttggtgggcataaggaagaatagaaatagtgaaacaaatatatgagcttgattcactattctgatttctcatgttattttgttgccagagggatggtaactatcgtgttgatgctcaaggcaccccaactatgctgaattgcctcatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20722 - DNA, 621 bp, Oryza sativa
aaaagggcattcgccgcgaaatccgccgaattgcggaagaagcattgcggtggcgaggtggtgagcacagcgaaccagtgcgtgcggcgggggcaagaagaagaagtggagcgagtggtggtggtggtggcggtggcaactcacccttctggacctggaagaactggagcgccaccccgagcgcgtcgccgtacttggagtcgatggccccgggcgggccgggcaccggcagcggcttgagcttgcgcccgctccccccgccgaccttcttcttcatgatggccaccaccgccgccgtcgccaccagcgacgccaccagcgccacgatcagccacccgcagcaccccttcgtcttggaccccatcgcattcgcctcctgcaacccaccggagacgacgacgcctccgcggcgctgctcggctcggcgtctcgctcgctcgccgcctcctcttctactgcaggggatgggctcgcgtgggctttcggctgggttggtggtggtggcgctcgtcgcgtactcgcgtgtggtgcggccgcgggggggttggtgcacggtcggggtaggggtgaggtggaagtctgggagtcgctgtcgggtggggcctaggcgtggtgggccac

SEQ ID NO: 20723 - DNA, 579 bp, Oryza sativa
gaactggcgataatgattgattaaaacgcagctggtgactacccaaagaatttctggagttagaattatttgcgcaattggtgtggataacgatgtgcatgcgatttttgggtaagaccagagacgatcccaaagaatttggggatctccaggtgtcccgcagtcggaatcttttgatgacggagagctcggcccctttttaaagcgttgatataaagcatcatataacgttttactcaagcggatgccaaagataatactactaatattaagcaaaggctagtggtaactaaagtattaacaatgtcataagcactggagaaagcattattcaccatttggcgttcatgctgcatagagaagaaaaacaaattgctaaaaaacaccaaggcaagaagggcaggaatctcaatccaagcacaccttagcgtaagcatcatattgacggtcatctcgaccagaatactggtgatgagttagttagtgagtagtgacagcagttgagcacagctcacaccaggagctttgcaaaccatgattagtccatggcccatttgcctttgtaacacatctgggggc

SEQ ID NO: 20724 - DNA, 6322 bp, Oryza sativa
ggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaacccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgataccagaagagcggagtacgacacctccgtccatacagtgcttcaaatggtgccatctgcagactagcttggtaactgttgttgtacgagaactcagcatacggcaagcttttgtcccatgccccaccaaaatcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgggccactttggtgagtcggtcaatgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaattcagctatttcccttctcatgctgacccaccaaaacttctctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcaaatgttccaaatcatgttgaacctcacagcatagttcctctacccatgcgacgttgcagtaactcttcctgctcaaggcatctgctaccacattggccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcgttagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaataaataaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctgtcagagctggctgaactgattgagctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcatagcgcgcgaggcggttgaactcatgcaaatactctataactgttctggttccttgttgcagggaacggaactctctcttcttttgtgccacgattccctcgggaacctgggctttattgaaactatgacaaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaacggcatgaagccagtcgtgggcctcgattgggttggtggtgcttgagaaagtgggcggcttgacacgaagaaattctaacaatttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcgatcgttgggttctcgggcggtggggacggactgttgtcagatgcaccgttggcacgtgctccattgatcggctcttcgctgccactggcgttgttggagtcgcgtgaaccattccttgtctccatctgaggggataggtagaaatatgagaaaaggaagaaaacaggggctcagaaactaatcttgcttatgaatttaagtgcaattatcttaatcttgattaaaacactgaaaaagaggcacgaaactcctaattgaggcagtcataccactgacacatgatatcgaccgccgactaacccacaagcaacaaacctaaacacgaaaactagcaagcaaacagactaagaaggcgataaagctaagggcggcgactctgaagctcgaggcggcgcttgcaaacgagggataggactgacatctaaagtagacaagggataggaaccaactcatgctcaaatccaaattaaacaaagcaaaagaagactcaaataaataaccgagcatgatgatttttatgcatagaatatttttcatgaactcaaataaagacactaatgcaactaaacaataaattaatgcatagactagttgcatggaaaatgatgcgcataacattgcccccaccgaatatagacacgacctaatgcataacccccaataaattcccgactgactgtcgaataaactccaactaaaatttttctaaagccctaggctgagctcattttttttttaaaaaaaaatccgatccgaatgaacgaccaagatttttcccgcaaaccaaagaggcaaaactccaaattttcccaaaacaaattccaagtgcaaaagggcatatgcatatgaaaaggggttcagagggctcttagggtttccagttggcttgtcctacggtcaaggtcggctctgataccaacttgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgccgaacccaaatttgacaaaacagctccaactaggaaaatcttc

SEQ ID NO: 20725 - DNA, 680 bp, Oryza sativa
gtatcccttctcttcttcctcttctccgagcgctcgcatcgcaccgcaattcaatgcccgcgcttcggtgtgagatcgacctagccggcctccctgacgacgattgaagatcgaacctaccgtgtaagctcgttgattctgttgacgccttgtttttcttttttttttagggttgttgacgccttgttgattgattcatggtaaatgttgctgttagtttgattggtgtactcccttgcagcattgccttgatcgatgagttttaactgcattattaatagttaattcttttcctaatttgttctcggagatgaattgacaaattcaatcacaagctaatgcgggttgttcccatgcaagttcaacataacatatcctgaatatatttttgttgaaaaaatatcatacggagtattccgaatcatatacatgtacttgtatgtttttttccgtataacacattatccaaacaattttactacagaatatttttcttaatatatctctcgttaactaactcttgtcttaatcttacatatacagtgcaagatcttgtatagtttgcaaaatccagctgtctaacgaagaacatgtaaaagatcttgtatctgcatggatttcgatgcgactacctaaagtgccaggtaaataactgaaataagctatccagggctgcagga

SEQ ID NO: 20726 - DNA, 13296 bp, Oryza sativa
  unsure (1)..(13296): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgggcattaggcctcatttcgccttgttccgctgcatcttcttcctcaagccccaaccaaacaagagtaaaccatgcatcgttgggggtgctggtttccaactcaggggaacactaagccaaaaatacttctccatgcccttcaagacctcaaataaaggctggcacgcaaattggttttatgttcaaaaccccgagcctgttcttctcgagtactcctgtcttcctccagtttatcgggatacttggaactcactgccaatgggagacgaagctgcacaagcagtagaactgatggagaggatgataaagctgaaagaacagggccttcaaggagaacagatcacccggcactttatcaagtgtcggttagctccaatcaaagaaagatctcgcacagccttcgaatttgacggcaagcatgacccaaaccgtgaagatccagattctcttgacttcaaggtcatgaaggaaaggatgtataagatcttctcaaacgccatcgttgtcagctacttacacttgttgccagtcgtaccgttcaatgcattcaatcctcctccaccggtacgtattcatacacttcaacctttctcaaaacatgatcttgctttctggtgatccaggttacaaatgaggatattacacccaggaatttgctttgatgaaggcggatcccccaatcgctcaacgccgatcgccccgcaccaaactgggcaagggagcggaggaccaagaattcggtctgaaactcaaccaagtgcttctgatccaatcggccagtcagattctcgaaagaggaagctggttctaagtgacgacgaagccgatgataccgccaggaggcctggagaccgagagacaaccaagaaactaccaaagcaggctactccaaggtagaaaacatccagtcgccctgtgccaaagatcaggaagtcttctaggtgcaactcatataacgatctcttttgcattgatgcgcacccattgcggcaataatactgataatcaaatttgcaggaaaccatctgatatagatccgtctgggaaagactctgacccgactaacgtggacacaagttcttccaaagaaaccgagccaactgctgaggatcatctgagtgacaatcaaccggcaaccgataatgtagaatccggtgatcaacccccgactggaatccagtcggccgaagccgaagccggagttaatcaggagcccccgactggaaaccagtcggacgcagggccaagccaagagattccagaagtcgaaacccaagcagacaaccctcgtggacaagacgccagcaatgaccggagatctggatcccctttaaaagtatccgaatccactcgtcctcgtccagaaatcattacaggtaaacactttgtccgaaaccatgttgacccaaataactctgatcgatcgtgtaacctttgtcaatggatgcattaggaccaatgatcggtgatgaagaagaaattccccgtatacaaacagccgaagattcgtgccctcctattctggtcaagtggtgggatgacaacttgcaacctcaaggaattgtaataaaccggcaaaaagaagacgaagaggtatgcctactgaaaaaggcactcaaccaagcgactcgcattgtaaatgtaagttccttgacgcctaacctcagccatcttgtttaccgtctggctcgagcgctgattaaactgctccgcagaggattcatcttaggaacgaggcgaaaaccgcaaccctagagagactagttcctcatcttggaaccctcgaagccaccaggagtcaactgcacgaggccagagaacttaccaagaagaatgaacacgatctgagggatcggattgctgagctccaggagtccaatttcgaactgagtggctcatcaaaaggttcgcgcaaactctgcccaactgatttgtgctgttatctctgtaatcttgattaaccgaagttaatgtagtgcaagctgccaagatatctcaactagagaagcagatccaaactctggaaaatgacaaggcagagctggcaagacagagggattcggctttaaaggaggttgaaggtaccaataatcaatacctcaaaagccattatcttctacatgctgattcattaatgtgaatctgttgacgcagaccgcaagatcaagtctcaagcacaatttgatgtcttagttgacaagatcaacaagcttgaaggagccaaggataaagtcgctaatgccgctactccacttatccaggccatgttcttcaataacgccggttcgagtacacttgatgctgccgaaatcttcgacaagctgagagtcgctacagatacttacttcaagaacatcaaagaagctggaagtatgggagcaagtctggcattggcgatgaccaaatccctttatccaagagttgacattgatgccattgatggctttgtagacgggacgagcgaagaagctgctcttgacctcatcagtgatgcgtagaaagcggctgacaagattgctgctgatgtagttgagagattccaagatgtcgaccttcggccaactgggtctgataagtctaatgatgaaaaaactgatactgattgatataacaatgattttgatgatcaatgatggtggaagctcaatttgtacaatactgatgaatttatgctatgcttggtgttccatacttagcttctgatttcttaaaagcctttgtcaagccttattgagcctaaaacccgcaaaagctattaaaaaccttcagtcctcattggctaagtcgaaagaccaaacagggcaatgataaatcaagtaagcaaattgaattgataaaaatcacactccattattatcataatggccccctgactgaaaacttcaaggaaaaacttgaagttagcagtcaaataggaaagatacaagcgaaatgcctaagcataaaatcgacgaaggtgttcaatattccaagaattgttgatgagagtactgtcttcgcgcttgagtcgataagaacctggccgagtgacttcagcaattatgaacggttcttcccataagagagataatttatgccgatcccgtgttgtttgaattttcctcagaaccaggtcgccgactaaaaaggctcgcgatcgaacattccgattatgataacggcgcaatccttgcaaatatcgagtcgactgaattaaaactgcttctcgggcttcttctagtcggttgatgtcgtctactcggccctcttcatagccctcctcgttgaagttccgaaatcgtagtgattcaaattccacttcactcggcaacattgcttctgcgccataaaccaaaaagaacggcgactggtcggtagcccactaggagtagtgcgtaaagaccaaagtacggacggcagctgatctacccacttgctagcatagggacgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaatgctccgccagtgaattgagtgccattgtcagtgatgatcctattaggtaccccaaaccgatgcacaatgttgatgaagaaatctctagctttatctgctgtgatcgtgatgaccggtttagcctcaatccacttggagaatttgtcgatagccacaaagagatgcgtgtaaccgccgactgcccttttaaacgggccgaccatgtcaatcccccagaccgcaaatggccaggacaacgggatggtttgcaactcttgggctggcaaatgaatttgtctggcaaaaaattgacaaccttcgcatgtccgcacaatcttgtcagcgtcggacaccgctgtaggccagaaaaaaccttgccggtaagctttgccgacaatggtccgtgcagcggcatggttaccacaaataccaaaatgtatatccttcaacaactatatcccttcttccaaagacacacagcgctgcagtattcctgacagacttttcttgtacagctcagtctcatgaataatataaagtctgctgcgcctggaaatccgctcagcttcatttttgtcttgaggtagttcttgtttgctcaaaaattttataaacggttctctccagtcggcttcgatcatgcttatgccttgaatatccatggcttcgactgtctcttttctgggcacggtcggttcgtaaaggtgttcgacaaacacatctgaaggagctgcttcccgttttgaaccaaaattagccagtctgtcggctgcctcattgttatgtcgaaggacatgggtgagctcgagtccatcgaatttattttccaacttgcgtacctcttgtcgataagcggtcatattatcatctagacatgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggaatggcataatattggctcatttgcaaaagcagcatttagcaaaatatttaagagaagtaaaacagtggagtaattaatcagaaattttaatcaacactgaacagcacacccatgctgcacaggcccaaccatcctgaacaaccatacccggctgaacagatctaactccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatttccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgagctaccattaaaccatcattaaataataatgaatcataagttatcccaatagtgtgctaatgtttctaagcatggctaagcaatcatatctaatatctagttgaaccaatatatataaagctcaactagtccaattataatcacccaaggtatcaaggaataaagtaatcgagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaacactcccgacgcactcgcgaaccttcgcaacgacggaaacgacaagctatcacgcaaaacgaggaaaaagactaataaaaaccaaataaacaatacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttaaacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacagcgatgacttggcgaacccgatggtggcgacgtgtcacgcccagaaattctcgaaccagaatttctaagctgaatgtgcattgaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacagacaatccttgacggcagcgacgaaaccaaatttgacaaaacagctccaactaggaaaatcttcagctctggtgtgggggaaaagagagcaagactgagtactacccactgtactcagcaagtcataccggtagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgctcaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacaacccaccattcaatgtattttaattaactaataccattgcggtggcaccaatccaaagctatgctcatagtcaaagtctatgtaataaggtgatccccatttgtgtgctagttgaactaagcatggctaagcatttcctaaaccaacatctagtcattttgatacccaggttatcaatggcatatggtaaacaataaatggctgagtaataggacccattccacatgatattgtaaacgaatgcaacatttaatagaaatgcgggatatttgtaaattgggtacaatatgatcaaacgtattgcatgacttgccttgctctcgcactgacgagacctcagcaacgtcttcgagaaaccgtggatcgacgaaacggccgaaacctacgcgacaaacaaagcacacaagcaaaacaggctataagactactgaaacagagaacaaaaccatttttaatggattctacacatttttcttgatttactgagacttgaatgggattaaacggagctcggatgaattagatatgaattttagaagattcactgtgtttattactataaaagaaatccttaaataatttattgcgcaatattaaccagggctgacgtcagcacggaggggtgcggcgccgacaggcggggcccaccggtcagcgaccgggagagagagaaagggggtggcggcgcgcgggcccactggtcagcggcacgggggaaaggaggggcggcggcgccacgtggcggccgaaccgacggccccgatctacccaagggtagatcgccccgatctacccaagggtagatcggacggcggcgggacctcgcggccggggcgcgcgggcgcggcgcgagacggcggcgaccatggcgccggcggcgcggcgcccacacggcggcggcgcgcatgcggcagcggcgcaaggcggcgaccgaaggcgaccgaccggcggcggggagcggcggctagaggaggagcggcggctacgcggctaagcggcgcgcacgcggctacacggtacggggaaaaggagaaaggggagggggaagcctcaccgacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggcgccgcttgccggcacacgacggggatgggtctccggcggcgaacctcgacggggaaggggcggccgaggtagatctcgaccccgcgaagctaacggcggcgacggcgcgagacggcgacgagcctagcggcggctagcggcggtcggagtagcaaaagcggcggcggcgggtggttgcacggcgcggaggcgatggggagctcgggagagatcggcgaaatggggaaaaagcgagagaggaggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggtttcggcgcggcggcgcgccgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaaggagggaaaaagggagggaaaagaaaaagaaaaaggaaaaggattttccctggaattaaaaattgcactttggtgatttttaattggttaaaattatttccaaggctctgaaaaatccactaaaaatcctgttaatatattgtgacatgtagaatccaagaaaaattccacatgccgattccgattattatttgcatttattaattagggaattagctctaggttaattaagataatttcttcggacgatttatttagccaaatttttaaagcaagcaaaaaggggaaaacttcagggcgtgacacgacggcgaccgacgacggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcgggcggcagcggcggctcgaggaagacgaacctgacaggtggggcccacctgtcagcggctgagagagaggagagcggcggctcggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaattattccttttaaacaacaatttataagttaaggatttttaaacaagaaaagctcttaacaattatacttagatcattaatgatcaaataattactgaactgttctttgtattatttaagaattgagctctgaaaaaaaaccgagaaaatttcagagagttgacttaaccatggagaatttaacaaaaattaaatccatccatgctttagatttaagaaatttttatttcccacattttacttcacttgaaaattaaagatcatttaatataaattctattaataatttattaaataatttataaatcctgaaacgaaaatcaggatgtgacaaactaccccccttacaaagaatctcgtcccgagattcggaacggctagaaagaaaagggcataggtaaactgcagtctatcttattccataactccgataattattctaaggctttaaagaaaactactgctgctttgaaactggtggctgagctgcaacacttgaagacacaactcttgaagacgcaactggcactgcattggctcctgtgacgacaatgttgttgacctgaccttgcggctgctgatgcttcggcttcggacactctcttgcaaagtggcctggcttgtaacagttgaaacatacctgctgcttccttccactactgttattctcctgagactgatcctgctgaactggcaccggctgattagcttgcttgatgttaacttcattgctttcattagtctctgatttgatctcaccaccgatattcaactgttgcgattgtccttggccagcggaaaaaggttcaccaatttggagtggcttgatacgctgcctctggctactaccttgtgcctcctggaaaacagtcattttccttttacggttatccatcctgttcttcttgtcttcaagtcgaattgctttgtcaaccaactcctgaaaatcctcatagtcatgagagatcaacataactgatagctcatcctttaagccttccaaaaacttctcctgcctttcctcgtcagtacgcacatcttctggagcatagcgagctagacgattgaactcatgaagatattccgtcacggtacgatccttttgcttaagtgcccggaactcacgcttcttcaaagcaacaacacctgcaggtatgtgtgtcttcttgaatgcttccgtgaactccgcccaagtgattggttgtccttctgctctgttcatccggaaatgatcccaccattctgatgcaggtccttgcaactgatgtgaagcgaaaacaactttctcctgatccgtacactggagcaattccaacttcttctcaatagcgtgtagccaatcacctgcttccactgggttggtagtgctagaaaaggtaggtggcctcacacgaagaaaatcagctagcttgttctgcggcggtggagcattgttgttcccttggttgagctggttctgcatctgctgtatcatcatgttcattaactgagtctgttgagccagaacttgagcaagagttgggttcccttcattgttattgtttccacttcgactggcgcgagtgttcaccatctattgcagattagagaagataggaggagaggggttacactaaagacaagaccttaaccatgttaccactgatctggtgtgtgtagaccattatattgttcaagttgattaagcaagcaacctagtatagttacacactcatcaatgaactactccaatgatggaaatgcaaccatacctacacacaagcaaacaacaaacgttctaccctactaactattcttcaaagacactttggcggcataggttctaaggtaggatccaaacttcattccatcttgaccacttggcacttcagatcgaccatcaccttcttattcatcgatccacttgactgacctccataagtagacctcactggcgtcttcaagtttcaacaactagtttcagaaccacttaagttgaaagcaggaggggagaggatgataaaatgatttatacagaattctagagaaggaagaaaggaaaattttcacaaatcatgttttcagaaaatttgtccttaaggtttgaccatttggcttatcctacagtcgagatggctctgataccaacttgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaagga

SEQ ID NO: 20727 - DNA, 20522 bp, Oryza sativa
attcctgcggcccgaaattggtatttcccacattttacttcacttgaaaattaaagaacctttaattttaaatcctattaataatttattaaataattaataaatcctgaaccaaaaatcaggatgtgacaagacatgaccactctttcatgacttgattgacaaccatctgagagtctccacagacgattagtcggcgaatacctagagatattgcaatcctttgtccatgaagtagcgccttgtattccgccacgttatgggacgcagaaaaatgtatccacaatacgtagctcaatctttctccagtcggggagattaaaacaaccccagctccagtgcctgtaagcctcttcgacccatcaaaatacatagtccaatattccatcttttcctctggcatgtcttcttggcactcggtccactcggcaaggaaatcagctaaagcttgtgacttgatcgaagttcgtggcttgaacgatatgtccaaagacatcaattctaaggcccatttcgcgatccgtccgtttgcttcgcggttatgaagtatatccccgagtggaaacgatgtgactaccgtgactgggtgactttgaaagtagtgagataatttcctaacggtaattaagacaccatatagtaacttttgaacctgaggatatcttgtcttggagtcggctaaaacctcgctaacgaaataaattggacgttagactttttgaacatggccttcctcttcacgctcgacaaccaggaccgcactcacaacctgggaggtcgccaacacatataacagtagcggctcttgcggatgtggcgaggccaaaactggtggagtggtgagaagtttcttgaagtcttcaaaggctttctgtgcttcgggtccccactggaaattgtcagtcttctttagcagcttaaagaaaggcatcccccgcttgccgagtcgtgagacgaaccggctgagcgccgccatgcaaccagtcaacttttggacgtctttttgggagcttggcggtttcatgttgagaatggcgttgattttctccgggttggcctgtatgcctctttgagataccataaatccgagcaatttccctgacggtactccgaagatgcacttttccgggtttagtttcatcttgaaagcacgaatgcttgtaaaagtttcttctaaatccacaatcaggtcatccttctgcttggtcttgacgactacatcatcaacataagcttcaacattgcgaccgatctgagttgaaaaacatctttgaatcatgcgttgataggtcgctcctgcattcttcaatccaaagggcatggtgatgtagcagtaggccccaaagggcgtaataaacgaggtcttcaagcagtcggattcttttagtcggatctgatgatatcccgagtaacagtccaagaaactgagtaacttgtagccagccgttgagtcaaccacctggtcaatgtgaggtaacccaaaagggtctttgggacaagatttgttgaggtcggtataatcgacacacatgcgccattaccccgtctttttccgaaccaggactgggttagccagccagtcgagatgaaggacttccttaatgaagcctgctactaacagcttggttaattcctccttgatcgcatccttcctgtcctgtgcaaaacggcggagtcattgcttgatgggtttggcgtcttcgttaacaagtaaagagtgctcaatcacctctctggggataccaggcatatcggatggtttccacgcaaaaatatctttattattctgaagaaaggtgatgagcacgctttcctatttacaatctaactcagcacctattacaacagtcttatcaagatcggagggatctaagggaatcttttttgtcttggcatcactttcttcggtcttcgtcagcttggttgaaggcacttctccctcgcttgccgtggtcgcagccagtcggatctcttcgcgggcgagagtagtctcgtgagtttgggccatctcgcaactttctttgtcacatgtgacggcttgcttgatgtcgctccgttgtgatatgacccctcgaggaccaggcatcttcatcattatgtaggtgtagtatgggacggccatgaatttggctagagccggtcgtccaagtatagcatgatatgctgtctcgaaatcagcaacttcgaaacaaacattttctgtgcgaaaattctcccgagtgccgaaggtaactggaagagtgatctggcgagtggtatagctgacaatcctgggataacaccgtggaagggtgcattactcggctttaattccgtgcgaggaatctgcatatcgtccagggtcttagcgaaaaggatgttgagtgcgctgccaccgtcgatgagagtccgtcggagcttgacattgcgaaccactgggtctagtaccagggggtaccgccccgggtggaccactcggtcgggatgatccgagcggttgaacttaattgttatctctgaccaccgaagatattggggcgtgctaggctgaaccgcattgatctcccgctctgttagcttttgttttctcttagattcataagccaggggtccgccgaagatgtgattaagttctttgcgatgatcttgaaaaccggtcggggcatcgtcttcatcatctttcttctttgatgtgccttgatctccgtctgagggtttacgtgcgttcttaacgtattgctccgcgaactgtttgtagacgaagcaatctttggccacgtggttggagttgggatgatgcgggcattgggagttcattatcttgtcgaaggtgttgacacgagaacgttgtcgggaagatggagaggtggtcgccacaagttcttcgagcttacgcttgcgatccttgtggtttttacttccactccctcctgcggtcggcgtatccttctttggcttccaagtggtgcccgactgcttggatgtcgtgatagcatcttcggctttggcatactcattggctttttcaaacatctgtttgaccgtcttgggaggtttgcgtccgaacttgtcgactaggtcctcgtggcgaatgcctttagtaaaggcggcaatgatgacgtcgtcggtgatgtcggagatcttgttgcgttgctcagagaagcgtcgaatgtaatctcgaagagattctccagacttctgaacgatgttgtagagatcgaagtgtgtgccgggccgttcaaaagtaccttggaagttggcgatgaagtggtcgcgtagctctgcccatgatccgatcgtgtcgcggggtagcccgtgaagccatgaccaggcagaatccgctagggccacaggtagatagttcgtcatggctttgctgtcccctcctgctgcgcggattgcgagaccatagacggtgagccaagactcagggttagtggtgccgtcatattttttgattccagtcggcttaaagccggctggccaatccactcgacgtagatcgcttgtgaaggcagcaactccgtccacgttgtcgtcgtagcgatccggtgaatgatggcctcttgctgtgcggcgctggttgatggtgtcgcgaagatcgatgggacgtcttcgatgtggggagtgtggtcgttcaattcggcgctccctatatcgctcgggaggcgagcgaacggaccgttcatcatgtcccctgctcctgcgactagattcggcgccggcaatgctgaggcttggctggtgatagtcttgagatcgaagatgagggactcggctaccagtcggggtgcgggtgcttgcagagttggctgggaccgaggcagcgatcatggtcttcgtctggttcaagatgttgactacatgatcagcttggttgagtgcgtcttccttgaggagggtgtcgaggagagtgattgctgcaaccgcgttctgttggggggtgcgaaagaccgctatcccatcgacgtcttgttgcccaatgagctctctcgcttgccacccagattccaaggcgcgttgtcgtcgatcttcagcctcctttgcaatccgttcgcgatcttgttgctcacgctgtagtcgttctcgctcttgtcgctgtcgctcttcctccaatcggcgacgttcagcttcttgccgtgcgcgatcttggtccgcttctcgggcttggcgctgttcctccgtttcgttgtcagccatgaatacgccgaagaagaggggcgtgtagttatccttatagctgtcgtcgaagttgtcgaggtcgccgtggtcgtagtggtagccgaaatcgtcgtagtcgaggatctcggttggtcgagaactgacgccgggggagctgaggtagccatccaactcttccgtcgagactgtcccgagaggttggagtataacgccaacctccctggatctagatcggatcggggccgaagccggagctcgcctagatcttcgagtgggagatgtcttgactgtgaagacagcggccaaatcatcaggaagtttcatcaggattgagggataggacccgtcgtcttgatctggtcgcggaagagtagattggatctcatccgagtggtttgaagccgactcgggagagatgatcttggagtaggcctcggccgagttcggaataccgaacggcacagggacctggtctctccccgactggtttgaatccgagtcaaggagagagatcttgccgaagtcgttggtgatgaagttgaggctgccgaaccggaacgcctgcccgggaggaaaggcgaagtcgtcgatgccagaaacgaaacccatcgcacttagtcggcgagaacttgacgctacccctacctggcgcgccaactgtcgaagcaagatttcggcaataataaaagggggtggctgtcaagctaggaaaatggatgggtttggagacaagaaattttatacaggttcaggccttcttattaaagaagtaataccctactcctgtccggggatgattccgccgagtgtgttattaattgtatagactgggaaaaagaatcacctcccaagaggcacgcggaccctccttatataggggaaggagtccgctttacaaaatacagtccatatcctaacggaatatgggattatagataaaatacaatcgtaaccgactaagatcccgggtatttccttgacatacaagtttagaacctaacccgagtcttcatagagatattccatctatatttgataccgtatatccgactaaattacaaccgtcatgtagatatggggtatccataatctccacaagctggcttgtctcgagctatcttattgggtcacatgacggtgttaaattttgaaatagatctaaggaaatcatgcataagagaaaatagccaaaagaaaataaaagacacaaatccaatttttaaagacttctcaattatctatctcttaaagataaatatagagaatatccataataaaaggaatgccgagaagcaaatagaaggcataacatccagattgtaaaggcttcccaaaatatctttcccctttgcaatctatcaatcccatgctggttggttttatgccagctgattgttgccctcaacattctttagttgagcgacacgtgacgacatacaagcgtcgaaaagagagccggttaataaaccctccctataaaactggcaagcgttcagttacaacggtgaatagaaaaacaagagaagagttgttccacgtgtcgtgaccacatatcctatatttggagaaactaaaagcaataaatagaaaaactaaatgacataaacaataaactctataatcctgataaccaatttctaaatatatgtattttctgcttatactataaataaataatatgtagatctttacgctacaattataataaaacaaatattaattctggtgttggatttatacctagagttttatgtcaaatctaaacaccataatgctcaaaatcataaaagaaaaattgaaatattagtatattaactatatggtttttaaaagccatacacccaagctaattagtggacgcgccaaacggcgtcttgattttctaatctacattattggtgattagtgaacctgaactaaaatttcatgaagtgcctttttttcaagttcacttagaaacttgtgtaaatattgatcacctaaaatttcatatataagcatgcatatagcattagatgatacatgcctactggataaatagtgaaataatgaaaataagagtaattctgggtttaccagctacacgagctagctgacaccaaaacagaaacatgattaatcggttatcagattagccaagagataaagcaatccaaataaattttaaaaaatgaaaaaaagcaacaaaaacaaaccaatatggccctagggagatccaattgtcagttatatctatctaataacagacacatttttgacaattatgtgatgttgtacagttgcaataccaaaaacagatagagaatttgctggtgaaaaacttgaaacataaattgcaaattgctaatatcagttatgtgattaaatgacaataactagtggaaattgaatagcattgctgacagataacaattgtgttactgatcaaatggcaagattatagatagagaaaaaaaacagagactaagtatgacatacttctgcatctaggatattatcatacatagagagctttcagaataatcttgcaggtgtaaaattattgaaccaacaagatggaacattcaatcttgcagatcttgtgattctgacaagtaatcctacttctgtgacgctagaaccttgaggacagcctcatccgccagagcactgtagttcggtttcactgtagttcagcttcaggttgtcgtaatcctgtgttgtcatggtggctgcaaattttcctgggcccttagagaaattcgaagcatgcagcgttcttcaagccggagcatccgtgttgctaggccaagattaggatgctcaccacgctggccacctcgatatgtttacaaagaagggcttctcatagcagcctccatcctgtatcgatcgggccgcgatgaggagatgctcggccatggcgcgtccctcctcgcgcctgctgcatctgcggcggcaatgagtctatgtaatagtgttattacagtgcgacacagctaggatgtaatggaagatggagcctcgaagtattgagcccgaggtccgccaattaattattttgaaatggtccattaattggagtcagactgccaatttatatatatgttgggctgagttacacctcagcaatagcccaatccgattttttttttcgtttcactccttggcaaagtaactcgcaacccattggcagtgatcaagagttcatgactttttgcatttaggttccagagttttcatgttttggttgcatttagattcctgtgcgtgcttagcctaaatatgtactctccttgccttttgtcactcctccgacggtcacaagctgccaccttgcctcaccatgaacctcctccctgcacgaactcctctccagtctccactccgccgaaagcacaacctctcaaatcgtgtttaatttcccgctgaatgtacgttgctgcaacaatagcaaaaaagttcccgctagatgcacgcctgctaaatgcaacggtttgttgggacacaggtcaagattctgataagcagttgatgaatagtcaatagataagaatataagcattatcgatttttagcttctactttactttctgcattagctagaggtgctagacaactagagaaatcggagcatgagacgccccaaataaatagcttcaatatgcgtttcacaagtagttaaagtggtttatgtgaggttgtcgtccaatccagtttcattattggaggtcaatttgaggtgttagacaagttcatgcatgtgaggaggaaagtgcaaggtgaattggatagaagcatacccaccaaccgagtatatgggggcatcagatccagcacctcgagaaatcttccagagcgatgcgcctgagatggttatgacacgaaaggagatctccgaaaaaatcataagtgggatcacaaacaccatgagaagatgctgacatgctcttgttcgctgcgaccaccagcggacgtgggtataatctgtttatgggatttggcatggttgtaaggatagaggcgaaagaatataacaccaaaggtccacgcaatttccagaaagaaaaacagaacacataaacaagaccacataaggcagcgtgtgacagcaagatcttgacatgcgaatgaatgaatgcatgatagctaacttgctagatcaacttgtaaacttatggaatgtagtacaagaggtgcagctcatccccgatgatatggacaaaaaaaacttggaaactcacaagtcatgaggaatacatgacggcaactgcctacaaaacataatttaccaaccccccccccaaaaaaaaaaggcgtttgcctagctagtaatacaaaactaaatctgaacatcagacaaagtatcaatctgagaatggacaaacaacacatactgccctctttgccccctacgttagaaacatccttccatctactcacgaatgtagatacacgaggaaaatctaagacatgctgacaacctagatctcgtgggaacaactcgaacaagtgaagcctattcattgaaaaacatgtacaaacatacatgaatggggggaggcgctcgcaacttgccttggggaacccaagcaaggagtttgctccctcaccctcctaacaaacttaggaactatggaaggaaaatatccataataacctccgttgaaaatcaaggaaaaagcaataacttagacttttgcaggggtgaagcgtcaagctagcatagattttactctaagcccttccttgtacaacccttgtttttcatacttgtacaatataaatttttacatgtgttatatatcagtaaaagttgtcactaaattttactattagagttatcgcacgaatcatgcaatttttttcttgcagcacaatggctgagttgaatgctgcaagcttgcaacacaacatgtaaaacttggaagtggatttttatccctcgagagaacatcacatatgttttgtgcatgtcgttcaaaaagttatcagaaaatttaaaaaaatttatcaagatagataatatatgatatatcttttcgcaaacatgcgagttaaaattcgacttatacaattcgaaacaaaaataacaaatttgaccgtaaattacgtgttatattcatagtcaaacttgtttttttttctacttgggccgagtttagttccaaaatttttcttcaaacttccaacttttccattacatcaaaactttcctacacacaaactttcaacttttccgtcacatcgttccaatttcaaccaaacttccaattttggcgtgaactaaacacacccttgtataagttgaatttgaatttgtatgtatgtgaagtgatatatcacatatttatctatcctgctaattttttttaatttttaaattttttgatgactttttgagtgcatgtaaaaatgagaggatatccttaagggatgaattaagttttccgtaaaactccaggtatgaacggcttggatgccggccaaaccaaaccgtcgttgttcgtgtgctgttttgcagccgctgtacgagatggccttttcactttccagcataaatagaagccgtcaaatgccggcgtgcgccagtgcgtcgtcggacggcaaccccccgaaagcaacgtcactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtgttggttaaggtttctatcttgtaatcctgccccccatcctatataaggtgggcaggaggccctctagggggcaggagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaaatctagtttcgacagttggcgcgccaggtaggggtgcgtcgagtttcctatcgacaagtgcgatggaaccaatctccgatgtggttgaactcgccaagctcgtttttcccttctctgattcaatccagtcgcgaagatcaatctcggcgacttcaatggtttaatctcctatcaccagcaagtggattcgtggtgtcgctgtgcagccaactggccgtgtcgccgtgagcctactccgccgccgccgaatcttttctttagtcagcaagactctaagccatcagccctcaagcaaacagaggagccatgcccttgacctctatctgccaagacgtcgagtcaggcacagcaagccaacaacacatgtcccggacagcatacgtcatcatatatcgtacacggtttgtcgaaacatgaattcggcaataataaaagggggtagcgcacgagacctaaaagtggatggatgtggagacaaaggatttagacaggttcaggccctctcaatgagaggtaataccctactcctgtttggggaattgaatccaccgggtgtttattgatctgacgatcagattgtcccatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatatatataagttatcccctataactagtcggataaccatgccgtgtgggtatggggtacccataatctccaaagtagcccctaagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaataactataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcgaaaagcaatgatattgtatccaatcaattgcttgataaacccaaacagcaccttgactatataaaaaaagtcagcgggacagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttctgggtaatatagaccaagtgtagctcatatgaatagcttctgatctgaatgattatcccttatgggatactccaaaataaatataataattgaatcccgactggcgcaagtattcggttgacagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtaataaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagccccctgtcacgaccggaaatcacccaacaggcgttcccgacgtgcgtgtattattccttgtcccaggaggcaaggtacaccaaaagttgatacaatacagagtttaacaagcggaagcgtatataaaattattacatgggcaacgaaggcccagcacacacagagacaaacgaagaacagcggaagactagggcgacgaccacaggcacttgacggcaggcacgagctagacaccgaagccttcatcttcaaggagctcctcttctgggcttgggaaaaattgagcaagactgtgtacaaccaccgtactcaacaagacacacccacaaatgcagaataaatgcaagggagtacaagggaattataatataaagggttagggttgcagtaaacagcatttaaagacatttagttgctcaaagctactttgtaaacgcgatcctagaatgctacaaagttattaatcaaggccgtgaacccacacgaacctgccttaacccaaggcctatgatgattcagaccgaactggcaacccgaccctgggtcccagctcgtcctaagccaacccaggccaaccattccacattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccacctacggccgggatacccgggacaggcaggcagaactgagcccctagcagcagggcaccaaccctctgccatatgacatctcgactaccgggccgcagctcgtgtagccttcatttgccctggagaatgtccatcgacacccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcaccccgagcccagcctaaaaccattttggggattttgaatagagggggcggtgtgaagccaattccacaataaacccacaattccagagtatccaggtgatatgaatatttcccaaagtctatagttgtaaaaccacctaaggttacctaattagattgcgaagcatctacctaaaattatactagggataccatgagtagagtgtccactagttgaggttttgtttgtctagggtgaacaaggtagtaataacaataacaataataatatggtcataacaaaggtaaataggcatggctaagtaaaacagtgataacgcgggaatttaaataaagcgacaatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaaatactatttattgcgtcagccgagggagcggggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcggtcggcgggcgaagcggaggcgcggacggagtcggcgacgatgcggcgaagccgaaggaggggtcgccgagtcggaaggacgtccggagcgacgtcggcggcgaaccgaaggtcgacggcgacggcggagagagaggagcacggcgcgagcacgaatccgacggcgagagcgagcggcgagcggcggaaacggaagagcgaagcacggggatcgaatatatagcaacgggagggggagagcgcggccggggagagaggaatcgcgcgcggagatctcggccgccattgaagacgccggcgatgattgcgggattcaaatcggacgaatccgagggagagagagagggaaaagaggggggaaacgggggaaacgggaaagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggcgcgcgcgcgcgcggggagccgatgggccgcgggagaggagagagagagagggagggagaagtgggccgagccggcccaagagggaaggggggggagaaaaagaacttcttttaggattttcttttttttataaaccttttccactttgtttatttcttttcaattattatttgtgctctgaaaattccactaaaatttgtttaagcattttaggcttttaggaaatatacaaaaatcctccaagcctcgtttgacttttatctttgcacattttaattgttggaggctttcacattgaattttaattattctgtggagattatgggtaccccatacccacacggcatggttatccgactagttataggggataacttatatctatgtaatatgtaacagatcatgacttgggtgttacgtttccttgtatatgacggaacggcctaaagtcctgatttaggaaaccgataccgtattggttaaggtttctatcttgtaatcctgccccccatcctatataaggtgggcaggaggccctctagggggcatatatgatgaggacacgacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccacccacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctacctccgtcgccgccgagtggtgcctccgcctacacggctggcctattatgccgccgctgttgggcgtctacgacttcaccgccggcgtgcctccgtcgccgccgagtggtgcctccgcctacacggctggcctattatgccgccgctgttgggcgtctacgacctcaccgccggcctgcctccgccgccgtcgactggcgtcctcgcctatacggttggttggtcacaccatcgttgatgggcgtcttcgctttcaccgaccggcttgcttccgccgccgactggtgttttcgcctatacggttggcggacttcgccgccgttaatgggcttcatcatctacaccactggcttggttccactggcgccgactggtgtttttgtcaccattgatggattgtttcgttcccacatcggctacttctgctgtcaccgagggaatacgacaaagctaagtcatcgcttattttattctttatatgatattttgtcttttcctttgcctcactacatcaactggttcgccgttgactagtgagtcgggggctatagatgttatatcgtattttttaaacaattttcataatatttatcttgattgcttgcgacatgttctgagtacaaaagtgcctatcgagttatggagttccatcttcctatgctttccgtttggtttgccaatagatagttgcctttaggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgattcgtgaaactttgttccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagaggagaaatacatatttataaatattttaaaatacttgcatttttcttgagtattgtatttacatcagatactactcatcctatatgtttgttctgcaggatccaaatccaaatatgcataaaagggattcatggctttaagcttatctcttacgctccaggaatggatcagtcagaacatcaccaccggctcgccgtcgtcgccgccgactggagtcttcgcctatacggttggagtcttcaccgaccggccgccttgtccgccgccgactggtgtttccgcctgcacggctggcctttatgccgccgttgttgggcgtctatgtcttcaccgaccggcttgccctcgtccgccgccgactggtgtttccgcctgcacggctggcctgttatgacaccaactgatgctatcttcttcacggccggctacgtcgccgtcaccactaataggcgtcatcatattcaaacgcaagctgtctacgtctgctgccgactagtttattcacttccatggctgcatgattctgccagtgttgattggccttatcttcttcaccgccggtcatctcgtctgctgttgactagtgccctcgcctctacgtctggtttataccactaccactactgatggacatcatcgtcttccgtcgccgactggttatgccgccgccgactggtgcttttatcttcacaactgcgcgtcttcactaccggtttgcttctgttgccgccgactcgtgttcacttcatcacggcaatgcaactttgtcatcatgcctcgacatctcggcatgcgatgccatgttgttttactacaacaagaggctctccaatattcaggatttctacttggacatcttcaacacatatcttcaatcaagcaatgactactcgacgataagaagctataattctcgactctatgttcagttgtttcccaactaaccaaagagtcgggggctacacaaatataaggctcaaaatttgccaaattttatgtcaagctgaagaaatcaattcatcaaccaacgagtcaactccaggagtcattatcttcatctttgattcggagcagacattctacttcaacaacttcaaatatttcggtttggacgagttagacaacaacatcaactctcctccaagtgaagcatctacaacagccataacattaatttgatggattattgtcactgacatcatcaccagcacttctgcttcatcgaccctgacatctctgctgttgctaatggatgattatgttttcgccgacttattatttcaccttcacggttgacctactatgcaaatgctgatgagcgtctttgtcattatcattggttgctacactgctattgaccggatcaccgacatcgtcatcttcatcatgtcggttgcgtttgtcttcgtcaagtattttcttcatcttcatgattggtggatttcgttattgcctttgatacgtgtctacatcttcaccgtcggcttgctttcgtcaccaccgactggtatcctcgccttcacggatggcttattatgtcgccactaatgggcatcttcatcttcttcaccggctgcctcatctgtcaccgactgattatttcgccaccatggctgctcaattttgtcgatgttgctggatgccttcatcttcactgttggctgacttgtctgctgccgactggtttcttcgctccacggctgtgcaacttcatcacttttgattgctaccatcaatggacaattgtgactacgacagaaggacaagctatatgctcaggggcttactagctcaaacacaagtatcataccttcaagttggacttgttccggatacatgcaacatgaattcatgatcatgggtctattttctatg

SEQ ID NO: 20728 - DNA, 2394 bp, Oryza sativa
tctgttaagcagtgtgcgcatggcgtatgcccaatactttagaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatacgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtgttggttaaggtttctatcttgtaatcctgccccccatcctatataaggtgggcaggaggccctctagggggcaggagacaacctgatcgtcagatctatactacacccggcggattcaaatccccaaacaggagtagggtattacctctcattgagagggcctgaacctgtctaaatcctttgtctctgcatccatccactttaggtctcgtacgctacccccttttattattgccgaaatctagtttcgacagtcaccgactgacagacagcgccgtgttgcagtgcagctgctgtgcgatcgatcgaggtggtgagaccctcccatccccgccacctcgcagccaccgggccgcccgcccggccgcgccccccgatccctttctccctcatcatttcgcgtctcgcgcgcagccgcgctcctgcaagcaacgtaacgcaacgcgcgccgcgaccgaaccacctaactggccacgcgcgcgcgcgcccgcccgcgccgcgtcggcctctccgaaccgcgcacacaaaactgctcgattattgtgagaccgcgagagcaagcgagcgatcgatcgatcagccagccaaccagcccgtcacgttcggaaaaacgggttaggtgccgcgcggccgcgcgcccccggcggattcgtggaaggaatcgcaccggagattaaaagaaaaaaaaaacgagcttcagaggaaaagacgtcctttcaaacattcttaagaaaagaatgtgagcatattgagaattagtaacattgaatattgggttaaaattacacatatcttactacactatctggtacatctccgtaccggggattcatcatgcacgattcctcacttctctcctgccagccatcgcggcgccacagaatcgctgctccgtctcggtgttctgcctcctgtccatagagctagccagcccacgattttctgcctgcaccgattcgcgtgtttttggatactgatcatgtgtgcgatcgacaatcacccggctaaacctgtcatcataactgtgcctcgcacactcgggagactttcttccagcgtacgtagaattgtcctgcgtctcctgcccgcccatggaacgaagtacaacttgcgagagctcttgagaccataattaaccatgattagtcaaaggcaataattcgtgacactaatttcgcttcgtcgatgcgtggcaccgagtggccggcgattggctcggagtaaatgcgaggcaattgatgggttccttcttccctgcagtggtcctggctgaagaaaagggttcttgctgtttgctcttgtggctgctgtgacactgtaggtccgagagaacaatcataggtaaattgtctgcttcatgcatgataactcatgaattatggagttttgatcgacgtaaagggaaaaagatatgattattgccaacctggaattcgttcttatcggcacggattgagaagcctgaaggaacaggaatggaatactgtcaggttttgatgcgcattctaatgaaatattcaggtgaggtttgtaggtcggaattacttatgccgaagtaataatcgacaagtactgaaaaatgtacgcagaatatagatcacagttgaaacgagaatgatataccgtctgggctctgcattttcagacggaattttctgtgctgtatctgaaagcaaaagcaacagcctcatttaaactgtgaaagttaagcagacgacattcagagaagctgtcaattccatcatt

SEQ ID NO: 20729 - DNA, 5000 bp, Oryza sativa
ctgcagcccctcttgtttttttagttttataaatacaagtagattttgcatacaccatgatgatactaggattaaatggtacaaacatttctcttattctccaattaacgtggtactccctctgttttaaaaacggcgatagtaattttaggcccctcagagtaacagataggtaaattaaaggaagccactcatagttgcatacttgcactagtaatctccataagagcgaattttagattgaattatttgatgagctaagttcttaatttaaaagacagtatatatctacccttctctacaaataaattgcactagtaacaagtaacagcaatacatacttttccaatgattgagaagggcagatccaaattattaagacaatgactacaaaaaattgacattacattttcatgaaaaattttttgacaatgtcaaatctcacgtgccataactatttacttccatttataaaacaccaggcttcatatttttttcaaacaggtaggaaaaacagtattattgcattcatatttaaatataaatatataacagtaattttacttttcaccaccttttattactgacattttgctttggattaccgtttaacaaatattttgaactttggattaggtaatcttaccttcgttacactctgggccatattgactcacttctcaagcatataaacgatttcgaatacgtcggctcttactcgtcaatgaactcctatagccgtatgagagataatttctttactataatacaaactggatatatatatatatatatatatatatatatatataaagagttaagggtgatccaaagtgccacaaaaggtaaaattatccggtttaaagtgaaaacattggtaaatgatggttcaaagtaaaacattgataataaaagtggccccaaagcgaaattcattcaatatatgatgatgttaatgtcatttggtatgtggcaagcaacttatttgaccactccttttcaattagaataaaacgataatgtctaacaaaattataatattgaaaagtacttatagagataaatctaccatattatttatatgtttttaaactaaatattttgagagctgttgattatcaaagttttaaaaatttaaccaaattagtcaatagtgtcacatatttaaatacaggagtagtatttacccggttgatgcgtgtagatcgacatccctaaagagaaagttcattccaatttgtggtaccgtaattaaggcaaataacatcacagaaatgggagaggatgcatgttcaagatgatagctaccctgatatatcaatctagttttccttatcggttatcatttcgggtaagctaccaacaacatctcttttcttttggagtatgctactaggaacaacctatgatgtatagtttgatgcatatgtatatacacagtggactaagagcatccccagcagctcttctatctagtcatccatccgatatttggagtatggaggagaaaaacaatgctccagcagagtctccatcatcatatgctctatttttggaggtcctccaaacctagcccttcctaagctaaatatggagctctctctcctcacttcatcctcaactacccactccctaagatcttttttaagtggtgaaaggtgagaggaataggagtaaaaatgtgtggtagttaaaaaatattagtaaaatataggatgttggtatatgtgggatgtaatatgaatgatctgttggagtaaaaagttatatagagtgagaatctttttggatggccatctaaatgagagtatggaggataaaatttagatgagctgctgggatgctctaaccttctcattttctctccactcttgtgaagtccgacagaagtttcggtgcaaaatttgaagggacaattcggcaaactcaacgtatcctatacgcatttgcaccgattaaaaagagaagtaatttggggcatagacttcgctgtcctagtcttcggtctgatgttaccgctgtaaacatcgaaatttataagtgacaattgacatgccgatcacactgaatttcttcctacatttctactagctaggatggcagaaaaagttcagaaaatcctgaattcttcctacagttctactgggagcagggtttcgatttcgaaattggattttatgcctggggtgaccgaaatgtaatttcagaaatttctggccaaaattatttgaaatttgactgaatttaaataaaatttgatcaaattcacaaaaaatgtaaaaaaactaaaaatttcggacgagaattgagcatgccggtggggggcgaaatttcaaaccctgactgggagtataggcagtataggacaagttcagaaaatcgttgaattcatcctactgttctactgggagtgtagctgtttagcactagttcagaaaatcttggattcttcctacaattccactgagagtgtacgacaagttcagaacatgtttgctctcaaaatatatgcatctcaaaatcaaatataccaactcgatcacactcgatcgtatcaagaattaacaggaaagagaaaaacttgaagcatgcgcacaattttcgtctctatgtatgtactctgcaataatccatgcgttcatgaactattcacatggtgccgtactgatccgtactgactatctaacgaagtagtaggtgctccgctccttggcggcggcggcggcggcgcgctgctgctgctgcatgcgcagctgctcgtggaaccacatgatgaactcgtcggcgcggcggtccaccacgccgagcctcccctcttcgtcgtcgtcgccgtccgcctcccacgccgggaacggcgagtccgtgatccgcacctgccgcggcgccggcaccaccaccgcgggccacgcgaccacgtcgccgtcttcgtcgtcgatatccgtcgtcatcgcctcggcggcggcctcctccttcacgtccatcagctcgaacagcctcgacaccgtggcggccgagccgtacggatccgcggcggacgaacggtcgtgccactgcccgtgctgctgcaggcgcagctggctgcggcgctgcgcgcggcggcgcctgtgcagcggcgtgctgctgcagctgaactcgacctcacggggccggtactggtactgcgacacggcggcggagggatccatggaccggcacgacatcgaggagagcccggaaacgcctcccgacgcgctgctgatgccgccgccgctgcgacggcggccagcgccgtgcgcgccgcggccccgcgggtacgggtgcaccgccgcggccgggtccatggacctgcacgacatcgtcgacgacaggtacgtcagcaacgccgggtgctcccgcaaatcgtcgaggccgtggtcgtggccaccgccgccatgccgcctcgaggacatcatctggtgcaggtggacgccgagcgcggcgagcttgggctggtgcttgccgagccccttgacgaggacgaggtacacggcgcgcaccacgcgacacagcttcttggcgctctcgcccgcggtggccgcctgcctctcctgatgatgctggcaaccacccgactccattgccgcctgctcgctgctgctcatctcgatcgaaaaaatatttgtctcttctcttgtttttagaaaattccggtgatctcagctgcgatctcctggaccagctactcctctctctctttctctctgtgttcttcgcaaccaatgaggcttattatcagagaggagacgagagggagaggtatttaaagggggccagatcactagctgggcattcatggcaaagggaaattattggtgtacgtatcgtcttcgtattgttcctttcgtgtttcggacacatgcctgcttttttttttcgtgacgcgttcagttttgatcagtgtgatttagttggtggttttcttggtttattactggagctaactaaggcactatttagatcccgcccaaaaatttttaccctatcacatcgaacatttaaacacatgtatgaagtattaaatataggttaaaaaataactaattgtgtagattgcgactaatttacgagacaaatcttttaagcctaattacttcatgatttaataatgtggtgctacagaacatttgctaatgatagattaattaggcttaataaatttatctcgtggtttactgacggattatgtaattagtttttttattagtatcagaacacctcatgtgacattaatataatacctgatatgacatgctaaagctttacaccgttagatctaactaccccctaagctctaagcttgccgtgtccagaccggatctgataggtacgggcagtatatagatagctgcttttaaattacctttctggagacgctttcagaggtttaccaattgggttaatccgagtgtttaagtagtaaaacacgtgcatatatggcacttgcatatactgtacgcggcgataatcagttaagagagttgttgaatgacctgcgtagctgctccattttagtattactcttttccggttgataatatttgtcccggagaaaatattaagttattgcagaaacattgtcctaaggattttggttaggaagttgacaaatacaatgccaaccgctcgattatcatggctattggacttattgatccagtatatatcaattgagaaaccgttcgataaactcgtcaatttaaaaataatcaaactaaagttcaaatttgtggtaaaatctgtttgagtttaaccggttgctgtgaccgaacgattttctaatccatgttgtccagttgcatgtttatcaatgtcatacacctcaaataaccgcttaccatttttttcggccagatgtatatgactgtactaccatttttatttgttactactactagtttgcatagtgctcatttaggtaagtacttatttttttaaaaaaaatgaagtcaatagagaaacaaataaagtggggctgcaggaat

SEQ ID NO: 20730 - DNA, 10230 bp, Oryza sativa
aaaccactctcgtttcagtcacttttaaaaggctcggatcgtgttaacatttgtgtaaacataataaccttgccattttattcccctcccccttctcttgctcgcctcctccaccgccgctcccacctccccaccctcaccaataccagaagacgccaacagtagtaaagccccactagccattcttctccctctccccctcactatctctcctaagccacgaggcgatggggtaccccagtcccactgtcttccacatctctaatggctctcttgcccatcagagacctcgtcgcctcccctgcctccaaactactcaggatgtagcacacccaccgtcaaccacatccaccaccgtcctccaaccccatggctcccccgccacctcccgtcaccttgtccccacctccccagtcgtggtcaccgctgccaccgctccctaccatggaactagtgggtgaagaagatatggaagccctcccggccgtgaccggccccagcgccaatggcgaggtgaccgtggaggagtggcagtggtgaggcacctcctcgcacgctccaagccacaatgaccaccataatccgtgaacttcttgagaggaggaggaggtgcacgcgaatggagaggagggtgaggagaacggactgacgggggtggggggaaggagagggggagcccgagggatcaaggacgggaggggagaaccgaagaagggggaggaaggtgcgagcggacggagttttttatgaggtgggggctcggcttggctctgtcagttttaattggtgctggtgttcttttaaaaaagagcaccaataatgttagttctttagaaaattggtatctataatctactataggtgtcggttcttttaagaaaatgtagctacagtattggtgtcggtttttcctttagaaccaatacctatagtgttcaaaggtatcggttctatatttctttatcactcgaagatgggaaaaggtccaatgaactggcacctatactcaagccgatacctaacctatactcaaatcgatacctataagggattctgtagtagtggattcacgggttgactcacttacccactgagatatcgataaagtataggcatcataatacataatcgacgaatcgaactaccaattgagttcctcccgtacatctgatgatctgaactgaacattttattattaggtatatagtattatgagattgtttagcttttggatgactactgtaactcgtcacctgaatcgaaaaagtttttcatccctcaaggggatatcttctcgtttcatgcatgccacctaaatagtaataaaagtatgaaaaagttgataggatggataaatatgatatatatcactacataaacatgcaagttaaaattctactttaacaatttgtaaaaaaataataaatataaatgcgaatgcatgataattactttaaattttcctttgttgcaacttgcagaaatcgaatttgacattgtatatttgtagagtgatatatttcatatcaatctatgttgtcttttttttgttatttttttaataactatttagatgctctaaaacttcttatattttagaacggaaggagtagtttgtaagtaacgaggggacgtcgccactacggatgaaaatccacatatatccaccttaatcaaatataattggctcctggcagagttgtttcaggctttgtaaaggaggggtcctctgatactcccctctcgccgtcgcagttatatcagtgatgaaaacgtaagtctctttatgcaaaaaccatgagcctaagcgtacggtggacactgcttacatcgtacacggagccgcatgcaagcacaagctagccacgcaacttggctcatcacaagaacttgtaactatacatcgacatagatgtgcccaccaccttaatccaattattccaatacaccatgtacaccactgatgatcacgtatgaccgtatatataaatatcacgtcaaatgcctgcaggctgcagcagcatctttcagtcactatatatgtatactactactctataataacttgttatatatacatatatacatgcataaatgcgtacatatgtacagatatatgcgtaaaagtatactactacgtaggacctgtataaggatgtgcatgcatgatcgctcgcgtgggcacgcgtacacgtatacgtatacgtaggcaatccgatcgttagacgtaggggagggcgcagctggtggagcgggccatggtggcggcgccggcgccggagcaggcggaggggatgacgtcggcgccggtggccgtggcgcggtgctggcagctcttgcgggcgatgtcgcgcatggagcttgcgagggagagcttggggttgaggcggacggtggagttgaagcgctcgcagagcgcggcgtgcgcgtcgacggcgccgtccacggtgagcgccggctcccgcttctgccgctccttgacggcctccgagcacagcccgcacacccacttcccgtggaagcgctcccgcacccgcccgatgtacctcggcgtgcactcctccgccatcccgcagcactcgcaccgcacgctccgagcctcctgatccgcccccgccgccatcccgccgccgccgtccgagttcgacctctgcagcgccgccgcgccctgcatgcaaaccacgcaaaaagacgtaaatattagagaagaactaatatcaaataattaaaaggaggcttcgaatccaaatcatttagcccaccgccctaaaaagctagccgaaagatttcttgatatttctccatatataaaccacgtagagcacccatccgtcaccatgacataaattccatcgtatttatagacacaactgcgtgtacacgtctataggtgggtcggccgtcgccggcctagctccctccttgtcacgtacgtatagcagtcaccattcatcaccaacctcactaattacaagtacacagagcgagcccatcacaggtgattgtttacttgccattctgattgatggacctatcagcactaattctttgatgatagaaaggcagttttcacatactagctttaattaacaccaagtaacacagtataatgatggattatacgtgcagatcaatgatagctcgaatttgaagagggtcattagagcaggcacaatagcaggctataagccatctagaaacatattttatgagataatagaggagagagaagagcagcgggctagaaatctgtagccagctgcagcacggacttcaaaacatggtgtgtgtatgacaggtgggactatgtattaatagtatagtaaacaactattatatgaattgactattagattggctatagataaattagagttactagtgagctatactgttgaacttctcttaccgtggggggctcagcctgctgcctagccatagccaaacgccaaggcatctcgccctctctctctctctctctctctctctctcgaactttcctttcctaaataaagctactttaatcacctgctaatcaatgagctaagctgtctaatgtgtgtgcacaccaatcgcaagctgctaggcctaccacctggccctatttataggcacgagccgcccgaagcaatcgaggtctcgggttggtccggctcaggtccagtgtgcgcgcacagtgtctctcactggataaaatctccccacgaaaaccaatccatcttcgccaaaggggacgaaccacacccgcgccgtcgagctcgagagcaacttgggggatggatggccaatgtcaggttaaaagttcgcggaaaaaagcgatcaaaatatctccatgctgcatgatttcgcctgatctgtgttgcggtttttttcccagaaaagtgcaccggatcgatccagcacaggagcggatcttttcaagcggccaaatgggcagccaagcaggttaactttctcgtcgattaattttactgctactgttgcatggagtacgattcaggataccagcaactgtcacatacagcagcgtgcacgcacataatcgtctctaccctaaatggtcgatctgttcatccatgcatccaattaagtaagtggcaaaaaggatttattaatgtctgaacacatttatcttgattcttttcggattacggtttcatctgcagagatcgactgcacgcacacgcttgcacatggtgcggcggattggatggggatcgattgatcaagcgggttgtcgaaatcaaattaatcgcgcgcgcgcgcctgtgagcagctcacgggatgcgcatcgcggccgccatcgacagagctccatcgcctaacctcatctccggcaacatgacgactacttttcctctttttcgcctccctttcgggtgcgggtcatcgctcgccggcgtacatcattcgatcgtccgcatgtcgccggtgatttcacctccggcgccgtacgcctagctgaggcgattcaggtgagtgtgtcccaagtggatattgaaccccagcaattggtgatactaactaataattagatatctaaataaagcgtaggttgctgcgcaagatctgcgtgctctttcttgcatgtggagagatcgatcgatatatacctgcgtatgtgcctcactttactagctagctatacgtctcagtactttcgtacgtagtatgtaggtagcacgacatattagcaatgtgtgttgacgatggtacgatatatatatatatatatatatatatatatatatatatttttccattgttagatgtggcaaataactatttaccacatggattcacatgtcatagacacatgacatgaggatccacatgtcattaacacatgtgtggcaaaatagttaaacgccaaatctaagagtgataaatagttaaatgtcccgtaacttctattaattataaaatcaatctatctattgaaagatagtaatatagtgaaagttaaaatttgatggtcaacggtgacaactgacaagcaaatgaaggcggttggagtaattttgtgtaaatactcacatatatgccgtagattctttttttgcaaaagaagataactgtgttgcttaaggagtagcctcatatgatttttttttttgttaaggagttgaatccctgtactcatagcttactgcttcaaaccattatctttttcttgtagcactttagttagttttgttttgttgcagatatatggttcactcttgtagcgatggtgtgtggtcgttagtatcggatctcaatatggttattagctgttgtcgatttctgtagtcgacagagaggtttgtgagcagtatttggtagtgggtttaaggttattgtgggcacttgactaactagacaaagaacacaaagattttttacacaggattagacctcctgaatgataatacggctactcctatcgaaatgtattgagagggaaaaaggattacactttgctcatgcaaggatgttatgcctctctctctctctcatgtgcaaaagcacctattattgcgccacaccaatgctagcgtcgttttatttacattatcctaccttcttcaccttctatcatatcgacaggcgtactgcttccaggcgtctctaactagtcattgtctcgagttgtgttgtacgggacatttgctttcccatctaactggacaggggcaggtaatgatgtatgttatgggtacacgggatatgcttgatcacctgtattttatgtgagaagacttgtgatagacatacgtatttattgtggaatgacaggatgcttaagtgtacattacattctatactcatgtcttgaccaagggacctatagagagacggtgaacaccactactagtagtcgcgaagaccactggagatcagcaaagactattagagatcactgccagcaacgcagagaccatcggagattagagggaccaccgccatagtcactgagatcactgctagtggccacatagaccactttcatgtccacgaagaccattagtttattagcaaatcctgcctattccgagaagagtaggaggcgcatagggcatcttctcacccatgaccctagtagttgtttcgaagattatcaatctcactctatgtagaaaagatataggagcaaaaaatgtggcatgcatgctttaaattaaaatacaatatacacttatgcaccagggatggtaactaatggctgtcaaagttttcttcattgtttaaagaaaatagaaaagacaaataaaaggttgtttcaaatgaaaagtcaaactaattaaggtggtggatatgaattggagcatgaaacttttgttcttgtcacaaaagtacggcccattctcaagtgctcaaatttaggcacttctgtatgcaactttacagtatttttttataagatacggtttaatttacataggaataggaaaaactccggtgtttcaaagcagaccttcaattaggaacatgtttgtttttgccattgcatccatgttccatctgttacctccttgcaacttaaaaaacgacaaaataatccattggcaaaaaagtaactgttcctaggtagcaagaagaaaaatcatcggaatatgaaagttacacgcaatgtacaacttacagcagcatgtataataaaaccaacatgatctagtaattctatactaaaataggaaagtacaatatacagcatgtacaagacttataacgtgaacctgttcaccacttacattaccatcacacacactgactcacacagttatacagctcatgaacaattaaaacttgatgcatgcagcagtgtactaacttgacaaataatgcaagtgcctctctgccgttgtgtcacctactcgcctgcattctagtacaagtctacaagatttctactgtacatgtactccctggagcagctgtgccagtgttggttcattatgttgttgctagcaggaacaaaaatgtgttgtgttgatcaatgttcccggcaccacttttatcgcgatgacacctgcaggtataggctgcagtatgcatgcgacggtagtaattaaggccctgtatagatgggactaaaacttttaagtccctatcacatcggatgtttgaaaattaattataaatattaaacgtagactattaataaaactcatccataatcttggactaatttgcgagacgaatctaatgagcctaattaatccatgattagcctatgtgatgctacaataaacattctctaattatagattaattaggcttaaaaaatttgtctcgtgaattaacttttatttatgtaattagttttgtaagtagtctatatttaatactctaaattagtgtctaaagacagggactaaagttaagtccctggatctaaacaccacctaaaggctgcacacaattcatgtcttgctgttgcaagctcattcttcagttctgagttctctggctcgcacatggtaagcatgcgcatgggatactaagcttggcatcatgccatctaaataagtacgcggagaaatgatatgtagatggaaagaacatacctcttccagaatggtgctaaataaaaagaggaaagtagcacacacacaaaacacctgagatagataggacatacacatcggaaagataggttcgcccataggaaagacaataccgctctaaacaagttaggtttgtgatgtattccgtccatggtattttgatcatctaaaaggtatcatgttaaggtctaaaagtcgagctatagtcttgtcaatgttgagttgaaatcaacggtcaataaaaaagtagacaacttgtcccacacaagttgagataagacacatcttcgatatcatccttatgaatgataggtgtttttagcggctatgatattgatagtgttggccgacctaataattatatatatgatcgacctacttatcaagcaaagaatatgtaggtccgtgacatgtatgaatctgacaggtacttttgtcataaatagacttggatacgatacgtgtctttatttaacaagcggctgatatttcaacgtacaaaacataaagtgtagagtagaatcacgagaagtatgaagtggaaaatataacaccctccttacaattactttttttttctttctgcaggttgtcacatgatataatagatgtttcaagcatctacaaaggctacaaccctcggggtaaagaacccattgtcagtaaacggagtacaaccccgttacagagccataggagtcataaaaccgccgagataatacagaaatgggctttctgcacctgggcctgaatcagaagccagaagaaaggctgtgcgcagatggagaaactaaaaactttgtagtgtactgtgtgggctatgacagcctctcacagcaaattcgcagtatctcaataccaaagacattgccgtggcccaggttttagacattgccgtgacattgatcgttatcgctaaaaagaagaaaaaaaacggacaactccatttactccttacctttctcggttcacatgcggatctaccaacgacagcgaggaccctggttaactgttcgtgcctgctgcaaatactcctcgcctactcggtcttgttgctccatcaggtgatcccatggagtggcagaagaaatgagaagcaacacgctgctcctgctggccggttcagtggacgtacgacgcaaccacgtaccggtgattactgtacgtatatatgcgtagtaaatgccttcacgaaggcacggcaaggtggcacgggaaagatcaaccagtgtcacgaacgccggtgcaactaggcggcagtagctgcctgcgcgcagcaacccagtcagtcagtcaccgcgcgtggcgtgacacggtgtacgtgctcggttgcggccgtagctcatggggttcttgccggcccccggccgtcgcgtgcacgcgcgcgcggcggcagacgcctcgatcatcgatcattcatccgtcgacggcgacacacggccgcccggcctgcgctgccacacgcgcgcggtgcccggccgactgtgacgcgtgtggattgggcacgcgaggcgaaacgtaaggtggaacgcgccgcgtgtgcgtgcgcgcgcgggggacgcagcgcagcccgggccacttggccgagccgcgcgtcccacttgggcacttggcacagccgcgcgcgtgttggagagttggacgccgccgtttcacgggcgacgggcgcaagcgggcaatttgaatatttgatggtgcgaagcactgttgcgtacgtatatatgcgcggctcagaggctgtttgcgcgcgcggaattacatatgtttccatctggaaaggataactatgtactagatcgagtatcagtgagaggatacgtactcttctgctgcttcctggtgtatatgtcctgtgttgccgccttgccgggccaactgttatcgtactgtagtctgtggaatgtactccgtacattcatcagagcaggtacaatagcagcagactattagccagctataaacatattttaatgagataaaatatgaaagataagagcatcgggctacagatctatagccagctgcagcacggacttcaagacacaatgtgtgtgtgacaaatgggactatatattaatagtatagtaagcaattattgtatgaattggctattagagcacccgcaatggtaaaagaaggtctcagtaatagactagattaatagtaaaccacctcaatagtatgtctacataggtatctatagctctatcatgcattgccttgtttttctctatagactatctctaagttagtagatagctttgctctctttcttcatttaatatctttcaagtagaaaaatatgctgacatggatctcttgtagagagcttatagataaccattgtggatattcttagattggctatagatgaattggagctagtagtaggctatactattaaacttgctctcagtgtttaattccggggagataaaagctggaaccgtactggttactggtttgtagaccagattcatcaacttgcttgctgcatggcagtaagccagtaattaatggacgttaatgtgttgctcatcgcttactctaccaccttgctattcccaggctccccgtatggatcatgcccaacaatcaattgattataaggaaattattttaaactctcgaggatacatcctctgcttatttacatgtcatctaaatagggctgcaggaa

SEQ ID NO: 20731 - DNA, 616 bp, Oryza sativa
atgcctattggatggatagtttactcgaaaagtgagtaccatcacatactaacacttgataattgtgtgtaccttcattttcattgtggttattgccttggcataatggaggagaatttttgccataggacatccaactgacttgctgacttgcacatggcaacaacctttttgctgtaatttaattaatttgttccatgcaataattgttgaaaatattgttttttaatctagaattctttcctatcctactacacgtaatgtgcaatgagggttggcttgttgtttatgtttagtttcatttgttcttccatattttgtatgtggtgcttcatccttgtgcaattgtgtatgtaccggcattctaatgttggtgcttgatttcaggtatccaactgacagcgataagcagatgcttgctaaacagacaggattaactaggaaccaggtaaacaaccatttcaagtttttcttttcccaaatttatatcgatgtaactagctagtccgctacagttgtccactagcaatatctttgggtccataatgttactagcgttgtaaaacattttgatatctcaattcttgagcaggtatcgaactggtttatcaatgca

SEQ ID NO: 20732 - DNA, 751 bp, Oryza sativa
cgcccgaaaccctagcgcgccgccgtcgccgtttccttccaaatccggccgctcctttccttctccggccgaattgattgaggggaaacaatctccgggatctcctctaccttttctcctttggaaacatcggctaaatcgttttggaagttcgtggaatagagttcgattcggatcggcctctttccttcaagccgcgagctttccttctcgtcgccggccgccgtgggcctttgccgccgcctccttgcacctatataaggacccccgagctcccctctacccgtcgcctcctttgccttagcctgccgtcgcgtctagcgccgcctccgcgtagccctagtcgccgccgtcgttgccgtcggttcagccgcgccgcgccgccgttgcagtcgccgtcgtcggtcgccgtcgccaccatcgggttcgccaagtcatcgccgtccccgtccaccgcttcgccgccgccgaagaccgtcggagcgccgtcgccgtcgtcgacccgaagagcttcgccgcttcctcctcgtcgccgccgccgtccgttggtcttccgccgccgttttggtcaccggtgagttcgccgcgtcgtcctctacgtgctggtgccctccgtttgtgccgaagtgccgccgttcgccggcgagcgtgcgccgcccgagctgtccgctccgccgagccgccgccgctgtcggtgacgtcatcgctggcgtcatcgtcccttttcccgtgagccggtcgtggaccgatc

SEQ ID NO: 20733 - DNA, 834 bp, Oryza sativa
attatgccgccgctgttgggcgtttacgacttcaccgccggcctgcctccgtcgccgccgagtggtgcctccaccaacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggtgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggtgtctacgacttcaccgccggcctgcctccgtcgccgccgagtggtgcctccgcctacacggctggcctattatgccgccgctgttgggcgtttacgacttcaccgccggcctgccttcgtcgccgccgagtggtgcctccgcctacacggctggcctattatgccgccgccgttgggcgtctacgacttc

SEQ ID NO: 20734 - DNA, 9625 bp, Oryza sativa
ttttttcgttttaaatgtcaccacgtgcattttcaggttaagaataaattaattaatgcatatacttcttgtttagttttagtggaattccgatagaacaaattaaaaggtcccattctggcaactgtatgggctgcttatattattatgttaaatcttagttgcctggttcttatcactcatgctcagtctgaaccactctaccttaatttgttgcaatctgcacacatttctgactctgaaaactgcacgtcgtcgttcttccatttctccatatataaattcaaggtgattgtactgcaaatctgcagcatctcctactcctagctgtacatgattgcagggtagtacgtactactaaaacgtacctacctaaaattgcagatattgttgccaaactaattaaaatatcaatatgtatacatccagatagaatattgtaacgtgtgataccacaagtgcagtttttaattgggcaagctgggtctgaagttaaatattttcaggttatctgcttgactgcttggcattagaaattggcagtgtccctgtaaagccagctattgtgtcagggcagagagaagagaaatgagatgaggcaagtgtgctaatcagctctcagctcagcatggctgctgcatgcttacctctgatcacaatactgattcggccccatgagtgagaagaggcgtctattttatgggcagacaattacggcttacacatgtggtgcatacaataaggtacaatccgctgctgcttagcatataatatagtgttgattagaggtatattttatatggtgcacacacatgttgctgggtgttggtgtggcacaggaggcagtggtaatatatattggccagttgctgtattttggggaggttgttttgtttgtgggagaacagcatgagggtagttggcctgttggactcaggaaaagggcctttttgccatagttaatttgtacttgaatcacttctagaaatgcttgtgtttacatcgatcgggttaacaacttcttttgctgtctttgttatggagtgagctagcttccatgctggattaagagttaaattacaaacgaactaaggtctttggctagctaattaaggttatcatctgtccatggggtttttaatatgttctcggttggttgatgcatgcaactagttaaccaggtaaaatcatccatggctaatccttgattacttaattggccgattaccacttcacaaaggagtaaacaaacccaagttgatcccactgtaaggtgcatgaatctcccacattatgtttgtgaagggccagcagggctccctgtggattggttgagcactttgttgacccgtggacaacgctagcttagcacggggtgtgtgcactgcgcacacaatacatctcaagtggacatatataaatgtaggaaattagcaaattaaggagaagagtattcttttcttttccttgaacttgtgtgtctgctttaatttggttgaaagtgttcgtcaagttttgcagtgtcatcaatccaaacccttaagcatgttcaacacaccatctgcaatgttttccatgtcatcaagaaaaaaaacactgagaatctggtatatacaaataaaagaaaacattaaaaaaagttgcactcctttcggccacagatataaatatttctaggttatttggcaaatattaaggtagattagaaagtattttaggcccatcattatataaaggatggttaggagaggaagggtgattgaggtaagatgtgaagaaatttatgtgagaagtaattgatgtgacaaataaatactctaggaatattatattcatagataaattaaagaaaatacttgaaatgcttttttttttcacgaagaatgatttttttaggctgaatgactaaatagatgaaatatttatagtaaattatttgagggtataagcaaatgaattagatattataaaattgaaaatagaattagaaataaattcagatataaaaagttagctacacatacgtgcgcattcatccatcattccattcctcaaaaaagtatagagattttatcacttactacatatatctactttttatatatacatatatattacaaaattgtttaaatgtatctttcaactttataatatttaattcattcatttatacccttgaacaatatttattactattttttcatctattcaatcattcaacataaaagaaatgccagtgccccttctttccacacatgtaaatattccaactatttgaaatccatccgaatataaacattcagtaccacttaatccatcgatcatctttggttcaaatttcctcctatcctaataaaaaatgtccctacaagcattttttaagaagaaattgtggacgtgttagggattgaacacaggacctcaggttgaaaccacacaccccttgctactgcactatcaagtgcatctgctctatcctactcccaactataattccccccccccccaccatccctcgtttattgagaggcatcaaagtttcttttactcaatcttaattttatctatgctagataaactaaaaattaatgtgtgtatttgtggacggagggagtatagttacctctactttgaatttgctcttaagcccggcatcccagtgcagggttaaatgcatcttccacaatttatatccgtttctcttagcgatctgtcgacctgcaatcacatgccatgcatatatggtgtgcattaacattaattggagctcaaaaggttatatagcaagagaactgaattaccaagagtaattgcactgcggcttacagctagcaaaagaactgcatttattcagtacgcttgtagtgaagtcaaagtaaaatgtaatctaggatgaaatatattaatcattttgctgaaaagtgatagtactactccaatgcattagggcatctggaaaaatcagtatgaaatgattgggacacatggtggctgatcaatttggtcaacttttaaaaatacagaaaaccgatggcagagttgattagaaatgctcaattaaaccatctaaaccaagtgttagttttgggtgaagttaaatgtctcttgcgacgatggcgcgaagtttcagtttcagagaactaggggactcgtcagagcacttgccctaagagctaagatcaacaaaaccataaacaactaaaataactgttctaaacgtcctacgtccataagcttgtaaaaactggagcattaattaactaattggagagaacacaaaaattagagtaaaatttgttaaattgtttatctgatgatcgattgcaattgggctggtagctagttgtatttgcatgcgcgcttctgataatgacgcgctagatctgtaaagatcgactggatgacttaatagtcgctggtcagactacagttaacgcactgatcgatatatacaatcttggtgacacatggattctgaatgatttggatagatcagattcagaggcaatcctggatatatctcaggatggttcgccatggagactagggaagataaagcaactgtacatctgcacgcatgcgtattgtccgtgtcaccaacatcaacatctactgatttgtaactggcagcttatatagatttatatgcagcaaaatgtacaataactgggtagatcaatcagcaacttggcacaaagcgcatgcatactttagtttgaccagcttgatcgtcagaacacaagtctacgatgtgaccatatatggggtgaagtcagcgcggggcaattcctttcgcaaatacgcgtcaatttgacgaaatccacaagtccatgtacatacatttcgtttcattcttactacgctgtgtacatgtcaattgtcaaggttagcatagctgttgtactaccgcagtttcctacatgtcctttgtcctctccttcaattttctactacaaacactgttcctaatttatggctttactgcggtacaccacaatattatttgttggaagtttggaagagttcagcacacaggacacatatatactatggccacctagccgtcattattgcaaatttgcaagtaacatgaatgcatagttgtaccaaattaagtacataatatatggtacaggtatacagtgtatagtactatagataccatgatggtacacatatgcaaatgttgatgtgcatacaccctagctaggcatgaaaatgaagtacttctgaaaacactgaacatatgctaaggtagctagattaggcccccagcacccctgcaaggctgcaatcataatgcttaagacacaagcatgcatgtggtaaaatgagggaggagatcagagaagggggaagaggaagctaaaaaagctggacagggatgtggataggtctgttgcatagaattgtttgcacgttgtatagcaaagctagcaatgcaagcagcaagggaagttgcaggtgaatattaatgaaagtaagcagcctttttctagctagtcttaagagaagctgcatgcttctgctgcccactgcatagagaaagtcctcatttgtgctttaggccttcatcagaaggaggagatgagataagagaagagaagagataattcagactagaacagaaatgcagagagagctagctaggtgcagccaaattaaatagacacccttcactctttccattacactgcaggcccaataggagcactttgataggcatcagcatgcaggagcaggacctctgctcccctttgccttttcatggcgccccatcttatatgcaaatgtcaatgtgtcattgtgtctgtatgcctaggtacagctaaatataaaagtagcttaattcagcttgatagctatgcataccagaagaagtcaagaaaccatgcacatattgctcaagcattagcaagtaaatcatggcagtacattgacgtgtgcatgagagggaaaatgacttcaattgatggatgtatatatcgacaggctaactactacaggtatcgcattagcagaaatgcagaagagttttccttttttttttgtcagtaatagctccattggttgtcctaataagccaaaacagaagctagaatttaaatttttaaagttaattgtaaagttgattttaagatattttcaacataatttcttttttatattggtttttaggtcgccacgaatttttattgtataataaatattttttgacttattaagaaatatgggaaacgacgaggatctaataaaacactcacagcaagatattaaataactgatgttatatgcgggggaagcaagtaccttttgagccgatcaattgaagcatcacatcacttgcacgtcagggccacttcatgaaaccgtgtatggtttttccgggtgttgcttaactccattttctgttcatatcctgcacacatgaatgccctgattgagcgaacagtgttgtgccttttgcacagggcaacaagatcgagaggtcccatgtatgcttgcaaggatgtgtactactacaccatatttcaggcccattaagggtgtgtttgaggagaaggggattggagagattgggaagatacgcaaaacgaggtgggccattagcatataattaattgagtattaactattttaaattgcaaaaatggattaatatgattttttaaagcaactttcctatagaaattttttgcaaaaaaacgcaccgtttagtagtttgggaagcgtgcgcgcgaaaaacgaggagctttctcacccaatgtcactggaacgaacacagcctaagcttactatatacccttagctagctagctagctagggtccttcatatatacgtgctctctactttagcagagcaaaaatttgaagaagaatctaaggtgaataatcaagcatcattaagtgagcatggcatctaataccaccctctcggctagctctagctgtatacatatatagagtagctactctagtctttatgtaggagctaggtttatagtacagggatggatcgatctctccctctcatctggcccctgagggcgcgggatggaggtcggcgcggggtcccggccggtgatggatgcttgccgtcgcgtgcgatgggctctctgtcgccgtggcatatggcatttagctagtaaaggagccacaggccggtgaggggaccggcgcctttgagaatgtgactggtgaaggctgggccggggagagctaactagcaagtgaagagaaggcagaatcaagcaaggccaaatgaatgatcgatcctgcataagtattacgttgtgccaagatggacttgacagtgcagtgacaagggatatgtgtttttaacccaagatcccatgttcaatcctccaatatgcttataatttcttttaaaaaatgtttgaaggaacatatcttcctccaaatctttttttttcttttttattaaggtgtgcctaatatactgactgacctgccatgcttaggctcccccccccccctctctctctctcgcataatggagggatctttgggccaatgacattccgggtgaggtttggcgcaagaggagcagcatatttctggtgttttatagggcatatgcacatgccatggaccaccaattatacagcattgagggcgtggccctttcaacatcatcagaacctttgtgattgattggggtctagtactatcaaaacctagctattacactagatttgtagtactaccttctaagtgttactccctccgtcccataatataagagattttgagttttttcttgcacagtttgactactcgtcttattcaaaaaattttggaattattatttacttttttgtgacttactttattatccaaagtactttacgcacaacttttcgttttttatatttgcataaattttttgaataagacgagtggtcaaacactacaagcaaaaactcaaaatcccttatattatgagacggagggagtattgttttagactctctttactcttcagaaattttagatattaacccattttttctcttatgtgatttttatctgaatgctatcacactcatcaataaatgaggtatcttgacactttcttaattcctatgcccaaatctaaaacaatttatatttggatttggaaacaaaagggaactagaagtgtttatgtttaaatacttctattaaaaagatagcaagaatcttcccagtttgcaagagaagttgggcacccacacactagcagaacaatttgaacacggatgcgtatccccagacactatccatggttaaacaccctagaggcagatggtatcatatatatgcgtgcagtatgaactatgattcatagtgaagggtcaagtgttgtcaatatatactgtttgagatatttaaccatttgccacatttagatgtgacaattaactttttgccattagacccacatgtcatagacatatgtggacccacatgtcattgagataggggtggtaaatagttatttgccaaatctaacagtggcaaatagttaaaagcccctgtactgtttagattactccaaattaatattagctgaaaagagatcacatatatgtaccctatatatgtgttttatataaagtgtgcgcgcacgcatgggcagtgcatacgtgactcaactagcttacttgctaattgactacagccatacttcaaatttttctggctataactccgcttctgataaaattttttgatgatacatcgatcatgaaatcagcattttttttaatgatcatttgtttatatgtacggatcagtgattttatgcagactatgatgtaggagcaactggcctaaacctaggccactaaactacatacattgtcagagcttttgtaataaaaaactggatttatatatataaagaaagaactgtatgtacttgatgggccttgcaattttttttttaaaaaaaagctagggttggaggagaaagctgcagcctgtagataatcctaatggggaacctgtatatgtttgataaccaaatcctttttgggatgataatctttgggctgattcaggggctccaagttgggttttgcttgtgccaggcctgcaaccgtccactttgggcagctggagtgctggaccatgggcctgccaaactattgtttcggtcgcttctacaactacgacactgcaccctgtcacctcctgcccatcccgaacgacgccacgtcaccctctatgcacacaagaatccgtcgtacgaattgtgttactaccttcgtcgcagaataagaggaaagtaaggataaaatgataaataattgtattgggatttaatagtcttttttttattgatatatgtgtaggatgagtgaaaaataaacttattttcggacagaaggagtcctaagcaactgcaggcaagtatggatcctagagaagtgctctccaagggataaagtggaacaaatgatttgaaatagtgggcattgctaccgggttgttcagatagcaacagccaaatatgcagctgatgccttgaatcccctatcaaattgcatattgactgtcctatatctgcaaactatccaccacaatattccccgcatccaagcgatacaaaatatcttgagttaaggatagaaaaggaatacacatacctccatatcttgctatattagtgggcacgttgagttgagggagatggcttcaaatggcacaccttatcaagctgatcgaaactacagtcgacatcattggacccacgtatctgcggcagatcaaataccagccacacccacagccacagttccacctctgacctctccctttcactatgcaagttttctccacttgatcagaattgtgtcacggcaggggagcaaatctgacattgctgttgctcctgctgtatgtagcccctgcaactgggtcatgttaaaagggggaaaaaaggaaatggcaatgagggatcagtcctgtcctaaacagatactccctccgtcctacaatgtagcaacctaggatagaatgagacccatcctaggactacgaatctggacatgagacatccagattcgtagtccgacccatcctagattgctacattatggaacggagggagtagagatcagctgtcacaaccatcggcttactccaactcaattgcatcggtttgcttctgcttccacaggaaatgaaaaaagacaacatccatgtaaaagtcgtactctcctttttttcccctggtacacattgtatgcaacatctcccctcttttcttgcatgaattgcttcttcctgccaattggagtggtaaacagtaaacagactgttacaatgcagcttgaaaaattcagaaggcatcctggacgatgaggttgaaaaattcaggaggtcttcccagcatacaaatcgactaaaaatctgtgttctagcccatgttgagctgataggctcacaccaaccagatccttggctggtggccggtgctattagctccattaaagatttcctctagctacattgcaaacagtacagatgtcctggacccctggcttggatattagagaagaggttgaatactaaatgatgtggaactgtactatacgtccatctccaccagattgc

SEQ ID NO: 20735 - DNA, 10505 bp, Oryza sativa
aatcagggcatcactcccatacctgacatcaaagaacaaaaaggttcaaaatcctcgcagccagctagaaaaggggcattagggtgtcacaagtgaaagaaaaactacttcctccgtttttttaatatatgacgtcgttgactttttgagatacgtttgatcattcgtcttattcaaaaactttatgtaattattatttattttattgtgacttgatttatcatcaaatgttctttaagcataacataaatatttttatatttgtacaaaaaaattaattttgaataagacgaatagtcaaacgttggtcaaaaagttaacggtgtcatatattaaaaaacggaggtagtatataacagtacacaaatcatggaactactaaaaagctcaaaagagattaaatatgaaactactaaaaagtacatgtgcaattgtttcaatcataagaatcaatagggcacacatcacatttacacagaagctcataagtagcacgagttgttgaagttcagttcaagtgaccaaccccgacggttgatccagcaaattatgtcaccattcctgcatacatagacatatttaagatttggaacatatatacagtatgaacttaagctgtagttacctttccacttccaaggactttatggatgaagagaagtcttcctggttcaacccgtaatggataatgttctgtttgataataatctgagtctgatgacccatcgtctgaatgatcttctggtatcccctccggaattttcaaggattggaaaaaccttaaagcatcatcttcgagctgcttcgtattacttgctgcttggcattgattagtggtgtcatctaatgatcttatattacccttatcgcacacgaaatctttgtgcctagccataacagtaacatcagtttgctttttaatactagatagaaacttgtcaaagtccacatccgatgagcttgaagagcccgataaacgtttaacaaacgaatagaaaggtgcagcagtatcaacatcagttttacttgattccacccgctctttgataggttctaccactacagagttcatgctatcatcaccagacttcaaagtatccatactaactgcagcagtattatcaaaaccatttgtttttttgttattacttgtttcctgctgctcctcatcacttccctcgccaaaggaacatatactatcaccacgggatctcaaaactctcaattgagtaaagacaccagcctcaacttcatttgcaatgcttctatttactttaggagattgtccatcgccagtattaccttcctcaggtagcaaggttgcactacagatagtgttttctttcacatggttttgttgtttgctaggatcatcaagcacttcatcacataacaagctcttggatttggacaagctagaatcttggacatctaatggaatagtaggaggtgcaccttcaagattatttaacttccaaagtaaggagatgctaaaaattgttgatataaatcaagccttaatagacatgcaaaatatactgacctgattgttgactgtgatatttcagtgcaagttccatacgggcaagttgaagttcatacttgagtttacacatggaagcttctgcttcgatccacagattcttatatgccagcacatgtgcatctttatcattgccagacttattttcctctatagatagattctgcaaacaagggagtaaagcacatctctgagaagaaaatcactattgtccacactaagcagatcgcaacaatattttgaagtcaatccaggatataatataaatcaatatctgtaaaatagatgttttgaaatctgtgataatatctgacagaacaggttcaacaaacttttgagcctggcaagtatttccatcacaatttatcttttccagttttgattgaaggtagttgatattggcatgatcatcgtttaatagacccttgcatgagacatagcataagcttaaatgacacaagaaataatttgattttcattgttgagtagagataccaccaaacttttgtttagcagattagcattttcagtgagcataattccaaaagtcctttggcagagttattattagaaatggaagtcaacacagtgtgctaggcattaaatttcttcagataatacagggatcatgttaagcttaaaatggaatatcagtcattgtgaatgacctatcatttatccaccatgacaacgcaatataagtgtagctatttttagcaccttcagaagaaaattgaagtgaggataaaaccatcacaatttcaaaaaccatgtacaagttaaaagctataaacgaaaaacgttcaacacagatgtgatatgaagcatagctgttaaatacaagttccaaaacttctattgattttaagttaagcaatcagtactcatgaaaaatataattataatcagtatgggtgaggtaatgttcaaaagttaaataaaatatatgtttttttctcaaaacatgaaaaaaatgaaatgtgtaagaaagagtctgcatcacaccttgcttctttttggactcagagaactgagattttgtatggcagattgaataagttcttgataagattcgtccaactcataatcaccattgcaactagatataagcgctactgacaaattgtacattgacttgattaactctgcatgatagttacatctgtaggtgatgttctcacaaaatgcattcaggtcctcctgaacaagtgagtgatgatgagataaaggttcctgaactctgctcataggcacttcagaacacagaatttcctgtgaaaaccttccagttatagaattctcaccaacattacaagtctcgccagaactattagctaaatagtttcccactattcccgtatcgttagtacatctgttccagtcgctgcaatgtctatacgcagtctgaaagccagcatgatctttctgctcatcctgcacgctatcaaaatgaccaatattaaacctacatgggtttgcatattgcaggaatcgacccttcaaaacaggatcacttggtgacggatctattcttttcatgccacatactacaggtgaggcagcaacagatggcatggataggccataattcaaagatgttgagcaggacgtaagatgtgataggtggctatcataagaataacggccatcagattgatgtatgggaacaggttctttgtcgaagcaatcaataatgctgggaaacaaagaaggcttatggagaactgatgatccaatctcactggatgcagctgctgaagttctttggtgaattactggaattttctcttccagccagcttgatcttcctgttgttgagggaatccagggatgcagctgcttgatggaactaaattgatcctccgggtatacattgtgtagtgcactatcgctaaacagaaatccatcggtatttgcagtacctgcaaattaatttggtttgtcagttgtatacaatgaaatttttgtcaaagccttggtgacaatttcttgatgtttatatttacacacgaagatagcaacaagagaaatagtagtcctcttgccaccgtcaaatcatctgtgacgctgaaaccaccaagcatcagtaacaacaagtgaacaatcagatgtctctatatgtacaactttaatgccacatacggtgagactccatgcactaaacaaaatctttatctaagatgatcacatacttttagaagtaaaaaaaatcttaatgtagtatttttagaagtaaatcgcatagttaactacccaccagtaattacgattgtcctcgaccgcacacaaaattccagttagtatgactgcacaccctaaatctacctcttataaatcaaatacacagcgtaacgcgtaaattaaaccagtgtaagatgcattcatgaactgtcaccactcaccactaccacaacacccagaaaccaaattaatcacgcagcacgtacagatacaggccctaatcacgggaggagcgcaagctagctcacctgcataccccgtctccgcgataacggggtgcatggagctcgccggaggttgcgccgaagacgagtagtacgatggggcggtggggaagtcgggccacgggctagggggtctagggctgtgggattggggtaatgttcagcgaggcggtgacgatcgacggcgaaaagaagcgcggcggagggccaggacatggccgcgtgcggcggcgccggtgccggctgggggagcccgcgatcgccggaggagtagggcatcatctcgccgccccgccgcgccgctgggtggaaatgtggaatcgcgtcgccgaagcgtgcttccgatttcaattgggtcggacgcccaacgccgcgtgggccactccataatgggcctcatggaccgtggtcggtaggctcggcccaggaagaaatgaggatggaataagttcatccgaggtcccttaacttatcgacgaatccgattttcgtccttcaaccggaaaaccagatacaacgggtccctcaactattaaaaccggtgcagactaggttccttagcggtttagatagcggttttggctgacgtggcgcctacgtggctaatttgactaggtcttcatctgacgtggcattgacgtggtgcttacgtggcaattcgatttggaaaaataataatatatgtgggacccacatgtccgtttcatacaccaaataataaaaaatggtggggcccacgtggaccccacatgtcatcctcaatcccctacggctgctgctgctcttcttcctctgttcttcgcgacgcggctcctgacagagcggggtggggggagcggcgtgaatgctgtcgcggcgacgctgtggcggcggacttgcgggaggacgcctcctagctagcagcggaggtggaggcgaacatcgcctttcccttctatgggaatccgatgatggagtccgagaccaacgccaacgcggtgcggcgcccacaaaagcggagagaggcgggagctctggagactagggtcgtacggaggggcacggagcagggtgcgcgtggacgagtgtaacatactgaaaattagctattttctaattatgcatcatgccggtttttatgttcttattaaccttctaaacctaggaaaatataattagagagagacctccaaaaattaacttgcataaaatccctctctggtatttaatttcttttatgtctttcctttaaaaatatatttggttaaattaaggtgtttctcgacttggttttaatttaaaaccttattttgacaaaattccttttattcaaatttagtttggaaaccccttttcatttgtatgaattatggtccaagaaaaccctccaaacctacactgtgcaattccaactttaattggaattaattgtcgacccatcctttgattctcgatccaaatattcaaatcctttcttttaatctagccaccaatttaattcttgtggcttgattttcttctcggcacaagaaatattattattgcaaatattatgaataattgctcttgtgctaagaaaatagattatatcattgtcatccaaatttcctattagcctcaaacaattctttgaaacacatgccatatattttgaggctaaaaccctacttatccttctccaattatcttcttcccaccttcctatttacacattcaattttattcatatatcccttaccctttcatttgagtgcatcaaataaattccattatatgctacctctaaaatattgcactcaaataattaggaaatatctctttggaaattatctccaaaataaattcatctcaaaggttagccacttaaatttcttccaaatattaatttggattttaactccatccctcaattccctacacaaattagaaagccttcctattcatttgggccgaattttctctcttccttcggcccagaccggcccaagtcggcccagcccctcccactcaagccgactccctgctcctcctcccgtgggtgcttccaggcgccgccaccgtgcgccattactgccgccgtgcacgactcagctaccgccgccgccatcttgccgtcgaagcgaaggaaccgccacccgacgtcagctacacttcattccgccgacgtcagcaacagggacgaaccgccatcgtcggccaatcagaggacagagcccgcgccgtcattcttttctccacgtcgctgcagccgtgtcctcatcgaccttctcctctgaaccgccatcagccaccacctctcgccgcctataaatataaggcgagccctccccttttctccacacatcaacagagcctcgagctccctttctctctctccatccatggccgatcgtcgacgccgtcggtcgatctccccatccgtagctccacctcccctatcctcgcgccaccggcttcgcctccatccggcgagtccgtttttcccctttcccctctccctccacctttaagtcaagccaccaccgccatcatccatgccggctcgaggtgagcccttgccgccgccgttccggctatatatctctccctctcggccagccaccgacctccccgggtgcgcgtcgctcgggaacacgcgtggccgctgtcgtcgaggccgttcatccaccggagcatcggcgcccctcctctcccttctctctgtttgctcggctggaagagaagaagaagcagaagaaggaaggaggaagaagaaagagaaaagaagaagaagagacaaagaactgacaggtgggcccctgtacagtactatttcataatttccctatttaattcaaattctattctttagaagtccatatctcctaaaccgtagatccgattccagtgaaacttggacctaaattcatctaaattcaaaatctacattttgatatcaaattttctattttaagattttatttgaatttattcaaataccgtttgaatttatatttgacttttcaaatattttcctttatcccaattaccctttagccactaaaaagctgtcggttggaactttacgccttccatggagacattcgcggttttctatccccgacgttgaaccgttggttgtaaagcccggcataaaccaaacccaaggtcaaagtgctgctcctggcaccccacgccttgatgcgtatagcggtcggagcttcactattccatcgacctccatagcacgccgcacagttagctctcggactctgtgtgatcctagccgctccgctgccacccacggttgtcgaagtaacacttccgccctactaaacctgcacctacctcctattccctctagccgatatgatgtctgctgacaccggctagagaagacactaaatctagtcgttatgttgccaactctagcaacaactagcaaacaaccaaatcctagccgataccctgctagtcaaatcccaattgtcatccaaatttcataccctctacaataccacttatccaccatactctcagcctcatactttttgtctatcagaacctatacataaaatatagagcctggccgatatattgccctactcctcaatcggcctaaatataaccaaaccctaggtataatcttacacaaacctaccatcagccaataccagtcacatatctgctcaaccaattcaattatccactatactccctatccaccaaccaatcaaagtctgcacataaaatataggtgatcttagccgcttaattccctctccaccccagctgccaactctttataacccacacataaaatatcagcccagtaatccatataccctataaaagagataggctatacactaaatcctaaccctcccaaccgtttatctctttcttgctattttatggcttttattgaatttggttcttcctcttctgtagtagagtctattatattttggatggcaacctgtggtatttcaaagatcagataatcaggttgcctatctcgcatttatttgcgttggagcaaggcaagttattattcctctcctttgagcataataatcctatattctatatttccagtatcttgtgcattagccatacatgattctaaatgcataacctgaatatatagcaaaccagatatatgctagattttgcttagccatgcctagttagattacataaaatataataaacttagattggaatagtacggtagaaatggttgatttccgggtggctagtactgttccaaccgacataaaattgccaagtacatgtgaagaacatacgagtacgaccgcaattctcgtatgggcatagacctagctgattaagttatctagcaaaggtggtacctctatacaatggttctattttaagtcctcgagcaggaggcaaatttacgccgagcagggcgattgtgatatttaccgaggcacaggtaaatatatgagatttattgatgtcgacttgtttgtgaaccctgattgcgatgacatggtgtcatacaatcagttctctctaaagaccttgggaacgctagaactcctctcgctgctgataacgttacgttcagagcgtatggggactagagtttatggaacaggtaccactgatgttagtaaccgaaaagctttgccatgacaaggctaatgtgtttggcacgtcatggattgcgggtaaagcgtacatttactgcagtaaagtataaatgaatctattcgaatagccgtgctcacggatttgagtattgagactcatatggtatttggttagaaactttattccaaactttattaaatactgttgcatttaaaacattttaggctttcttcctctatattctttgctttctgcaagtaaacctagctctactcagatattaccatttcatgcattcattattgaatataatagcttgctgagtacgttgtactcacccttgcttcaaccctttttttttccagagtcaatttaatgttcttaccgaagccgggagttcaatcatataagttagtgtcatttcaatctaattctcaagtctagattagatagatggtttaagtctatagcaaaacattagagttggctcattctatagcttctactgtaatagttagccacaaatttgtaaatacccgtatattttgtaataacatctcctctggagccttgttcaaatgtatgcaatgaagatctagattgttgaacctgtatcaatctactgatccagggcttgatacagtctaaacatgtcggtttccgaatcattagtttcgggacccgacaacgagggggagcgccgcctgggggggagcctgctgcggggtcgccatggccgccatgggtggaggtgaggagggagacgagtggattctccatgtctcgatcgccctctcctggcgccgcgaccttccgcatgtcccgccccaacgtcgactacctctacaccaagctcaccgccgccatcgccaaggaggacgccgccctccgagctgccatccccgtccgccagcacgtcgccgtctgtgtccgatgcctcgccatgggggagccactcagtaacaggacgcggtgcttcccggcaggccatggagctcatggagggttaagatgaaatttactgtgggagttcgcttggatatatatttttttaaaaaaatcatgagctgcaattaggagtccgatcgtctcaagttaatatgcgagtttttttaaacaaatttcttatatgattccttatgtattaccaaaagtgaacaaaccgactcaaatacggatatgtatttccaaaagcaaacgaacttaaaaaccgactcatatacggatgacgtaccaaaataccggcaaaaacatcttcaattgttataatagtagagatttgggtcaaattgccacgtaagcgccacgcaagtgccacgttggacgaagacctagtcaaacaatacacgtaggcgctacatcggtcaaaaccggggtcaaatactgccgagggatctcgattgcactgttttgaaagttggagcatgtgttgtacccagttttccggactagggacgaaaatcagactaagcgacgaaaatcagacggagtgacaaattgagggacctagagtgaacttattccaatgagagtactacgtacttcagttggactgggccgagaaatgcagatgaaattcaggcccagttacgcgtggggagcatgagcatgagcatcatcttcgggcagctgctgctgatgtgttgctgtcgacgtcgccgctaaccgtgctttcagctcgtgatccgatcagatcagatcagtcgatcaatctcatcgcctccgcctgaacaaattcccggggtttcctgctttgcttagtagccaaggaataatccgccgagccgggtatgtacgatcgagacgacgacggcataaagcgtgtacacgccgccagccttgccatggtgatggtgtcgtcaaaacattaatattcccccggccggcgaggctgccggctagtgcgccgggaatct

SEQ ID NO: 20736 - DNA, 5050 bp, Oryza sativa
ccccccccccccccccgcggagcgctttctctctttctttctcacctgcactactgactactgctgctgctactcgaattcgacccattcagctgcatttgtgctgcgcccgcggtatggagcagcagctagctagagtgaggagagtagctagcacactggtcgctagctgcttctggatgatggataagggaatggatgccattctcaatttctcatagcaggagagagagagagacatatggcgatgcagatgaatgcatatgcgtgcatggatggaattggctagggggtgtttttgattttacttaattcgatcgcgacgcctttagctatgttgccaaatattcgagcaagttgaaatgggtggtaaggtgaactggtcatgtgcctcgctttctatctggtatcgtcgaatattgcaagtggatagaagatggtaatttactgaacgtaacggtagtcggcaggtggttttctcaaggtttttcaggtaagcaaacatttgtggagtatattttaatatatgtgtttttttttaaaaaaaacattgaaagactcctgaattttgcatatctgcatctcatgtcctacagtaaaacagttcagcaacaggagcaggctacttatgcttattccttgaactttcactgtacataaaacgaaaaggtgtttcaagagtacagcaactttcaacttaataggagtacagcaacttaaaaaggactgaagtttatctactagactactatagtcttgtaaagcagagagttggcagtttgatatttttaagatgtagacttgcagaggcagtgaacttccatcttgttttactatcgaccccttcaattgcagattgtagtgtcttgtgagctcaacttcagcagtaagcaagtttttcttgcttttgatattctcagcttttaggatacgttactttgcacctttgaggtgcagttctcttccagtgttctgccctgacacacagtacttgtgtttgttcagaaaagcactggcttttcctctaaatctgactttgtgtttagatctgattccagcatggcactgcattccattcgaaataatagtttgcttaccttcagatacaacttaaaaattacttactggaaaagaaaagtatattgaatgccaaaatgaaatttcctaaagatttttacagtactgcatccacagtggaagttttaacatacctgtcgtggaaacgataaagcagagaatatattaggaaaaagacaggaaaaatatttctttcagaaaaaaagaaacaagaaaaaaggattggaaaactttttcaacaaagtaactttgtctctatcttctcttgcaaaaaaatatcaagaacgttctttttaaaaatatcctaccaaattgttattaaccacctaagaagtactttattccatggggaaaaaaaggtaacatcaatttggattctacctaaagtttatcagaataattatccttaacatagacatatcttctccattaccacctttttttttgtgaaatacacagatttttatcttcaaaattcccttttgttcttctccatcacctgactgttcatgttttagcaaatcccagtttcaccattgcaatttcttccatttttcatatgactaacaccaagctgaaatttgttctctcctttattttaataaagctaaagtttaaattaggtgcctacaagaataagtactttcaaaggctgtatatattatctaagtcctttcaacaactttgccatgaaagaaccattcgtacatccaaaaataacccaaatcccatcatttcaagttcactcagcggaccatccatccagcatctcaaagaaaaaagaaagggaccatccatcagaaccaattataccccattactttcattcaaaaattataccccattactgatcaagctgaatacactaactcaaatggaagcctgagggagagatgtacaatgattatagtgcgcaataagaaattaggaatcgatggttggtacttaaagttgacaaggcataaatctttcaccaaaaatttaaaagataatcggatggctctgctcagtgtaatctgaataagatatcaagctgaagaaacatgaaatgggagacatgggacaggcccctgattaaatcaaaccaagacaggaaaacactggtcaaaagagcagctttaggtttaagttgcttaattagttggcataatgaggacgaggccatagccgaaagaatttgcagctgcgcttattataatcatcagataaggcaggcactattcttaacagtttgaccattgaggcttcaaatatttcatcatgtaggtgagatcaatcaaattaatggactatagcttgatcacatagcacatgttcgccgcatgaattcccggcaccgcatgtcaagttgcactacgttcaattcgattacgtgtagcgcatttcctgataaacgcattgctggaatgctagtagtcactagctaattaagcatacgtgagcaaacgattcgacattagtttttgcaccgaggtatgaactgtgaccatcctatgctaattcagccactaacaactgttttagcattgccaacttgtcttgtcaactcaattatttcacaagaaaaaaaaagactacctaagatagctagatgctctgataaaagcactattattgcatcaacactgtgagaggttccaaagctggaataaacacggcagcaaaattcagaaaccaaacagacaggataaaattacacagagaaagcaaggaaaaaattcctctgagagtcacagagattgctaagttaagagcacatgcaacagtggtgcatgccctgcgtacaaaagcttggacagaataagcacaaggcataatatcattgagggaggcacgagctttggaactcgttccaaagcgacactggcttgaaatctgaagaagagaagaaaaaaagagtcgcgagattttttagaatatttcagagaactttgcctttcctcccaaacctgacatatattcctccaacaaacacttttcctgccttctgcaccacttctctcagccggtcaatcactaagcaaacacttcgtttttgcagagaaatcagtcactaaacactcttgatactaaacacttgataagcctgcatttacataatctcttgtctcccacgctttgcagtgacagtgtctctgagtgtttagtaggcgttgcaatcgagcgtgagtttcgaaagggaaaaaaaatgacaccttgcatgcgtgattctgaatttccgaccattgttctgttgttggacaattggtattgtaatttgtaaagaaacatgaagaaacgggaacgctgaaatgtgaacttcaccaaaagacactcgctgccattcgtgtccgttctgatgcaaaaaggctagacacgagcatcattcgccagctcatttccctgcatcttgagaatactcgtctctctttttctagcataattagtacttacctgtaacaagattccaaggattaatccacggatgatgtggcagaacaggtgtactggatcaatcctacgccctttcctcacaaaccgggggccccctttcacccccatttcaagcaataaaatgagggggaaaggcaagggttctacactacactgccactgcaacaccctcttctcctcttcctcccccaaaaaaaagcctataaaaaagtataaaaccattgcaccatcgagcaaggcagtagcagtgatcgaggagaataaaagcagaagtagtagcagaagcaagaaaacactttgagcatttttgttttgttctccttgcagttacagctgaagcagcaagcagaagattaaccctcttggctaagattcaggttaacctgcagcgagaggttagctcagctcagcttagcttagcttaagctttgctcgagcttgccgtgcactccactgtctcttttccggtggtataatttggtgcggcggtgagctgccggccatgtcgaccgtctcctccgcgctgtcgtcgttcctctactgctgcttctcccccaccggcggccaccggcacggccaccgcgccggcgcgtactactacagcagccacccgacgagcaccaacacctactactacgagggtggcctcgccggacgcaggatgggcaggagcaggccactgtcactgcaggtatttgttcttcttcagcttgctcgttcgttcttgctttgcttgctctgttcctcgcttcctctgtttagctatgctacgcatgcagaagacggacatattctttgttcagatgaatacgtatttgcaagctagcttgtttatgcgatattgcgattgcgactagtcgtgttcagattattctcctcagatttttgtccgccacttctgatgctgtctcctagcttaacgctaattaatttcctagcatatgctcgtagcgataatctgtgctgctgtgcacgttgctgtctagaacagcccgcgaaaccaagctcatgcatgcgtgcgaaaaagagagcgataaaaggttgaaggaaaaaaaaagggcaacttacataggacaagggaaacttttccctcggcttgccgcatgcgccggtgttggagacagtaaaaatgtactcgtaccagtagcaaaatactacagtaggtgtatgtatcattcatgcgtgcgattgattgaattgctgcatgcgagtacatacagtaaaatatgaacggttgtctcctctgttttcccccagacagtggagctcaaggttcggatgtgctgctcaggctgcgagagggtcgtgaagcatgctctcatgaagctcagaggtatagtttgcaaatctcaattatcataaaaagtttttgaatcttggcaactaagggtttagatcaatttgttgtgacaaatttttttggcaaaagttttggcgggtaaaaaatttggcattgaagttttactaattggtgcatagatgcatggtaaagttttgtcattttactagcaaagagagagagagcacggctcccaacgtg

SEQ ID NO: 20737 - DNA, 8313 bp, Oryza sativa
  unsure (1)..(8313): unsure at all n locations
tttggatctaaacacagccgtagttaaattcataaatatggataattctgagaatcgggtttccatggacaattcatgtgatgatgttcctccgtgtgagtatagcaacgaatgggatgccagccagggtatcttcttgtgctcgtagctatagctagcagcagctaggtttggtcgttggtgattgtggttatgccagtttaaatattctccactgctggctgcatctgcacgatgatttgatggatagtactactccagccaccacagagagaaaaagcctgggaataggacgggagcatgatggtgttcgtggagcctgcggaacatacaccaggccaccagctgccaaaactcagccgccaacaatagtgaccctaaaattaaaaggcttactactagcttcgagctcttcagttcaaaattgaggaccgattttagttacaaactttttatttgaacttctaactttttcatcacatcaaaacttttctacacacacttctaacttttctattacatcattccaatttcaaccaaactttcaattttagtgtgaactaatcacaccctgagttcactcttccaactttatcagatatataggcactcgattcagaaattccactctcaaaaatcataacacacacgaacgtttgagcataagaattcaatctatctttgaggtttcaaactaaaatcaggtggtttttgtggtgttcatgtataagctcatctcctcacgttctactccaattcacgtgtgtataggctgtaaattaaaaaactaaaatttcggcccatatgtttacatgggccgtgacgacgcctcgagtagcatattggcctgaagccctgaacacggatgagaaaaaaaccggaaaaaacttggccgatctcctcctcaccgcacggcaaaggctcctttcccctttcccgcaaggctcccacgctgacgaaatcgacgccgatttcccgaaatccccaatccccaatccagaatccactcgcttttcgataaaatttctgttgattgcgtcgaaaccttcgcaatcctctcgcacgcatcacgccttgcgcgccgcatctcgtagccctgaattttgatttgattctgctgcctccggcgcgcccctgattggcgaggaggtggtggtggttgtggtgggtgcggccatggcggcttcgacggcggcggcggtggcaccggactggtggaacgacgtgaacaactcgccgatgtggcaggaccgctccttccacgccctcgccacgctatacggcgccgtctcgttcgtcgcgctggtaagccctagccctacgggacacgttagaatcgatttaggttttgaaaaacatgggctaataataggggaggatattgggtcgtgtagccgagcagtttggaagtttcgtctttaattgtctcgatcgagggcttagatttgatttaagctgatgttttgtgcgggaactttgtagcttaccgtatgcttgaattgtatagtgatggagacatgggcatcagtctcatttgagtcgtttgcacttttgggagaatttttgcaggtccaattgatcagaatcgaatgtagagtacctgagtacggatggacgacacagaaggtgttccatttcatgaactttattgtgaatggaggtgagcatacttttgcactttgccactgcttcattgatacatgctagctttttcggaacttcagtttatgattttggactggtttgtttcagtgcggtcaatcgtgtttgtgctccgacgagatgtgcaacttgtgcagcctgaggtttgtggggggaacagtttatgtttctctgacttgtttctgcaatttttttcgaaggtgcaaagtaggaatgatgcgtaaccatatggcattgtaggtatttcaacatgtgctcattgattttccggggcttgcattcttcacaacctatgctctgttagtgctcttctgggctgagatttactatcaggttagttttacttggatatattttggttttgtcccatgggtgtttttgttctcattggttcatgatggcatttgttaggcacgggcaatgtctactgatgggctcagaccagctttttatacaatcaatggagtggtctatgcaatccaggtgactttgccatccacatttcttactgttgatataattgcttctctctacaaactcatacatgaaactcattatcatgacaattggaaaacttgttactggacggatcatccattgataatgtaaagtgattggatgagtcccaattgaattgttatgtttgatagtatgctatcagaaaaaaggttaaacagagaaaataaagcaaacactatcataaaaccctcgaaataagttagttagcgtagcatgattccaactgactaaatcttgactgcataatgtacaattactcatcattgcacaaatagtttattttattgtggagacaatgatggctgttagcttgtggggactccctggatgtacactttctgttgtgctacattttggtgggcatggatgtcaaattaacctaccacttgccattcagagcatttttcagtgtggacatgttcacaaatttctaccgtattgagagcatatttcaatacatagaattacacaaagttttgctacctttcctttttgaagtacttttggaatgatctgatctttgcatgattttcagataatactttggatggcgttgtggtggaaaccagttcgagcaatggtcatcttgtctaagatgttctttgcaggtaaatcttgtgtaatttgccttgtcttgcagttagtatggattttttattttgaatgagagcttgtggaaatcatagctggagatagatgggaaaactatctgatcataagttaaaaaaattctcgcgtacgtttagttcctcacatcccctaaatattaatgaacatgaaggaaatacattgagtcatgataaaccaggcgtagtgcaattttgagttttcttgttatacatgataatttatcatttattctactaatacaaagttatttgccagcgacatctttatttgctgcccttggatttcttctctatggagggaggtaagctgtccttggttttcttatttttgttgttttgggtgtttgtcttttgaattatggacaagaaattagtatgcttctgaagttatttcccacatgttatgtccatgagcttttgtatattggattatttggaaattggaagtaggcatgcctgggtgggtgtgcagttattgggtactggttgcggtgattcttttcatagcatgttacttagtgtaattttgtggttatctttgtaggctatttctgatgttacagcgttttccagttgaatcaaaaggaaggcgtaaaaagttgaatgaggtactatcttttatcattggcttctattccagaattaatactttagataatttgcatttctaacacatctactttttcataggttggatatgtgacaaccatatgcttttctggcttcttgatcagatgcgtaatggtacgtcctatgtcaatattatgttagggaggtcttcagactttaattactccacttaattagagcatcttacagatgtgcttaaatgcgtttgataaagaagccgatcttgatgttctgaaccatccaatcctaaacttcttctactacttggtatgtcttcctgttcacttgctttgtactcaaccttgtagttttatacattgtttttgtttatctcgtggcatttatatcttgatctcctctaatgtcattgttgtttaatgttagaggctctgtgttggtcattttaatttgccatgttcgaatgttcacatcgaggaaatcatttcttacataattttaactggtgtcaaacaagggataatgctagaatgtgatatagacttgtggaagatatgtttcttttgcttgtttttaccctgattggaacatggggcacatggtgggtatgctgatatcctaattaagtgattgtgtttacaaaaagagctgaactgaaattctgttgggaatgtgactcaaggaaaaatggttttgctacattgtataaaacaagagaggaaactagtgaaagctatttatttggcagaacacagaaattgtatgtgcttatctgtgcataagcattccaaactatagcatattgattttgccgaatgagtttacaaaatgcttttgctgttggagtatattcagattgtatgaagtaattgagactcaagacagtcactgccatatttatttgcttttgtaagaatggtcattaaaaaatggcttgccaagaataaactgcaaaagcaatttctttgtcgtgttattttgaatatgtctagaccaataattgtacttactgagtgcttgttgatagcgttcattttctctttggcagttggttgagattgtaccttcagctttggtgctgttcatattaaggaaactaccacctaaacgggggatcacacagtaccatccaatccattagatcagtccagggatccccaatgtgcccttgcaaattgttccttcaaactggtgagtacagaaatgtaaatcttaaccacggatttctttgtaggtaggttgcttggttttcatgtgaaaaaagctcaacaaaaattctgggatatatatagtttgtaaaaagtctaacatcccgtcatcccaaattcctgcaattgctgtactgcgacccaggagtattctgcaactacaggttttcttctgtaaactgaaggacaaatatgctttgattatttgtttgattatttgtaataatgtcagctttggtttattgttcctggtaaaaagccccttgcacgcttcctcctgactccccagtggtacacattgttcattactacctttttttagcctggacaatactgggcaatgttgtgttccttggcagagtattttcccttttacaccttcctgttcactggattgcttatacaagctctgatgggcctggatgtgtagtagacattgggcctcgttaacatctgtaaacttgagcaactgatattccaaagttgatcatagtgcgggaagtctagcaatgaactgttgagaagagaagatagatccatgttttgctatcaaacattgcaattataggttttgccacccaaaaggtatttacatacataatttgctgagttttatgtattacttttagtttcctttgttttcaatctggagatcattttcaaattgatcattagctgaaactggtagaaacaggacagatgtgctgagcccttgacattcaagaaatttatcaaattttcatcacccagttgtcaaatatgtttgggtgggtatgagatataggcaccagattgattccaatgaaccaaagccagtttggtcgaatccctaataattgtctgatcaaagaaagagagaaaaagagaacacatcgaaggtgacgaatcatgagtgaaaccgccgttaagcaaatcatattacgaacagtggcagatgatcatataataaggagtagcaaattctagagttgcaaccttcgagcgacaaataggcctaaggaggttggagaaaattacgaacctccaggtacaagttaccagtgttattagtcctctgtccgtcccaaaatataagagattttggacggatgtgacactatatccaaaatctagtgtcttacccgtccgaaatcccttagattttgggatgaagggaatacgtggaaggaacaaatgagtatatgaaagaaaatgaaagcacgcacctgtcaatcaggtcgacagcttgtatataccgggagcatcaaattcagaaccacacgaacaggttgtccaattgacagcagaggaatggagacttggagagggtataaacaaagctcatcttcatcttaggccttaggagtgcatttttagaggcttctattctgactggtagctgtgtgttcctgttgggaatatctcaatccaactgcgattcaactcccaatctaactgccatttcccgtttctgttgggagtagtagcgttaatgacgttggaccagccctgctggactgtttatgaactattgtacgtctgaattagtaattccaactctgctttacttgtccggacaaactctgacgaaattcttgtaaagatcttgtgaaatttgaacattccatatttccattctacatctactactgctacatgcaacacaggattctggtccaagacagtaaaatgcttggatgctctctcggatgccggcagggggaagggatcggcaggacgggcccaacaggaaggactcgtgtgcagacaccggacagagtgagagattgctgtgctttgggcagcagatgtgtcagtgtttatccatccattcctcggctaccttttgacagcaagaaatggatctccatagaaaccgcatggccccagcgaattcagcatccacggattctttgcttggatttgatgttcttcttcttcttgtgctatgctctctccttcaggccatccatcatgctcaagtctgaatactgaatccatggctttggctgatgctgtcatccatatagtgtgtgtgtgtgtgtgtgtgtgtgtgtgttttaatgcatgattcttttattgaagtgcattttctgatgagtagttaccgtggatgattgacttctaagcaagtgcggagttggtaagttgtaccacagacagacaacacgtatctcatgtacagtacagttcagcagggtaacgtagtacccttgctaaccagggtcgacagggactcgcagtagttgtaaatgggacatatacactgatagtggtactgttcattcattgattaacggctacacctacacctttcctttcagaaacattattgtggtcatgttattaattatagagaaaattgcaaaaaccaccccgaaagtcacttgaattttgacattccaccctataagtcattttgttgtaaatacccacctgctactaagttttgtttcaaaaaccaccccaatgcgcacgtgtttaaccgaatcaattcgttattgctgatgtaggattaccacaggctaagctagccaagtcaatcttgtctaagtgcttgcattagacttattttccatatttgattgattttttttttgcatatagcaaaactcagtgcaacaatgtttaggctctcgtcaacaattttatatgtggaatctcacaaaaaatgtatcacgaatactctagaagtatttagttttggcaaaggccatattgatggctcacattttataaaaatatgttgattcggttaagcatatgtttaccggggtggtttttgcaacaaaattgagtaggtgggtggatatttgcaacaaaataatttatggggtggaatgtcaaacttcaaatgacttatggggtgatttttgcaattttcccttaattatatgccaaagtagcaaattactccctctgttctaaaaaaactctttttagatgccatagcaacggtcacttaacacattattcaggtaatgttttttccccaactgtttttactgaactgattagtgctaacaaaacgagcggtaactcgccggtgatatatttttcctggctgaagtatgatgctttaccactgaattacatttggggaaaatggcctagcttagagtagcttagcaaacatccacacacaaaggtgaaaacctacaaagacaaccctgcacgcttatattttggaaagtagtatgtagtggtagttggaagatcaccatccagaaatgcgttgagctcccaacttgggacctatgcgtttgcaggaattagtggactatggaggtagttggtgccggccggccttacacttctttttttttttttgaacgaatgccggccttacactcctgaatttgctactccctttaaatttcgaattcagacggcatggattttgattataaattaccactagctcgtagcagatggttcttggccaccttatccatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20738 - DNA, 631 bp, Oryza sativa
cgccgtgtagggcgggcggccctggctgttgtagctgatgtagttccagtacaggcggccgagttcatggtccgggtccacccgcagcaggtcgctcaggtccgcgtacacgcgcgcgtacaggcgctggcgcttggacgtggtgtgctcttccaccaggaagccccagttgtcgcggacttggttgaagcggtcggccacgtgctccttcagcgcgtcggcacgcggcttgaacaccagccggacctgcgcaccgtcgagggcatcggcatcgaagcctggtgcggccgaggcgatgctcagccacaggctgtccggggtgaggatgcgatcgcgcaggtccagccacagcgtgcgcgcctgccgtggcggcaccgacaccgatacatcgatcatgtcgcgcgccggccagatcggatccttgatgcggatgttcagcgggatcagtccatcgtgggtgggcggcaggtccagcgcgggaaggtcgatggccacgccgtccaggccgtcgtgcatgttctcccagctgtaggcccagctgcggatcagcggctggttggccggcgcgtcacccaccccggaaggaatcagcacgtgcacgatcggctgcggatgtgcgggcagggtgccg

SEQ ID NO: 20739 - DNA, 415 bp, Oryza sativa
acagctcaccgccgggggtattgactggccgggtgaaggtgaagtcgtcggtgggcgaggcgccggtaccggtcagcagttcggcaggcaggccgctgtcggtgtacgggcggttctcgcgcagggtctggaccgaggtctcgatgtccttgtagaacaggcccaggcccgccatcgcgccttcggcgaagtaccactcgaagcccaggtcgacattggtggcgcgcgtcgggtccaggttgggattgccgctggagatggtgcgcgcaccaccggccacggccacggttgcacctggggcaggctgcccaggcccgggcgggtcatgaccttggccgcacccaggcggatcaggaaatcgggcgtgacctcggccaccaggttgaacgagggcagggtgtcgggctgcaggaat

SEQ ID NO: 20740 - DNA, 659 bp, Oryza sativa
  unsure (1)..(659): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggtgcagcagtatcaacatcagttttacttgattccacccgctctttgataggttctaccactacagagttcatgctatcatcaccagacttcaaagtatccatactaactgcagcagtattatcaaaaccatttgtttttttgttattacttgtttcctgctgctcctcatcacttccctcgccaaaggaacatatactatcaccacgggatctcaaaactctcaattgagtaaagacaccagcctcaacttcatttgcaatgcttctatttactttaggagattgtccatcgccagtattaccttcctcaggtagcaaggttgcactacagatagtgttttctttcacatggttttgttgtttgctaggatcatcaagcacttcatcacataacaagctcttggatttggacagcta

SEQ ID NO: 20741 - DNA, 640 bp, Oryza sativa
ctaaccagtatttatccatatttatgaatttaactagtagtatttaatagagacatcaatacgatgttggtatattagaaacaaaaaaatactacttttaaaaaacgatattcgatcaattggctttagtttcgggcccattgacaatttgcagatcgacagagagtacgtacgtacacagagcctggctttccattgtgtaacccgtaaagggcgccactactcattcgatattgccacactgactgactgactttagcatctgctactactactactccatggacacacagcacactacctgacctgtcaccacggcgccgagcacaagagagaacacacaatgatgatcacacacactcgatcgatctcactgctactagtagtagtagtagtacgcgtgcaatgcgaggcgggcatgggaatttttttacatgatggagcaggcgttgacgtcgtcgtcgttgaagaggttgctgacggggtcggcgccgcggtggggctccgggaggtggccgtgcttgtcgccgttgtagccgtggcggtagtagttgtagctggggcggaaggactcctcgtcgtggaagtagtccttggccgacgtgaagtagagcggcaggtctgggtttggccagaactc

SEQ ID NO: 20742 - DNA, 704 bp, Oryza sativa
ttcctgcagcccctgggcgcaccaccacggacacggagccgccgccgccgccgccgccgccgccggcgccaggtttctcctgcctccctcctcgactcccatctacgaccaccaccgccgacacgcccacgccgtcgggtacgacgcgtacgccgcggccaccagcaggcaggtgctgttctaccggccgttgccgccgcagcagcagcatcatcccgcggtggtgctggagtcggtgccggtgcgcatgacggcggggcacgcggagccgccgtcggctccgtcgaagcgagttcggctgttcggggtgaacctcgactgcgcgaattccgaacaagaccacgccggcgtggtcgggaagacggcgccgccgccgctgccatcgccgccgtcatcatcgtcatcttcctccgggaaagcgaggtgctccttgaaccttgacttgtgaagagggtacggccgtacacgtacacgatctctgctactttatgcttcaattctgctactacgtactgacacaaatggaaatcgtcgacgaagagtgtgaccggagaagtaaacaaaggcggcgatggcggcgcgcaacggcggcggtggcggcggaggtggaggcgcttggagcatctagcgccttcgtatttcgtatatagctcatcatctctcttaaattagtcagtgcagtgtgagggggaacagtttaagaa

SEQ ID NO: 20743 - DNA, 9743 bp, Oryza sativa
tacgagtttatatatgtacacttgttatatatacatactggtgatgagctagctatagctaatggagattgttacattggagagcccgtactctacgcatcatgtatactgggcacatggattgttcttggtgctgccgttgtttgtgcaggtcaattgggctctccttccaaggcatcagcaacagcagctatagctagctaagctgtgatgaagagaagagaagagaagagaagagaggagaagagaggagaagaggcctttaaaatgtggggagcgagccagcctgcaggccagctatcaagctaggacaggcagttattggagggctgcaggtcagatcctaaatccttctcctacacatgcatattacagtctctcactcctctctcactccatatgtatatatgcatccctagctatacatctttctctctccctctgcacatcactgctccgttcttgatttggtttgcgcatttgtctcttgtgctattccttctttcgtcgtcgtccctgctgctgcttctgttgctgctgtttcttctgcgccagcaatacactgtgcaatgtgtgaaatgttcatcaggccggctagctagctactagctggcagcagaactctcatacacaacatggctagtttactgtgcagtgtgtgaacgaaatgccaaggttaatttgtgtgtggaatcccaaacctttctgcgagcaaggagtgaaaaaaagggataaagatgtggattagaaagcagtagtagatccttcttctctccttgcctcctattgggttcttccttttggtgtcaggaggaggaagagagaagtatagaatctccatcatcccggccatccatgtggatagacagcaaaatttgcaggccacattgcacatacactggttgcgcatgcattgcatgaactgaacttgcaggactgcaaatgcacacttgcatcgatatggtagaattaattctgcttcgctccccgactcattcagggtactgggtctgggcgtacgcagtgataacagaagaaattgattattgcgttgatagtagacgagctgcctttttctgctagcttttgcccatgagtctaggactctagcctctgccattaatttctgagtgtcatgctgggtttatatgtacaactggttagctagctgctcatgatctatttaggtcattgtagagattgccgtacgttaattaatattgatactttctttgattaggttcaggctcccatgcatatgccctttgtcaggaattcagtattttcagtctgattggtgttaatgtatcagccttttagcatgtttgcttttaacatagccaatattcaattctattcctatatattggcagatcattctgctgtttcttctgcgccagcaatacactgtgcaatgtgtgaatgtgcatatattatctatgataatttccctttttagcaatgaattacgcatcacaaattataaagtgtttgccaattattaattcgattagtttttgttcctaagattgaatcttcatgcagcatgcatattttctgtacatatgtaatcttgctttaattctgcacaattattttttagaaaaatccctctgttaaacgcacatatgtacatatataggaaataagaacatgcatgtattggttaaattgagccaataaaagttaattgtttaattgattgataaattaaagcacattgcatcaatatatatataagtatgaagaaaagacatcagatatatggtataatcttacaagatcataaagttttagtgtatatatcattgatgtatttataagagcctatagcttaactagatcagagcatatgtgcacattcttgaagcgtaatcaattaatctatcctgtatataggagtattaattaaggatatgtttaattagcaaaccatatcaaattatctaaggacttattgaactgtatgcaagttgaatattggcttgatattttggattatcaatatctatacaaagtataaactggcttcatgaaacactgaataaaagtaccagatatatatcaacataaaacttaattagcatttccccgctaattcttcctgtcatgcattagttacttcgtcaatgctatggtgtgcaacaattaatgtaccattaccaaatattaatttgtttcgaccaacgtacatgcatgtaatgtttgtgttaataataatctgtcactgatagtatatgaatttaagattttgatgagtgatatggttttgagaagagcattttatgcatgccttagttttctgcttctctctatcatgcccccttttcttgattattttcactcaatttcttctgataacccgattatttggtttttatatataagtgtgaaaaccgtagggctatatatatggatcatatattaattcttgcatgtgtgcgtctctctcttaaataaaaataaagctgcacatataagtttggttgttactcctacataagtatcatattcacgtacgtccaaacgtcagcctaatttttcctgcgtgcatgttaattaattaatttgttttacacagcaggtgtggttaattattattaagaatgcaaaccattactatatgcatttggctagccctggatcggcgctttactccttgcaaccatgcgtgtttcattgataaagtagctacttagatatatatgaagttcaattctaattaagctcaaaagatatagaatttattatatagttaggactgaggacaaagtaacgagtttcttcgaatatttatctatatatttatattgttaattaacagaaattgaaaaagggacaccccacattattctagctagaaacctaattaaaaattaccactttaataggagaaaaggagatatttgcattgtcagattttaatggttctagactataacgatgtgatttgattaatattgttacaattatatatgtggcaacagaagctaattagagttttttatcaattgcaatttctaatttaaaatattgttatatttataaattacaactgtacgtgttatggagatagaaactaaaatttgtatatcaaatcaaattgtactattgtatatagatttcaaatatatcaatggaaaaaagaagctaaaaggtgtgaaactaaaaaggtgtatatcaaataaattgtgtgggaaaaatccatgctagttcattaattaccagtatgctgtcccctttttttagataatgagtatactgtgccctttttatgtcttgtttttctaaatccagtgagaggcactctgtctagttcacttgaaatatgtgcaccatatatatatatagtatgcttgatctctagatatactagtattaattaaatgatgaaattgaagtgaaccaagaaatgtcttaaatattttttttgaacgaatagaaatgtcttaaatatcacatataatgaaacgcatgttgtaatttctttaattttctcaatgtacatatgtatcttgtaggatttgctagttgtaattttggcataatctttcgattaattaggcatcattaactagacagagtggtcctctctatatatacacttgatatgtaaaatattgttggcccgtaagcattcttcagagagagtactaaagttagctagctagggacagcgggtatattactatagctagctagatcgatgcatgatcatgaagtacagtaggagacataacacatataaacaaaattcaaaagttgttaaaacgtacgatcgatgacatatggtacattatttgtgccacattgccatgcatatgtaaatgcagaaaccgatcgtttttgaacggcatgtgtatgcaactgagaaatgctgtgtgtgatgcatatgtatgcaatacatatagcgatatccgtagatagaccgattgctttggtctgaattaatgcatgctgcaagtttggatcaatcgatcttctggtgcgggtgatcgacggggaaacggtgagagattgaaattgtagcgtgacatgtatgtatgatctcgctggcttagctagctgcaactaccggtgccgtcactgccgtgccgatctttatatcgctacgcatgcacggtgtgcatggaccatcctaagtaggggagggagcgcatatgtatctcggggacgaccggccggccgcccgcggatgcatgcatccatcaatgcatgtgtgtacattgcatgagaggtgtggggacactcctacttagctacatagctagttaaatggtgggtccagcctaagcattcgatcacctagttcctctccttccaatttttatttttttaaaaaaatgcatatatacatactctccctgtcacataaaaaattaacttctgtctataaatctagatacatgtacgctacatctatgcatgttcgtaacataagttgtttttttttgagacggatgaagtatatgctatgttgtttcctttcatttatacacattaaaaatatgagcgacactcgtatatgctacttgatctctcctattgaaatctcacattaaattaagaggtggggtaaattaccatgctaccctctttatttactctaagtcatctttcccaaatcaaatattgaagttctctacgaagactaatactagaacttagtatagtaattactccattcgtttcataatataaggcgcaactacttttttcagatgttctataagagcaggtacaatagcaagctattagccagctataaacgtattttaatgagataaacaatgagagagatcagcagcgggatacagatttgtagccagctgcagtacggactccaagacgcaatgtgtgtatgacaggtgggaccacatattaatagtatagcaagcaactattgtatgaattggttattagattggctatagatgaattggagttagtagtgggctatactattgaacttgctctaaataagacgtgcatgcatgcatgcaattaattagtacctcttctctattaaattatgattgtttaaaattctccaccctcaacatctctaattctattgggtgcatgtattttatttattagggtgatacaaattaggaggttataataattgtttcttagtctttggagtaagggcgattgtgccttatattttgaaacggagggagtatattattgtactgatgaaacttaggaagggaaatgcaactctaaaaatgttttgaaatatcaaaacgacaagtattttgaaaaagaaagataaatgttataatgataaaatatttattttgccggatcgatcgaacgattggtcgagaccagattgtattaagatttggagagttacaagatatgtatgtattacattatccatacgaaaaaagtcgagatccgagtgatcaggcacatggaatgcctgtccctcgaggaaaaaacatcatgtccaggttatagttattggttactatatctaaaaaatctcttcctcctttcatattacaatctctctcttaaaatctctgaaaatcaagttgcatcattgttcacgatctgcgatcgaaattccgtgtattgcgctccttcccaaccaaccagcacactgtcatgaagagcatatcgaatgcgttcatgtaggtcatctaaaaataccgtacttcctgcactcagacatcatttttttagataaggtctttttttttatccggtctatatatacattcaatgggatatatatgtaacccttttcaattgggaacttagccactcaaacaacccaatctaacattcgctcttatgaagatttgaactcagtttcttagagtgctactcgtcactgtaaccactggactactagccaccatttatttagaggaaagattgttctcgcccgaaagctagaagtggcatttatccatccttttagcatcttcctgatttgggttggtgtatgcacgcgctacaaataggtggtgacaatcttcaattcctgattcacttggcacaggggcagctcgattgatgtgggcagccacgaacgacaagtaaactaaaacaacaagtggtattctctctcttctttctctttcgtcgctcgtataaaagattgtacgttgcaatctcgtcctaaacagtgacaccatagtactgcgaaagcctttatatataatttacgaggatgtcgatccgccgaactaaatgtgacgtgcctcatatatatttacttatcagaaacaagctagtgctttgcacaaggatgttttgactcatatatattataaactcaaagagaaaaacaaagatcatacgactcaattcgtgacactaaagcctcttttagaattgtggatttttgctgaattttacggggaaatggactaaatattgtaaaaattctagaaaattctcgcgtctcagaagagccctgtaaattgtcccagtcatctagtaacttctgatctaattaatgcataagaaccacgaaggtggagctaggaattaaggttgtgtttatttcttttcaaagttggaagtttggtttgaaattggtacgatgtgactgaaaagttgtgtgtgtatgacaggttgatgtgatggaaaaagttggaagtttggatccaaagtttgaatccaaacacagccttactaaggtcagtgatcaatcaatgaaatttgtcaaatcttcacatttttcatttttcttagatgaatttacaagggattaagcatacaagcctatatactgtcctaggtatgtacaggtatgtacatgtttccatgcatgcatacaacctcctcgatctcactcataccatatgcgcagtcgtgctcttttggaattgatagttgaaaatcttttatttcgttttggtgtaataccaaaataattactcggtagattctaaggtattaattggttatcttatccgagggatttagggacttgtacattaattattactcgatattttttttcaacaacaaaatttattagttgtgcgtctatcaattcagggtggagatgcaatacgtacctagaatcgagcatgtggatagcgtccaatgtgctggtgctcgtacttgtcatatggctattcgatgattcgtgtaccccatttgtaaaaaaatatagcaatttatatagttcaaatcttgttccaaacataatattgaacatcaagatgattttttttagcactaaactacccatactatccatatgcttcattatcacccaaccagcttgacttcacacccactcgagcacccaaggagacaaactttattaatagatgtatcaaatcctaaaagttgttatattatgagatgagaaaagtagtagtatgtgtgtatatatatatatatatatatatatatatatatatatatatatatatatatatatatatatatatatatatatatgactctgtcatgcgtcttgatcggtaggtcgtccgccctgaaagttacatgtcagcaattatagtgaaggggttaactactgtttggcacatgtccacacgtgaaatttggttcaatttctggccagtacaacatccatatgatccttggttgattgatcctgtaataactgtgggtccgaataatatcacatcaactacgtacttgtaatatttgtgagtactactactaattgcattgcatgtcagaggagtatatttgttcctacgtacggtagaccaagctagacatggcccaccactcatcggcttctactcatcaagagctacaaataattaagcaaagtgagagaacggttaaccatgcacactctggcttaatttgcatgctgaaaggggtgtactgctgtgctggcagtaggtaggtttgcagtagtacataaagtgctaaagcgcttttcattgtgcaaacagtgaaaggtaattgtttccgagaatttcacagcttttttcaacaaagtttagcttggacaacatggatctaactagcttccaaatagataggggtaaaaaggaaaagttgagagtgataaaggtgcaatattctactccctccattctaaattgatctacatatttcatagctacaccaagacaaaaaaaaactaataactctctcatactacatttactccagcaacaaactcgatgcatgcaccatccccattatttcctagccaatagcaaatcaagatattgcatgtgggttataaatacttatgtgcatggatgcatgcatcaatgtccatttactccaatgcgcaaataacgaatagacttaatgaataaacacaaatatatagatcatttaggaataacctcaaaaaaactatatgtagatcaatttggaatggagggagtatgtgtttacagttagtggaactagaaattttgctttaagatacatgtataaccatgtatatatttacatatttttgcccccttctcatgttcgttttcctgactgcgctctaacgatataacattttctttcaaaagaaaatactatttatacctttgtcaagttggaattaatatatacagttgatctggagaagagagataaggcatcatcctttgaacatgtcctttcatactcgcactatatatagaagaggaaagattaatttatacatacactatacagagaagataaattaatttataaatttccaaattcatatctaaaatttacatattactaactggtcctgtggtgctttgtcagacgatctggtagaattttcgtttggacgcgggcggcggatcaaataatgggctatatcttctttttggactttggagaacgattgacgctgatctgtcctatatttgcagcacctgtttgattggtcccccatcggattaatcatccaacagagactcgattttcgtgcaaagatagagggaccattagttaggaattgaatatgaaaatccatctaacatactgtatgtacgaaaaatcaagctttcaatctaacaaaacgtcttaaaagcttttgtttgtactgtgcattcgcccttctagctcgatctcaatgttgatggtgcactagtacgatcgcctatttaatttgcctattacgacaagtcgtgttaattgggcttgagacgcaaaacttggtgggatataagcatatttatgcatggcagaactagaaactaaacaatattatagatgctgataggtcaacaagtgaaaaaaatactagtcaaaaatctcccttatgtcatctaggaaacattcatgcgtgcgactaaaatccatatgtaagacgggtccgtcgagccactctaactaattaaaagacgacagaaatggattgttctaattaacatgtttttatgtcccaacgaatatactccctccataaaaaaggaaagaaacctagtagaaaatacgacacactagatagctctactgcgtctttgtttttctatacaacagagggaatattcttttaacaagatgcatgaagttctattaaactgagtgaacaatttgaacattccagatgtatttcactgtcatggccaataagtaaaaagtacagctgtgtgtgttacactttggcagttaggctatactgtcgattagtacgttcaggacgatgtatcaacgaaccccctgatgagaatccaaacgtgctaattggcatcactttttctagctagagatatatacgcagaaaacgtgtatatatatgtgtggaatacgcctaagataaggttccaatcagg

SEQ ID NO: 20744 - DNA, 23127 bp, Oryza sativa
aaattttataatctcataacaataaaaatactatttataaaaagttcaaataaaacagatgattaaagttgggcgaaactcatgattgcacttaaaatgggacggagggagtacaagtttcagtcaagaaacacagctggaaagatgttgcttaatttgcatgaccctggtgactcataggagggttccatacgtatcacacatatcgcatactttctctgattctactttttttctaattaggtccgaatgtccttctgaatttaaatataaaacattttatacacttgtgcaaatgatcatgcatgctatcccttcatttatggagtacgtacatatgacaagctggatcatttatatttgtgaaggaataggccagattttcttattttcatttgcaagggcaaatggaggagaaagtattaaaaaaatgtgtataggagttgaaaacaaactacatttatgaaagagttttaggagcttaagcaacttatatttatttaatcggaaggcatagtctacaagtagattcttcgagagaaaactatgcatatcctcaaatacctagataagattttcttttttttttgggtaactacgtacataagttgatatatgcatcaaattgtccccactgcttaaagagagagtcattctcttttcatcactctccctctcccttctacgtaaaaacctcttctctttcatataaatcgttttgaacaccgatttctcaaaaaataaaaaacaaacgacgaatatataaaaacatattatatatagtttgtgctctaaaattattagttttctaaccagagaagttgtggttacatgcatgcatttttttagaaaaaaaaacaatattggacaaccgaggatgacattctaataataaaggaggtgtgagcatgttaataattgaacacgggactttataaatgaaaccaaacatcctcttggctctaacgatgcagtagcaggcgtatctcaccttaatgcttaatgcatgagtaagagtaagttttcgtaacaaaagaaaagtaaacctttgcatttgattccagccaccattagcagactaggaacttgtgatattccttagccgcgtttccatcgtcacgtgatcgttagctagctctacgaactataagatctcctatgataatgagttcatcaattctcactacgaatggttgccaaaagcacacgtagcatgaaatttattcacatgtcatattaccagaaagttatgtaaaaaaaacgtactattatatatggacgtaacattttatccgaatcacaacgaaatatcgctaaaataaatagacaatacaataaggacgacggaaatgtaaatacgatggccccgcgggccgcagcgatgttctaaggacgtccgatatgggtcccattcggcaggcatgtgttggcagcggcaggagtgacagtctctccatcccctgctcaccggtgacgccattaagttttcttgggtggaatgataatactagcagagaaccactgagtcgctgctaggtgggtccaagaacacatcgggcccacacttcagtgaaagcaagaaaggagagatgagtacacgaggtccgtgctggagacaaaactgggcgcgctgcagctgcaggccaatgggcggagacgaaatggcatctttgtcatcgtctcacgccaactgcaaatgctacgcagagactaggaccacaattcagtgagagctaatctttctcgagctcagctcccaatgcaagcaagagtattctctgcattttgggttactctcaatctcaatacaaaattctgcgatcttctccgtattcaactttaatcgtccgtcttatttaaaaattattttaaaataaataaaaaaaataaatcatgcataaagtatcattcatgttttatcatctcatgacaacaaaaatattaattataaaaaattttcaaataagacgaacgattaaaattgaatacgaaaacgtatggttgcagttaaactgagacggaggaagtaagtactctcctcttgcatattactctcctctatcccggttagttccagtagttgactagtagttggcccgtactaatactagccaggctttaactgttgtggtaccatacgctactgttcatgcttaccaagccatcgtgtccatgagtgcatccatcccttgaacgcaatagtgagtactgatcgagtagtggtcgctcctcagtacttgcattgcatgcacgcatgaatgatggctgcagattgttgaacagcgagttattgtagatagagatcgatgactatatatatctcctgatcctttgattgctggatgagaagtgagacaccatcatgggattcatgcaaggagaaatcattggtttagctcattcattattgttgttttatccgtgcttaaaaatgtgggtttcgctcgtgatacgtctcccgcgcgaccagtcgtgtacatgaagcgcggttggatgctccgtggctgatcaagtagcgcatgcatgagctgctctggtgtatgttagtaggacccgccctcatgtgaccgactgctggctagctcctgcaccctgtcattccacagctgttctcgtgccatgtcacccgtacttttaaataaaccgacatctatgaaccggtacctattaggtattttgtagtggtgctagcttgtgcactacttcccatcccaagggcgaaagaggtgttcgtacatgttcatttatttgcaaaatgggtgtccctggcagcttgacgacgctagtgacatagcctcacgcacggtgcttggcagctcggcatgttgtcaccaccaagtccacgtagctcgtgccattggtcctagactcccagcgtttgacagtgcgtctggacattttttgaacataagaaattaattgttcgatcccaacgagaatcgaattgatgatctgtatgaaaatattgtaaaatcactcaggacgccctattgatgcgaattggctataggtgtcagattcctatccagaaccaattgggggcacctattctcaaccgtataggtgccagttccaaaatcggcacctataaaggttgtaggtgccggttattagttaagaaccagcatctatatatagtcaatgaataaaaaaaatgccagctcgatgcatcagctcaagcagctcgtcaccggaccgggaccaccacgttgctcaccgtcatcgcgtactgcaccattatccgtcttgcagagcatgaccagaggacaaagcggaggggaaaggaggaactcacatcgaacccttggttggcagtgacgcctccatccacctcaccgctgcgttctcctcctggtctcgacgcaatgctctctggcccatccattccccatcgctccttgtccccaatctccccatgcactgtagtgatttgatgcatccttgcatctgcttcgcaaccaattgaggcatacaaatgtagaacacgtcaatgaatacgatacaaattggacacaaaatgatctcacataaacatatactacactattaatacctggtctcacatgtcatgctcacactgtgtcttgtagtctgtgctgcagctgggctacaaatctgtagcccgctgctcttctctctcatcttttatctttttaaaatatgtttatagttggattatagtcagctattgtacctacccttagctagagtagtctcctactggcaccttttgtggcatggtgtgcggtcataaatataatgacacgaaatgcatgcagcgcagggcctaaagaagatgaggcctactcctagatgcagttgcagacacgtcacctggatgggatggcggccatacatctactagctctccccaatccccatgcctgcctgaagctggttactgtagtaaacttcgaaccagatccgagtcttcctttacagcgacgtcccatcgaaaagataggaacaaatggccagaaaagatagcacagagaagccgatggatcgatcaggatatggaagcttaggttccagctacccctactagtgtaggacagcgaaaccctccgttttctgccgccacatgagccatgaacgaccactcgaagttctcagataacacgcaagccaaattaatttgaaacctctgagagcaaatataatagtaggctataaactgactaaatgctgaagtggaagaaaaaagagatgagagagagaagaagtgggctgtaaacttacagtcggcttagacacaagaaccaagaaactgtgtgagagagacaagtgagtcatatattaattgcaaagagctaactaaattatatgggtgagctgaaagaaggctacaaagaaccttatacccaacaagtcggctgtattattagtcttgctcttaggagcatccagaacacggaatcgaatgtaatcactttatcgccagattagtagatcgaccatgcatgcatatgatgatgcagcttactgtccgttagcgcatgtccgaactgaaaaaggatcatcgcgaaccctgaatacattggtccagatgattccagtggaaaaactatagtcctccattattatgcacgcatggatgatatggagttaggcccggtcaaaaagaagcgatggcgactcgaactgcagcgtgtgaaaggaaaacgaaaaaaattcagtagcatatatgcagcacgcatgcacactgttgcagatgtaggtgttggaattacagcacgcatggcttccacacacgcagctttcagctgatcagctcaggccactggcgtcaacagagggagagctagcaaataagctggatctcctgcaggggggagatgtctccgtgtcatcaacatcccagcagctatatatctaatctgttcgatactctctatacaatagaatcgaagtccatctgaccctctccccactcgcttatctcgatcagatgtgatcgattcaacaagttatatatgcatgtgtatgattggtgcttgtatggtggagaagagagaaacgcaatcgtttatagccatacattttcagccatgcatgaaaatgtctggatcacgacttgtcgtagaggccaatatgtacacacgtacagttcggtcgatggatttcgtcagctactatataccggtatacttttgctcgttcaagtccaaaagttaatagtatggtttcattgaatttctggttgtagctagcaggtgggcatatatttagaccaagtacaataatagactataagtcggctacaagtttatgtggggagataagagagaagagagaaaagaaacaggctacaaatttatagccaacagcagcacggactttaaaacgttatatgtgtatgacaagtggaaccaattattaatgatgtagtatatatttatagttaactattgtacgaattagttattagattgactatatataatttggaggtagtagttggctatgctattaaacttgctcttaccgtcatcgcgcgcgttccttgtgtggagatgtttcctgacctgaacagtactgtataccgttcacatcatgcagctatttatcttttgcttttttgacaactacacaggagatatcaggatgcaaagaaacggccggcatgcgcatatagaatcttcgacgactatgcatgcatgcctttaaattccatcaaaactcaatataataattattcttttttggtaatatctggtggtgtcaccagcacaactgttagacttaagctttcaacaacgtccttacaataaatttattctgaaaaatctctggatcactcatgcgaaatgtgtagtactccagtagcgactagccaactatactactgtgccacgaaaataagcagccgcgggcggggcactgtacgcctgtgggtacgtatctctcgtacagtacaccgtaccatacctgtgcggacggagttaggacgtctgcaacgatggcggccgacgcgacatttcaccggccagctgcatgagaattgtattgcgacttgcgagagatatttgtagtactcggcagcatgcatgttacattgttacctgatctcaggacgacgacgaatcgacaaatctttatctacacattgcagatcggcatcggcacgggcgcgcacgcgtcacggagatcggcacggggcattatggcggggcactgtgctactgctagtctgcgacacgctgcaacagtagccacagcaatgcagtggtagtagtagcagcatatgctagctcttggggagcctggaccagtacacgcgcttttcgttctcgccatatatgcagcgcagcacgctgcaggcaggcagggagtgaggagtagtgggtgtgggagattccccttttaactcgtggcgcatgcatgctgctgctgctgacgctgccgcccgactggccgacgagccggcctgctgctgccgctgcttcgattctctgcgcctgcctctgcctgcttgagttcctcttcgttcgatgatcttttctttgggagatgtcttcttgctcttcatgcgctggcgctgctcacgagatcgatctctgcgtgcgtcggctgctgaagaggaaggggatttttgcagcccagcgccacaatcatagcccacgtcagtgtgtagcccatgtgacatgcaggctcgggctcaacgtaagcccagattttgccacgttgttatgggccatatagtagaggccttctcaggctgtaacaatcaaagcccacagatgtcgcgccaaaggcccacactaacagaagaatccacgagcgagcactattggcccgtggttgaagcctcaaggccgtatgtatgcccgtatgtctccctgcggttgccacttgccagtggatagttaaggcctgtttagtagagctcaaacttctaaatttagcttcaggagttgggtctgtagtggagttgtgaagctgcctaaacctagctccacctctctagttcattttgtgagagagctccacctatctctgctccatttttggtggagcggaaactgtttggctaagctaaggtggagctggagttggagctgtgccaaacagacccttaaggtcacagctccagctccagatctcctagatagcctaaccaaacagtttcaactccatctgaaatgagaatggagatgagtaaagtgctctcataggatgaattagagagatggagtcgggtttaacctgctccataactccactttagacccaactcatgaaactaaatttaaaagttggagcttaaataggtttcttattctggctttctattcgcagcatgtacatgcagaggttaaaagatggaacaataaaactatattgtcactataatgtcacagagaagtacagagtgcagagtaaaataatctacgggaagaggggagaagggacgcacgagcaagctaattgagctagctagcacgtaatacagagagaccaaatgaatgatcaaacaaataagtttacaacactctatctagctagctacgtcgtcgtacgtacaattttcaatttaatctcatcacaatcccaactcacacaagcctgccacgagctatacatcatgcttaggtcgatcgatcagctggccaccctgcagtttgtcctgatggtgccggcgttgccggtgagcacgccgatggagcccatcttgaccatggcggcggcgaagtcggtctggaacgagtccgggttgttggtgtagccgacgacctgcgcggcggtggtctggtcggcgaggagcgcctggtcggagctgagcaatccccggttagcgacaatggcggcgtagtagttggtgtcaaaggcgttgggcgtgacggcgtccatgggcaccatccccgccgcgggctgcccctgctgctgcgggcactgcgtcgtcagcgcggcgacgtagctggggtccatgctggggtcctgcccggcgttggggcccgacgagtagaggcggttgctgaaggagctgcagtgcgacacgccgatggtgtgcgcgcccgacagtgccaccatttccgcctgggtgagccccttggcgccgaacatctggttcagctgcgccacgttcgccgacggcggcggcaggttcccgttcgtctcctgcgccaccgacacgttgccgtctctcctcccccccggcacctggtacgcgttccctcccacctgcacgtacacacgcacgccaattgttactctgtttctcaaaaactgtactaaaagtataattttagctgctgtcatcttggctcgtgcatcagcggtgtacctatatccatgtgatacacggaaacatgtagattagggatggaaaccgtacagtggtttgtgttctcgagttagttagacgcggcacatggttgattgggttggtggtgaagcggcggggggacgcatgggccgcacaacgggagggaatggggacaaactaaaccgatcgatccatggcatgtggtgttgtggaccgatgggcgtgccggccacatgggcgtgagacgaatccacgtaaactatccgtcccacttgctcatcctgcccccagaattaaacccctcctcgtagctttcggtatttaatttcctctttggttatcccctaatgtaatcctgattgataccggagagggctggagtcgtcactactcactagcgttgctttttgcaggtatatgtctttttcatcatgtgatgatgtgaaaggttatgcacacgcatacgcatcatctatgtgttgtttccagctccagctgaagtttcagtataacggtcttaacagagcaccatttggagttcataaattgataaatatgctagtgtctatttggaaaatacatgcatttggtcggttgtgaattattgacgtggtggtatatactgtatactccattgacttaccactagtgaggaatctttgactacttgttcagaatatgtcaacttgaacaatatgaaactgcaacggtcgtatgatcagtaatgttcatttaaaaaacacatgtaacacaaaaaatggttctaaacctgctgaccgtatatatcatgtcgtaatgctcctactttaccgttgtggcgtcagtaataatcaaatttagtccaactgaatcaatataatcatacgaacgtactagtactagtactccataattttgctccgatcgatgtctcaacttccttctacactgaattgcatggcgatacagtttacgatttgtttgcatggagatcggagcaaagctagattaggaatgattggagttggcccatcacaccagcctcctaaaataactgttcatcacccccagagggttaaagtgaactttattagtgtgccaagtgccatgatcccacgatcagattggattacttaatctccattcttttggcgcatccccaaaagatgatcgattttggaaagcaaaggctctcttttccttaacctgtgtgagggcgacacggccatgtgacgctgatacggacaccgaccggtgggtccgtgcagacaacgggctcattatacgtgaaccaaccaaaacaaaagaaaaagagcggcctctgcttctcctgcagtcgcatcgcggcatcggcacatatcgtgcgtgatgccgccgtggtgcgttgcttccagaaaagcatcggcaatgaatcacctcccattctacgccgggtcgggccggcagcatcgatcggaaaggagaagaacagagtaagttcctactgccagtcggagtacaactactttcagcgtcagcttttggagaaagatagaacgaaagttggggcaatccgtgtagggcccgaccggttttatattccaggctcgatctatctatctatcactcgcaaatcacccaatccaccgacgaatcaaccgtgcgccgtgcgcgttgtgatcccccccgacttgtacccgcacgggcaagtagcaagcactagcagtgatgcgccggaggaagcagctggtaattcaatggagcagaagaaaacgtacgtaccagcgcgagggcgtcccgggcggcgaaggcgaggacgtcggcgcaggagacgacgccgaagcaggccgtctcgaggcgggacttggcgctgtcgatgacctcgaagccgcggaggctcgtgttcgggggcgcgtccttctccgccctgttcccctgcgtcgagtccagcagcaccgacgcgtcgcacccctgcatccacaaggaattcaggtgtctcgctattacgtgcaccacatgtcaaaacgaatgcagtaaattaggtaacacaggtactacgtgcttgattgattgactgtagcactgtactaatgttttggatgctaggataaaacaggggatgccagatggcaaacatgaacgagcgatttctagctgtcatggttccagagtatcccatcgttccgtgcaggtgcagacacggtgcagcaatctaccgtgcgtgcattattcccctacctcgatcggcttatcatcctcgcagtaaaattaagtacagtactacatacgcgagaaacggacgaagcagagcagggtgcgcggcaaaagagatgcagaggctccatatgcaagcgaagcacatccccacagtgacatcacgttgcaaccattggatcactcaaaaaaacacttgtatgtgcagccgccgcatatatgcagttgcaactttgcaaaggcatctatctctagcttaattagcttcacatccccaacaagctagtatacgtggtctcattaatggaggaaccgaatttggtggtgtaataagttactattagttactgtactgaccctgacgaagcagtcgtggaagtggagacggacgaggccggcggccatgccggggttcccggacaccgccttgctgacctcctcctgcacgatgatctccgccgccgggcacagcgtgtcgtagtacccgacctgcagctgcgcctgcgacctcgtcgccatcgccatggccatcaccgccacggacaggagccacagccgcattcctctgcttcctcgcgcctccataatatcgatcgatcgatcgatctgctacgctgctaggctctcgtttgattcttcgcttcttgcttcaggcgctgatcttgcaggactgcagtctgcagcagcaagaggggcagcttttaatcttgcgtggaagcgagctatgcttctcggttaaggatggtgatgaggtggtgggactcgaggtggttttataggcgtgagagcgagagacgacatgtggggggtgaagtgggggagcgagatgcatggtgccaattggggtggtgcccttttgggggcgagcatgattgagtggaggcgatagaaaggcattgcaaagaaacaactttgatttttggactgtaaaaaatgctccaggcttttggtcttcatctgcattctcctgtaaatactaacccgagggtaattgagcatttgaactggatattgataggcagtgcactgcagtagcaacaagcagtcaagcagaacacatgttatgttacaggaaaaccgcgggcagggtgcatgttgggctgagctggcatttgagatgatgagaacgactcttatttgttttcttttcttcttctgtagcttggaactttcttctctgttctcaccttgtcagttgtccccatgcaaatctgggccctggagtagtagtactacatcagcatgcgattattgctaaagtaaatgatgggacaatggatgtttcaagacagaggtccctcggaatcacgtctgctgttttgagcttgtgaattttgcgactttattacctgaacatttaacgattgggatgtgaaactgacggtctggaagaaatggctggatgtgccctgcttccagcacactcctgatccaaacttaagtactcctataaatttcgctatatcacacttcagaacaagccaaccgtgtcctccggaacgcaccgtagcgtggtcggtttgtactaaaaatgttggggttgcttcagtttgtagtgttctactattattgtcatctctcccattagttgcatccggtacgcaaaatagcgtcagctacgcggaatgctgctgcccaagctcttcgttgccagctagttacacttcacggaatccacaggcatcatcctaatcgattgcttcgtttgactcatgcgtgctactcctacttacaaactgggtcctccttgcttccacatgcatgatcgctatcaggttttctggcagtggttaacaagagaaaaaggactaactgtactggtatagtgcggttcgttagggcagtgcagacgacagacaactcaaagccagattcttgcacgatggcttccacgttaaggagaagctaccttagcctgaaacccttttcttcactcgcaccattaaagcttaatggtgtgacactacgtttggatctgttcggttagctttacccaaaggaatcatagtacatcatgaagtataaacgcagggccctgcagatttgggtgaagttgcatgcagtaattaaccaataataactgaagaaagtaggaacattccttaggctgtttcaggacaaaacttcactgtcagaataattcgagttcaagcttctttagcattcagaaacgtgtttatctacctggaaaaaaaagggataaatcccctctgttaactgctacctaccagatggatgagtaggggtggtactgcctgcacatgcatgcagatgcagccatgcaggtagtcgtgtttggtagaagctggatgcataaatcgcgcaaagaaacctggcaatttatagcctaccaatcaatccagcatggactgctgtcgctttgacctcaatttgagaagccatgataaagtgaggttgcataaatcagtaccagcactgtagaagaaatatctttttcagcagtttgcttaatcagtaacagtactaatcgaattgcttgcatgatcactaccatacttcattaataccggtatcaggattcagaagtattatttccttagactcgtcttgtactcgggcgaaccactaagtcctccttttgtttgttcttccatcttgatatcaaagttggctctgctttggttgcattgcatttgcaggcctgttgcctcttttcgccagcatcaactttacggccaataactaacaattgttcgtagaaagtctcagccttatcaatattcagtgtccggttcaacataaaaaattgcgattgctagattagattgttaggttggctttcaattttgcttggcacatgactaaaagtgtgtacgcagcgtgtggcgccgatccatgcattcaccagctaaataaaaaacacttttttcccctgtatttccaggcaacgcgccatggcttcgcaggatttttttagcagagcttcgagaacctgtgagcttgcatgtctgctaatctctcgtgcctcactgtactgtccaaattccaaagagcaatgaatatctcacgcgtaatggttggataatttagttcaaaaccaatgcgtaattccattgaatttttgccgtttgacaaattaaagcatagagacaaaagaagaacaaaaactctctgatgataggaacaagtagaggcttcaaaaatgttgttgttcagcaagcgaggcctagctcagtttgcaaccctgcagtttgtgcggatctggccgtcgctgccggtgagcacctggatggcgcccatcttgaccatggcctggccgaacttggtggcgaagaggtacatgttgtaggcgttctgcgccacgagcgcggcggtggcgttgtcggcggtgagcgtctggtcggaggcgaggacgccgcggccggcgaggaggttctggtagtagctggtgtcgaacgtgttctcgctgccgtcgtccatggccaccgtgttggcgctcccctgcgggcaactccgcgacagccgcgacgccatcgccgcgttcagcgccgggtcctgccccgtgctggagttgtacccgtacagcctcgagctgaacgagctgcaatgcgccacccctatcgtgtgcgcccctgattaaaaaaaaacacagagagaaaaatattgtttgttaaaaaaaagaaaaaaataaatcttttcgagaagaagagtggtggatatgcatgtagcctaatatttatagtgacttaagtaccattctaatatcttgagttcaaactaacagcgaattttagattagattatttgtggggctaataagttcttaatttattgcctattcgcctgggccttatgagaattccagaagttgggctgaattgaatagtgggctgtcattaacaagttgacctatgtgggcttttatatggacctgtacctgaaaggatgaccatgtcgtcctgggaaagcccatgagtggcgaaactttgtgtgagttgggccacatctgaggtgggacggggcaggttggccatcgcgtcggacgccacggaggtgttgccgtccctcctcccggccggaacgcggtacggggtgccgccggcctgccgtccaccaccgaccgtatgcaagttaaaaacaaattcgcagccaccgtgaaagagctagctgcgtaccagcacgacgctgtctctggcggcgaaggcgagtatgtccgcgcaggagaccacccccttgcacgcgctctccagccgccgcttggcgctgtccaccacctcgaaccccctcaggctcttgttcggtatcgcgtccttctccgccgtgctgttcgccgtcgaatccagcaaaaccgacgcgtcacatccctaaaaacagttcatcgatcaaccatctcgatcagctgattgatcccatttccccggaatgaattgaacaatataaaggagagatcgaattagagattggtttattgggatcgaccttgacgaagcagtcatggaagtgcatccggacaaggccggcggcgaggccaacgttggcgctcacggccttgccgacctcgtctctcacaatcacttcggcctgggggcacgattggtcgtagaaccctacctggagctgaccttgcacacctccaatgcacaagctcagtgccacgactactgcacctgctaccgccaccaccaactccattgcccctcgatctcacctagctagctactactataggcagctgaataatgcgtcaaagatctgaacaatgtggacaaatttatagctaggaggctagcaaatgatctgaagaagaaccccaataactagtaaatgaacattggtcactgcagtggactaaccagtctacatgttcttatcaactgcttctactactagtaatattcactgacactgacaggcatgcgcagacaagctttcaggcagccatgtgaaggcctgtagctagaaacatggccaagattttcaggcaggcagggctttgggatatttggtgcgatgtgtgcaaaaaactagccggtaaaacagctgctgcgaccagggttggaaatttcggtcatttcagacccctccgatacgatattatttcggccgaaattttttaatttttccatgaattttggtaatatttattcaaattcaactaaattttgctcaaaatttcagaaatttcggtatttcggtgagcaccgatcaaatcggctaaactgataggtttaaccctggctgcgacttgcgattgaccatctgttgtttggtgccattgtagtagtgaccactgaaccactaaacgagtggcgttgtaaattaatttgtcattgttaccaagggataggagattactcggatgagggattttaaactgggacagtgcctgcgaggattaaaaactgcagttgcttcaagatcggtcaaggcatccggctagttgtctcatgtgctagggacagaaccgaacgtgcatggagttctagaggcttggatataaaaatggcagccatcatgtggttaagcgtgcaaatggtgctgatcgaggtagttttgccctttgcagggcatgtcatagggcagggatcggtgaagggcagcacaagtgtgatagtttttatgctagtggggcactggggcgtacgtttctttgacctgtaaaataggaacacaaatgagatcgtcctgcagggatagggcatcctataggttttgtaaagtactgcacatgtggatgtggccaagattgtaaaatgcatgtgagtgatggtgacaatagtccaccaacttacaacttacaagatcatttcacccccttttctgaagaatgcagacctgtttggttggattcagactagagcactgttatgtatcttctgcgtattcataacgcgttgatgccttcttttgatgtctttgtgacactattactagtacatgatgagagcccataatagagctacaagaattacaactgcaataaccgacaggagaaggcatgagcaggaagcgcttttcctcatgcgtgttgttacagatttcaactttttctgcgcacgctgtacatacaaacacgaaacgacatgttagctagcttatcttagaaagatgagataaatatatgcgggcatctgtagaatcaaacaacaggcacggtggatcacctgaagctggttgcttgtctcttctgttttctcgtctaagtcatcctgcaacgtttgtaaaaggcattagtataggaaccaagttaattcagaaacgatgcttacaaataggagctactgagatacttacaatcaacctagtgtgcagatccaactcttcgttgatcgccagcgcaatgtgcttggtgctgactatcgtctcctccagcttgtccaattcgtcgtcttgctctgcatcataattcagagaagttcagtcactgaacacctgtacattacatggagcagcacacgtacgtgctgacgccagacgagaagggaagaaaaaaggtatatcctctcttacctttaataacgttcctctgcaactcaatgatctcacggttgtccatattggcaatgctgcttacatcgatctttgcgtggttgtcgtccggtccaagcaggtcgctcctaaataaagattcagaaagacacaagtaggaagaagtgtttcatcgtaaagttcagagttcagacttgttggaactcagctgaagctgcaagcggttaaactagtggagtatataagcttgcaaattcacctattggagaagcgcttccgggtgaacggagcgccaacctccttcaccttggagctcagagtggagtgcttggctgctagcttgttcaactctttcaggcttctgccaggtttaagcaaacaaaattaacgttacgtttaggccaatttgatcaatatactatcgtccaattgcaatatcacgtgtggcttgcttaactacttacatgcgttgcttgtttgggagttgagaaaggtcttcctgcatcatgtcaagcctggtctcgagaatcgcgactttcctcctgatttcggcggttcgccgctgcagctcctgcggcagcgacggcgagacggactccctctccgcgatcctctcgacgacgtcggccacgagcctctccgcctcctcgaaccgcttcatccattgctccaatggggaagacgccgctgatgatcgatgatcatcgtcattagcacatcgtcagtcggatgcaaaggttaaaaagaaaagaagaaggttgagatgttgatgaagatacccgcgtgctggtacgtgatcggaagaagtggacgcgccatgtgcaatccgcgatgtaaactctacgagtttttcgtctgatcatccttcagtgaagaacaggatggttaataattgaggaaggttctctgatcttgtggtgttcgtttccgggtcgaacgtagggaggaaaccagagcagctacgagtaggtttctttccggcgacgaccggctccgttccggcctcaacgccgtagcaaaacgatcgagattgttatgtacaactaggtaagtctgcacgtagtggcgtagagccgtagaggacaaaacggagaggggccgtgggctggttgactagtacgttatacgaacatgggctgggccatccaggcccactttggcgtggtaacctaactaggcctagtgactgttacgtgggcctttttagacccatatcatagtggaaaaagtacatcgaaagtccctcaacttgtcatcggattacaaaatcatccccaaccgcaaaaccagatatacgtcatccctcaacttacaaaaccggatcactttaggtcctcgggtgattttaaccccggttttgtctgacgtggcagctaagtcaacgtgggacccacgtgggtcccacatgtcagtgaaacaacttagtctacccttttcacccttttcccccttcccccttgcttacgacgctgggtggcgcatcgacgcgacgccgcttggctcgccgggaggtcgaggcaagcctccaacgctagatgcctcgagttcctacgagctcactggcgacgatgagggccaacgctgcccttcttgcggagtcggaggtcgagaggaagctagaggccacgcgggcgagcttagggtcagacaggcttgggaggacgtagcacaacagcggcacgacagagctggcatgaggcgtgtcggcggtgtcagctcgtccgcttcccccgccggccacagccgcgcgtcgccatcgccgacggctgatggcggcgtcgtcgagtcgatctcggtgcgggcctttcgtggcttcggcttcgaccatcgaggtcctgcgtggctgtgcccggctcgccgccgccgtgtcgccatgccaccccgccgcccatcgctagccgccctactgccccgagttgacccaccctccccgggccgcccgcacgaggggggcggggaggtcggcgagctcggccagcactgagcccacgcgccgccacttgggagccgccgccgtaccaccccaccggccctgtctcctccctccctatcactcgccgctggcctccccgcttccctctccgtcacttgccgtctccttgctaagcaatacactgtgacgctactgcgtccgcggtcacggcggagagagctggcaccgcgggagaagctggtgtggaggagggggtcggccgcgggcacgccacgtcgccgtccacggcctccgcccgcggcatttttccaccaccatcacccccacctcgccagcgacgaatttcctccatccttcccttctcctcctccgccccctgttgacataaaacacgaggcctgggagatctgcttaactccagtgcaggtccaaagctcgccttcgggtgtgttagcgtgccagttgatttgatcatgcaatcaacaagaaatagaaacaaagaaatcgcggttaaatctataaatgatagccgatcggctaagtgccgatgacatatcatttatctttgagccgatgtcatatgtgaatcgattggcgactataaatagataataaaaaattaaacctactcgatcgactgtagatattaccaatatatagctcttatatcgatatatatttaaatcaagtgattgggatagatcggtcgccatgccgagacagtataaaccacttggatcgaaatatatactaataacagaactatatatgtttatagcatagccgatcatatagatctagcatgtatcgactaatactccgatactactctatatcaggatattaaaacaaatataatatatcaaacaaaaacttaatatacttaaatgcaataaaatcttgacataaagggcggatttaacatgtcactgaagcatatagagcgaatatggttaaatcagataagatcggctgaaactccgatactaccctaatcggcaactagaaggcatgctagagattggtattctaaacacgacttaatagatcaaactcaactaatgcagcattaagtatgaaaagaagaacaatatctagacaatcaagccgctggaagtttcatagagtagtggatatcttatataatctaaatcaacatcaagatctgtcacgccccgaactagccccgagcggagctagcccgtgacgctccaaattaacctgttaatcgataccagtcccaggaaacagtgctggtatcacaggaagacagaatatcacagcaacggcggtctctttattatagagtaggagtacagtcatgttgggctgcggacagatcccgagctcacaactgcattacaaaagggaaagcggaagccaagacttggaccaaacatcacaggcgcgacttgggaactaggccgaaaccctaaaactcattgtagccgacttgctcctggaagaactcctcgtcagcgggatccgcttcatcttcttcagcaactggggggggaatatttatatagagcaagggtgagtactcagcaagccatgggaattaagtgtttaatgcaggcttcaaggaaaggttgttgtttttgcaattgattttatttaaactcttttctgaaacaactaagtgagtgcttctcaaacgacacggatgggacagtgtgtctcgtctggccggagtatgtacaaggtatcagtcttttgaattgatcaaggttggcatccggccaacagctttcaaacggccacccgggcctggctgatcccagcagccgcagattttccaaacatcgaacccaaaccacatcagcaaattccacaaagcagtagtcaaacaaaactacgctaggaatcacctcacatccacccatgactgtgggcacggctgttcgaacagtttgataacctctgcagagagggtacactttacccacacgacattactaacccgaatcacccagcccgtgtagaacggccacgtctggtgacctaagggctttcatgacaaggcatttcgaaagccgacacaggttcaccatatgccaacgagaggggtcccagaccaacaccagattaggtcccagaccatactgtgccaggaaacccgggggttctccccaacaccaccccgttgaatccacatgtctcttggcatcatggctcccccgattagctagttactcagccaggggtgtcccattccacccatgtggtcgtacttgtcttatgttcggatgaaattccaaggaaacggtccttaagtgcaagagcgggagactgtatacccggtacgttccccagtccgcgattttggaaattcatttagttcgcaagcaccgacccaggtgtcgggttttccaagtcttttgtaatacccaagttttacccatggttggatattttatattttgagggggggtgttctgatgcgcgtacccgaaggcccgtgcatcgaagcacaacagttaacaaggaggtttaagtgttcaataattcaaggagggtaattgcagcaattaggattggggccggcaggccgtttcgcaagccgcggccgaattacttgtgtaaatcctattcatgcaatatttgcggaaaagaaatacttagatttaaattataggtgcaagatgatcaaaggtgacttgctttgctcgagatcttgagcttgatcctcgaaatcctcgcactgcggatcttcgggctccgaaactacacgcgaaacgggacaacacagcaaacggcgaaaataaggccctattattgacctctaagcatgccattaggtagatcttaggatttgaggaattttggaagttgaacggagtaaaacgtacttacggttgggaagatattaaatttctaagattattggatttttggtctaaaggaaaaaggatttatttaaatccttttcgaaaagaaaagaaaagaaaagaaaagaaggagggaggggaattagacttccctcgggcggctagggcgcggcccgagagaaagggggcggctcggccgaacttaacgggccggccggcccgagaaggcggcccaaggcatgcgcgcgggcggggaggagtgaggaagccggtgggccgggtccatcccgcgtggtccagggtaggacccgcttgtcggcggcttggctcaccgtgagcgaggtgcacgcggggcgtgctagggtctggggaggggaggcacggcgcatgcgcgcggttcgcggaggacgcggtgcggcgggcccacgcgcagcctcacggctcgcggtggaccgcatgtgcaggcagggctggagggagtggcggaccggggtcagcttgacccggtcgcggccgaggtggcgccgacgtggcgcctacgtagccgccacgcgggccggcgggaggtagacgacgacgtcggtcggaacggacggcggacggcggcggcgagcggcggagcgaaccacggcgatacaggcgaaagcgagcacaccgggaggttgcacgggacgaggggagacgagccaacggctcggattcgccgggggatgctcgacggcggcggattgcggcggtggcaaccggcggcgagagaagggggaaacggcgacggcgcgacgggagactgattcgggcaagctaaagcatctacgcgactccgggaatccgttgctagcgtcggattgggcggagctacgccgagcgaggccggcgacgagcgggcgctacggagcacgggcggcgacggcggcgagcacacagcgagcagcggcaacggtcggggcggcgctagctagctatgggaggctactcgtgctactacccgagtctaaggggaggagatggaacgagaagggggaacggagagaagcactaccgtgcggggtgatggggcgcagtgacgaggggccgacggcacgggagtgatctcttcgcctcaggccggggaagaggaagaagacgagcgcccggagtccccttccgtgtccttgcgcgcaccggctcctccggcacacgcgacggcggcggtcggcgagagggacggcaatggcgcgggcgaaaaacggggaagattgggaggggaaaaaggaagggagggcgcctgggtttatagggcggcaatgtcggtttggaaaccgaccttgggcagtcaaggcgcgagctagcgctcggtgctcgcggccaaaacggcgacagaggcggatgacgccggcggggaagagaaaaggaaaaaggaagggagaaaggggggcttgccccttgcctctttgggaaacgaacgagggagagagggcgatgaggcagagccc

SEQ ID NO: 20745 - DNA, 1360 bp, Oryza sativa
agagagagagagagagatggggagggagggagagatgggccgagaggaattcggcccatcgaacctgagggaggcaaaatagacttttgcggaggaatttgatttgggacggattttggattcgggattaagcttgacgatagatcggggatttgagatctgagatggcacggacactagacaacaagcaaagaaacagatttcgcaattaaggtttttaagagatagttttcccgctaggcgccacgacggaacgggcgctacaagatctaacctaatcggctgccctctactaacagatgttagccgattgtaggttaggtagcgatattgttagagattatgtatgatatatgataacacgacgaattacgtaaacaagattagagtatcataaaaatggaagcactaatcccgagaacacaagccgtcataacaagttttacctcttgttgaagatcgaaaccgatgcagctcaactcgaaagcaggaactcgttgaaataaaactaaagcaaaaaggtggcgatgcgccgaaattgtattgaacgtgtgttgttgttttttacatagggctcggggtctatttatacccaagaattacaagatatgtccataccggacacgaccattatctctaacaaactctaatataccataagtctttgcggcagacttttgcccaaacatatctctaaggaaattacataaaacatcctaattaatagatacaattgccttctcaggactctatccatgtgcggcaatcatcttgaagcacctcaattcaacccgatgtcatacaccaagtcgtactgtcgtaatcggctgcatcggcttacctagtccgacttagacccagccgatcctaatcgtaaccgatctggactccagccgattcttgctctgttctcggatagatctctgcctccgactccacttcgatctaatctccttttccgatgccgatgttaccaaatttggttgttaacaccccccccccaccttgccggcaacgacgacaaccacatcgacgcgagcacaaggtatgtgagcacctgcttcccctccgccctgggcgccgccgccatcgccaccacagccgcctccgccgtcgcccacagcttcccctcggcctcctcctgtcgcccacaatcctgctccacaagcttgctgtgtgccgcctccagcgcacgcgccgcgccgatgacggtgtgcacctgctgccacagccccttcctctcccgcagcgcgagctctcaacgccgcctcccgtcactgtcggtagcgctcgtgcacgggaaaaggataatggaagagaggggaaaggggggaaaagttgtgtttcactgacatgtggg

SEQ ID NO: 20746 - DNA, 15547 bp, Oryza sativa
ggcacgcgcggcggagctgcggcagcaacgccgggtcgacgctggggtcggcggcgcccgtcgcgctgaagttgtagaggcggtcgctgaacgacgtgcagtgcgcgcggccgacggtgtgcgcgccggacagggtgaccatctcctcctgtgtgaggcccttggcggcgaagctctgggtgagctggtccagcgtgaacgtcggagccgggatgttgtccgccacctccggctcgagcgacgccgtgccgtccctccggccgcccgggacgtcgtagcgggggcccccggtgagcgcgacgccgtccctggcggcgtaggcgaggacgtcggcgcaggagacgacgcctgggcaggcggcctccagccgagccttggcggcgtcgatgacctcgaagccgcgtaggctcgggttgttgatcggcgagtccctctccgcgacgttgtccgacgtcgactccagcagcaccgacccgtcgcacccctgcatgcatggatggataatccattttgcatgatgcattgcatggtgaattaattcgcgtgcgtgcgtaccctgacgaagcagtcgtggaagtgcatgcggacgaggccggcagcgaagccgatgttggtgtagagggcccgggtgacctcctggcgaacgatggtctccgcctgcgggcacgtcgccgcgtagaagttggggtgcagtgacccatcgttggcagggaaaccggcacacacgattgccatggtgcataaccacaagaccgacactgctgctgattccgccgtcatgatcaaccgcatcattagtacacaattagccacccgttcgagctagtacagtggtcacttaattggtgagctgacacaagctagcttaattaactggcaattaagtcgtcgaggttaacacacatatatagcccgcggccaggcattgcacattgttaggtgaagtgccacgtactcgcgtgatttgcaatgtgggatactgggattgtggccaacctgcagatcgaccatggaaagtgtatttgggtgggtgggggcgtgtgtgattggatagcgccgggtaattgggttattggggcacactgaagcataaattagctccaggttgagtaggatttggccacgaattacatgtgtgtccggcatcaacttgagagagaggccattactgagttcatgggtcactacatcatgcacgttcccattgaactcgggttggtggtaagcagatttggtggactgtgttccaatgggcgtcacgaccggatggccatattttagatttcttcaaatatgtacgtgccacggcggcacggccgtagtgactggtgatccttgaatccatgagcaacgaatgtgccactaccgagttgtgactgtgagggtatatatgtaatatttaaaaaagaattgacggcaacaacaataggatcctcccccggccccctccattgtgttttttcttttacttttgaacctttttattttaaaaataaacttttcaaaaccttattttcggatctaaacctttagccatgccagccagttggctggcaaaacaatactatgacggcggtctcgctggtgtgatagcgttatttggtcatgccagtctcgctagcgtggcaacgttatttagtcacgccgctcttactgatgtggctggataaaactgtcacgtccattgcatatggcatgttagtgttgttttatcacgtcaggcgggatagtgtgaccaaaaggttcaaattttgagaataagtttttagaagcatttattttaaaactaaaaattaaaaaggttcaaaaagtttaaaaactttcctccagttccacctatctccttatctattggtgtggagaagctccatctctacgccacccatgccattggcggtaatggaacgtgctcttgacacaacaccacaacgatgccgcctacacactatgtcgagcagatccaatgtagagacgtggtgccacttagttggagggagacatcggccaccgtggtgttaagagctaatgacgcgatcaaggcaactctgctgatagcagggagtagggggatcatatgttagtgtcaacccatcttcgtgctcgatggtgccagtgtcgttctccaccaccatcacctccctccgtccaatccgctctaggacacgggcacctagtaaaaaaacgagatttggagaaagagatgtgcctccaaatatttcttgataagaaattatgagcgcattgaaaattgaacacgagacctcgacattgaaaccacacatcccttgtcactgcactatcaagtgcatctcctcgtgggcagccagtaataagagctcgataggcgagaagtgccctatagtaggacattaacttgtttggagatttttgatgatttcttttcaattcattatgcatattgtcgcacattgttgttttagtctattcgatcagatatgctacacatgatgcacactccttcgccatcttaatgcgcccggcaacaatgtagtatttttttttatgttgcagtgcagtcggtatgcactttgcgtggacttaaacatgcgtcaacacgtgtgtatatacagcatagttgtgtacatgttggctgtagctacagaaaaatagtggttctataacttttggtagcggccttaattagttccagatctcccaagtgctccactacatattcgtgcatgagtttgggcgacacgcaagcatgtatgtgtggatatcacccttcagccaccgtgttgcaaaatattactaagagacactccatacgcaggtactcctcctactaattagtagtgctgtgcataagctcagactcagggagaagcctaggaaggcaaagagaggaaaaaatttcggcacgtacactgtcccggtcgagattggcgcatgaatcctcgtgatgcaggtctccggtacccgactgcggtgcgcccgttcgcacaccatcatgctctgttgcacggttgaacctgtcgtcgaccacgctgagccgcgtgccgtatgcctcgcttgccggccgcgcggcgcgggccacgactccatccgcacgagacgggctacccacccatgggccgcgtgctctcctgcgttggcgtccggcacccaagacaccagcaccccgcgcggcccagcaagttaagggataagtcgccgccgcgcgaggacgcgggcgcggactcggctctggtccctccccttatcctgaggcgaccctcctggtgcgcgcgccaccaccgcaagtcgttgttgcaaccgcgagcctcgctcgtctcctcttcctcctcctcctcctcgacatggtcagcgagcaaacggcgccggtggcgaccgccgaggcggagctggagagcagcgccgcgccgcccgtcaagcccgacgaggccgcggccaaggcgcagccggaggacgacgcccccgttgtggaggatgccaaggatgatgacgacgacgaagaagacgacgatgacgacgaggatgaggatgaagacggttaactctcttcctcctcttctccttcttcttctcgtttcgtcttcgttaatactgcaatctttccatgtgaaatgcagcgtgtgtggtagttgggttttactactgtttagaaacgtattagtgcgtcggggtgcttggatttcgttaatggtgtctctttcggttcttgtagcaattactaatgtactactctagatagcaagatttatagcctgacttgcagttttaaatgaccttgaattgaaggtgaacaaggtgcaatcggaaacgagggctccaagcagagcaggagcgagaagaagagccgcaaggccatgatgaagctcggaatgaaacccgtcacgggagtcagcaggattaccatcaagagagccaagaatgtaagaaactgtgcagctgctgcaaacaatctattcattcgaatggaagacagaattaatgttttctctgaatcccgtgtgtttcagatactgttcgtggtgtccaagcctgacgtcttcaagagcccgacgtcggagacgtacgtcatattcggggaggccaagatcgaggacctgagctcccagctgcaggcgcaggccgcgcagcagttcaggatgcaagacctgagcaaggtgatgtccaagccggacgcggcggcggcggcgccggccgacgaggaggaagaggtggacgagacagggatagagccccgcgacatcgacctcgtcatgacgcaggccagcgtgtcgcgggccaaggccgtcaaggcgctcaaggcgcacgacggcgacattgtgagcgccatcatggagctcacggcctgaagccccctcctgctgctgcattggcaccacctctcttcccccatttcagtatcgtgtttttttttatggcgtttcgtcgtgggtttgcataagatgccctgtttgttcagctgctggactttgcatcaaacttttcatagcatgttcccatattagtgtcatcttaaatggagttttcagacttgtttgaacggcaacaccaatagagttcgatattttgagtcaattaagaggagaaataagatgttcaccaaatccatagcatgccagcgcaatggtaatataaatttattggattaatgcattgttttgtttacacattgcacgacagaattatgaggccccgcgcctatcctatgctatcaagctatcctttttctatcgcggctcctatttatcacatctcaccactataatcgccagcgcaggtaaaaataatcctctactctcactcaccagctctggttatgtccttattagccaaagctgaggagcactgaatgggtaattaattttgtgtttgtgtaagaatgctgaatgcctaacaccacaaatgcccacaatgccaccaccaataacaaccacagtgcctacggctgcttaccgtcaggcttgtcagggaaatctctattcagaagctcgaggagaagaactgcagcagagtctttagccttcttcacactaggcattggctctccaatgcattcatccgtccatccacgatcagaagtgttcaccctcaccgaatagacgaatcttttagcatgggcagggccaccctcgtttacgcacctgtactgaggcattggccactgccttctcaagcagatgtcgttcagggtctgcctggtgaacatctgagcaccatttttcttctcgccatccctttcatcttctttctttgttgcggtttccttctccttcaggaccacaagtgcattcctcgctgccaacttctgtgccatcttcttctgagggttctgagctacaccgatctgaacaccatcaacaaatacttcaacagtagctatgttgcctgctcgggatgctttgtattccaggccttcagcctgctgttggcagcgttcttggagctccctaactggatgcatcggaagggtctctggcgtcaccattggatgaaggagtggctgaaaaacctggtgcagaatagttttatttagagaacttatatcgaatgagcacttcaacaaagatccctttcaaacagtccagaaatgattaccttccagacaactgaggtatcatatccactatccaggaatatcgcgccagcaatcgactcaacaatgtcaccaagaactttaggagccttacaatccccaagcccaaaagaattgaaacctggtttcaaaagctcctcttggacatctttcacaaactctcgaatctacggaagattgaattaagagtcagcattgctttcagaaaagaagaggaaaaaggttcttcctaatcaaacaagacctaccaacaatgtctagtttgtcaccacaaagaaaaatacctacctgtgtttctaatgcagatgatccatggcgaagatgtacatgcagcttatgcttaactgcaacccttgcaaaattctcattattaacagctgcagctctcaaatcagtcaagcggccaggaggtaggtcagtatatgtaaaaaacaaatgcctggttatgagatgatccaacacagcatcaccaacaaattccaaacgctggtaacaggaaacaccagaagatggtctcgatgcatgtgttatggcctcaacaagtaaacctttattctggaattcgatacccaagacacctttcaacgtgtcaaagttgatgcttctcattatgctctcaggaatgtcatatggctttggaggtgggatctcttcaggatccaactctgcatgaattccaatccatttcatcaggtggtttgcagcgattttccctcctgctacataatacaccccaataagtgcctcaacaacatccgctaaagttttgctcgacagaacccgatagcagctagagtctccttcaatttcaccatcttcttgcatgttatctgcatagtcatcataggattccttctgtaactcgcaaccagttgattcctcgtcaaagatggaaggttcatactctctagactcttcatcgaatacaggtagcactcctggagctgcccatcttgatggagcaaaccggtctgcttgaatatatgattggagggttttattcagagcatattggtacaggaccatgttactaaccatctgctgccgcatccttgtaagctgtccctcatgcttttgaggatattttaggaagaggaatctactcacgacccatttcaggtatgcatcacccagcagctctgctctttcatagcataatgtctcctggcatgatgcagcagtcaaggcttctagtatctgccatgaaccccaacaagcacttgtgaatttatgaatcaacaagcatatataagcatttttttcaaaaataaaattatatttttggcccacatgcaacgagtcaaaaagagtagaggaaaatattaggtgagcactccagggaggcactgaaatgcaaaatagggagcagatagaaaattaaaaataccatgtaccccctatatgatacatggcatacagttaatcagcaacctcccaaaattaatcattcttttggaaatatagtccttacaagcaccctttagtttaggatgattacctgttatttcaaaactaacataaattatggatgctgagtgaatccttgtttatcacttgcctaccaacactaatcaaaattcaagatttcaagataattgtgggcctcctgtggtaatatgccacatttgacattcggtgtgaagtcatgtcacatgtgctactgtcttctagctaacaagcagaacccactaaagctagatgccctatttaacacatagtcactagatgagaatggtgtgttataaaaaggtaagaaaatgcaagggactaccaggggggacataagatgcttttcctaaaaatgaccatttgggtagtcaaggatgctgagattaccttagttgcaggaacagggtaatcaattatgtccttcaattgaactgcaagaagcatgctctccacccttctcattattgagggcaacctctgagctccacgaactagtgatccaggaagtgggtgcacaaggcacaactcaggtggcaaatacacgtagtatgttttgtcaaggttctcagagaagtcaccttctctagctgttgaacaaatggtagcataataatcacataagactttagtttattttccttcaaaatattgtcatataccactgctcagaatgaaatattaaataataaaacaaaatgactgcataactttaccgtcagaatgctcaaatctaggagaaagaagattcttgcaatatgaaacaccacgggcccgtataagaggctgtttcctatagattaactccacaccgtacctgagaacaagacagtgaatcatgctgtatttctctaaagttgtaaagccataaaagggaaggaaaatggggaactcaagagtaaaaaaaactaaagcgccactctccttgatttcagaattaaataaaaggtcatcttacttctgcttgtagtaatcagcatatgaactatactccaatggccccaggtagccttctttcctagggaatgaattttctgcattcatgttatagcaaatgcagtccacataaaacctcttccctgagtgggcagcagtgacaaccattccagcaagatctttagcattccaacatgaatctgccatgaacaacttgccttggttctgataatcactaaaatgtcctctatcacgagcaggaactaatccagatgctttcacaatgtcaaattcagcaatagctcccctaataccataagtaggatgggccttttgtccaaaagcagtcccatggcgcaatttcccaaacccgtattccctcctatccccaccaagtgttcgttcattggtgcctagatagacatctgggcgtgccctctgaagtggattgttccaggcatcagtgttaacaatgttgttaaccaaagtccaatcaatctctcttaaaggatctgtacacttctcagctcctacagggacaaagaggtatgcttttgcgggatcccaaggtgtagttgagggatcaacatcaacatcaagtactatgctcatgagcctaacatgaaagctcttcagcaacaccagctggaatcacaatattaggtattagctacattaatgtaaaaccatgaaaatggaagttcttcatttgccaagaaggtcaacctgactttctgtaatttcaattcgtccacggaatacgagagatgcctttgttatcattgtccttgcaacaaagagatccatcgtcgtcgataaaacctgaaaagaaaagaacaagtgcttatgttacagttttagactattttattcaagtttcaggacatgcattatgcatatgatggaacatacctctgcatccagctcattgccaaaaataattgcaaaatttgaaagttgtgtaacgaaagggtccttagaagtcccaacgtttacacagttcacagaatacatatataacttaataaattgagagttttggtagccatctctgccagataaaatccattctccctgttggaatccattgaaaaaaattcaagataatggttagttgcactggaaagtgcacagaaataaatgagtgagaatgaaatttctcacccgtagaatatcagcaacaccttcaggataaaactctctatggcgagctgttccaggaagtggttcaccttcatcattctgctcagttttttccccttccccgcttcctctgtcaggtaagagcgtatctgtgaaggcacccatctcatgcagcttcttacaagcagccaaacaaacagcctgcacaaagagaacaagtgtggtttcatgttagtgatggccaaaagggctacaggactggtattattatggtttttttaactcaaacaaaagcatcatattacctgctgtgccagtcgtattgaactgcatataggaccctcaagtttttcgaacggggcattacaagggagctgaagcttgcaagaatattccgatgaaccacctggctgctcatacttttgcatagatgaattccggatgaagaattgagtttctgagaataggaaaatcagggtgaatctgacaccatgatattctaaataagctttgtacactaaaaatacattaaataatttacctgtcacttggcaactgtgaacagtaaaaatgtatgagtccaactgctgagttcaagctgacaacagcacctgttgattcaacctgatacattgaaccaggtgatgtatcaacaggactcaacacagaagtaccatccaaatgactaagatcggttctttccatagcttcctttctcaacgtctcctcactattccgagcattcctcaaaaaagtttcatgtgatatattgcccctgtgcatttacaaatttacaagccaattgagtaaaaataaccactatatcaaatccaaaggcttaatcgttcaattttgtgtctatatttgctaatcgagtaaaattaacctttcaagcattaatatataatcagatccaggctttcttgcacgaccacgtgactgtatgtaggctaagacggtctttgcaaggtcaaatcgaatgacaacattgcactgtcgaatatcaagcccttcctctgcaacgcttgttgcgactaaaagtgtaacctgcaaggcatgtcaaaaacatttatgagaaatcatctggcattgagtaataaatgagctgcaactgacaggtggttatcacttatcgttgacaaatgaaataaattaacattgtcaagaaacatacacggccatcacgaaattttgaaattgtatcctgcatctggcacgcgcgcatctcttgattattgttatggcctatcaagcttgcacatcgaataaaacttagagatggaagttctgccaatacctatcaggttaaaaaaagaaaaagaaaaacaaagagcattaacaaaaggatataaagggaatacatgtacagaaataaaacttcaacagcacttcaccttaggaagaactaatgctgtcacaactctctccacaaagattatggcacgaaaatcctcagtatgctgatatttgagaagtattttgatcaaagcctgcaccctaggagtaactttaccatctgctacggcagcaccgataacttcatctacatgctcacctacagaaacagctggtgggaaaaatgatatcattagaaagagactgagctagactcacaagtcaaataatcaaatattaaaagcaaagtaggcatcaaaatggcatggagaagttaagtcacataatgataaagattaacgaaaaaggggcatcaaaatgatggaaggttaaaaggaaaatctaaaggaacaacaactacataacacacttaaaattaagacaaaataataccatgactgtcaggcagctccccctcctcaaggtcatttgtgttgtgtttttcagtattttgcatttcaacatcactggtctcacttttcattgcagccccttcagtcaactggcagtgtaacagatcaacaaccttttttaaataagactcttgaaacttgacatcaacctgatagtttgccctttcatcattttgtaatgcagtcaaaaaggactgtgcaacctgaaattaggagaagaacaattaaaaatgcacaatgattaatgagacgctaatgttcaacatgaaagaaataccttatatgcacaccattgtccaagttcacctaaagcataatttatagctctcaacttctggattaaattagccgcaccatcactctctgtacgctctgaaacaccatagacaagacgcagctcatctctagacccagcatccctagcccccatgaactgccatttagttctcttagagctagagagtgcagcttcttcaaccgtgctttccatttgtttgatttgctcatgcaaggaccaaagagtggctgctttgtcatattggacaacaacttccaaaggcatggggacatgcttctcaagctctttacgatctttgatggtacaaactactgaatctagtttgctctcaagatttcttatcttgatggcacagtcctcttgactcgtcactcctatccacataatagtattaacaaacatatgaaaaccaacggcgaatctacgtatgaaacagcgattgatcatgaaagatggaaacggtggcaggaacagggcagggaaataccttttagattgacaggagaagccgtcataccgaaaactgctggcctcttctccttcggagtcgtgtgataaaattctgacatcactagagaatatggatgttttttcactgcatgatggcactcatctaaaatcaaaagatgtatcgcatccattttaataatactgtgcctgaggatgtttaacaaaatttgggctgtcataactagtacctgcgtgaaaaggaatgcatctaatgtgagcaaatcacaaaagatatttaattcaatgcaaatacgcctttccttttgtaatagaaaaacataaataatttccacagatggatgcgcatccagccatcgatatacaggcatacagcacgtgataaattgagatattttcaacttccacacgagcaaaacgtgccaagtatgggacgtgcaagaaaacgaaaggctgtggttaattagaatataaagatggttatcaatatatcccaaaattacgagaatatatatcaggtagccgatcccttttaccatcccaatttttctttcatgcatggcaagtcggctacactatgtcttgattgataccaaaagccatgatcacgaatgaaggatgcacaggtcacgttcacaaaatgatgtactatatatgaaggatttttttagaaatctgctatctaggtcttgagtattatcattgataatatatagcaatgccattcacgcaattgctccattataatacaatttaatatccgagggaattgcacaaacaagtgttggtcaaataagagcgattttaggaaaaggtacagctcagagttaggccatgaaacatcctcaataataatggtgtaaaattagaaatgcaaaagcaaattgaagaaataaatttgcctgtttcgactcgaattcgcgctgccactttctagcatcccagaaatcctgtcccatctctccacaataatgcccaacacgatagccggttctgtcacgaatcacctcagcttgctgcaatttcagtaacacagttattcctcccaaaacttccaacctttacagattgaaagcacactcgtttatctgtacctgatacacaagaggcaccttgggaaccaagaagacagcaagcatcttcttgttctccttgagcattttatcgcacacacttttgatgagaagcacggcgatgagagtcttccctgcgccagtctccaggaaggctattgtgttcctgctcttagcttgctcaagcacctctagctggtattgccttgcacgctcctccgcgacaggcttctcccgctgcgcagcccccatcctatctgcctctgccttcttctccatggagcctccatcttgcgtcctggcacgctttgcctcgcggtcagactcctgctcccaggtgcctgagcggaacaccatcttgccgccgcggtcacgctcccagaaaccccgggcctcgcgccgatggtgctcgtgcttgcggaccctgtcgaaatcgcgccttccacgcctgtcatcccacccacgcgagggcggtggtggcagcatcggcctccgccgccactcctgacgcggtcccccgacaccaccggaggcgaggcgcgggcgcttcccgtccctccactccccaccgccgccgccatttgcagcacagccatgcgactccctcctcggctccttcctcgccaccacgcctttacttctctgcacaacgcccaccaccgccacggcattgttggccacgggcgcagaggccacctgtaattgcttttcctgaatcggtagctccggcggagccacaggcacgggctcaggtagcggcggcggcggcgggggtgggggcgcaggggagctctccgcgttgatgctctcgagtatcctgtcgatctcggcgacgaagccgtcgtcggcgccggtgtccatcgcgggtatgaggccggggtcgaagtccgcggacgcggcgaagtcgatgccgcacagcagcgacgcgccgtcctcgcacgcgtcgtaccagtacgccgccgccgcgtgctcgccagcgcctcctccaactcctcctcctcccgccatcgctcccgccgtcaacagcagctgcaagcaagcagtcacacagcaccacaccaacacccgaccacttcactcctccattaatcagaagcagcagaatacaaaagacgagagatgaggaggggaaaacgaatgttggtactactactgctgctgctgctgctactacttccggtgggcgtgggcgttgcggcgcgcgcggcggtgacgacgatgcgacggggagagtggaagagaaagaggcggtgataaaccgtacgaatcacgcaaacgcaagagggaaaggaaagggaagggatgcgatgctccccattccgattccgatatggggagaggggaggcgatggtgggggtccggcacgattcgattcgattcgacggtgtatcaacgctactctttctcttcactctctctctcttctctctctctctctcttcctctttcctctgatctcttctccctcctccgcttccctctctctctctctcgtgtgctcgctctctcgattgagatggcggacgaggaggaggaaggagaggagggggaagggacgcagcggcgcgtggagttcccgattaatggacgcccacctgaggggcagtgcgggggctctcccactggcgtgtggggacacgggcgcaacgcggtggaccgggcctacgcccgatctcgaggcgcgaacgcacggcggggatgggctccggtctatgggcgggttgcaggcggcggcggcgcggcggtacgggcccaactgctcctggactggggcgtttgttacttgtcgtgtgggtatgacctgatgggcccacctctcagtgagagcccccgcgtggggaggacggtgtcgagtgcgatgcgatggcgtgagccgtgaggaccgggtcgtaccgcgcgagtgactcgtgtgtcaggggcggttgttcgcccccacgagccgcggagcggaatggccggcttcgtacggcggaccccgtgtcagtctcatcagcggtggcccatgcttgggcccgttcggtaacagagaagatcaagggcatattcagattaaaaattttacttggcaagataataatattgttaaaattttggcaagattttttatatatttatcaaatttgacaaccaactaaacacagatatttttttggcaactttaccaaaaaatggtacgattgaaaatagcatcaaattgaataggccctaatttataagaaagtcatgtaggattgtttatattatagctaaaataaaccttatcaaattttggcattgtcaacattttagcacgttgataatattaccaaaattttttggaaggatatcttatgccaaaatttgataaaaaaaactaaatatatgcacatctttagcaatttcaccaaaaaaatggtatggttaaaaatatcatcaatctgaaccgcctcataattcatttttttatgaaaggaaaataatgatttgtttaagaaatagatatattgcagttccaaacgataattttgtaatggccccaaatttgccctaaacttaaccttcacaggcaatcccatcaaaccatacgctaatcaaggaataacgctccattttgacttgccctctctcccgacatacttgcgtattcatcagctaattgatgaggatttatagggactcgttcactattgtgttcagttagaagaatttgaggtacatcatttcatggcggtctcgtttttaattcatatgttttgtttgggaattgagcgtagccgactagataggtcctttgtggtggaacaaggccatccatgtttaattcctaaa

SEQ ID NO: 20747 - DNA, 10150 bp, Oryza sativa
tttgtacattttatcctctttttagttgttttctttcaccttttcttttgagaaaaagaccaacttgaataaaccaaaattattgaaggttatataagttatccaatcgtcgatagtattatttgcgaaaatttcatatttcaactttctattttctaaaattcaaatgcataacccatggatgaaattacatttgattttaaaaattaataatttacctaaaaatattttaaaaaatcagcatttgggtatattaaacccaaataaatcatgcttattccaaaataaatattattgcaagcataaaaggtgattttaaccatattatggaactaccttacacaacctactaaaaatgatatattaaacatttttttcatgtactagttttaaaatttcaaaagtcttttcaaccttaaatcataaggacatgtcatacaaaactattttaaattggccaaaggatgaaatgtgaatggtttgtaaagcttaggacggttgatgtccagttttagaatttaaggatgctaaaagataggaaaagtccactgttttccgtgcatgcttcccaatttgctaaaatatgttttttttaaaaaaatatgtctaatagtttcttgaaaattgtaataatctacttctaagtttgaaataattaatatttgcactaatagtttatctcgttttacatatcttttcaaaaaaaatttacatttctcttctatccagcacaccctagagagagtattgtagacttctgtataagttcaaggaagtaaagagaggttttgtccgattatattttgggaccttttttttttgccttgagaaaatgattggccacgacagtagcttatgatcggccagtgtgattgctgctcctcctaattagaggtgaaaacggagcgagtatttcccaactgcctgcccgaccaagaaccgcagaaagaatatgggggagaaaatgggatgccagttcgaatccgaatccgtacaaaaaaaaagggttggttacgggaagagttgtagctgcttgtatgtcctatataatacgaaatatatatgaaaatctattataagtccacctacaaagtagaaatattgattaatcactattttacaagctcacatgtaatattctatatttttcccccttgttgtatctcttttagcactttaattgcatccttatattttatatctatgaattagagacacaaataaatatgcattcctaagtccgattcaaaggaaataacatggattaggatacatatagataatatattacccggtatccagtttcagttttttaaaaaaatagaaaaaatatccgtgcgttgcaatgggtgaatactattttaatcttattattattatactgtttagctaggatgaaatttaacgcgagaattcttttgcatatttttttttagaaaatcatgaactgcaattaggagttggactttcatctcaagttaacatgcaagcttttttatagagatttcttatatgacttcttttgtatttctaaaagcaaacgaacttaaaatcggactcaaacatggatctctattttcaaaagtgaacgaacttaaaaaatgcccaaatacggataacgtaccaaaataccgacaaaaacattttaatttttcgggaaggctaaatggttgtcgaatgatttttgataactaaatcattcatgttttaatatattcagaactgttgtttaatacgttatagcaaaatgttttatgagatgatttggttgtgtttcgattttttaaaagattgaaaccttctcaatttacttggtgaaacattttcaatatgggttagtatatgaaacgccgggattcgtctgaacccgtccattttacccctacccctgatccaccgctccggcgagtccactagagaggacgaaaaggcattaatcctgaaaaaaccacattgttcttcgaaccccactgaaccctaaccattcctatggcccttggggaaaaaggaagagaaaacacgtccaagttcgttttgacaatacgctcctttcagaaaatcgaacaaaatccatcccctgaagcagatatgctacacgaatactacacgatggacgagcacacgggacaaggacagtgagccccaaaatgggcgagaaaagctgtcacttctcctggagaagaatctctgcctttccaccccccaaatttacgacgttcgtcagcggctcgcagtacagtggagtgatggctagccttgctcctcgaccttctcctctgacaaaagtggctcaagtgagcaatagtgtgtgtgtgtgtgagtactgatagagatatttatgggcgccccgacaggggatcctctgcccgggaatcctgtatgattgttgctctgcctttaaggcgttaccagctcggatccagtgtcgtgtgcctaacacaggacattgctcttgacatttccaatcgaccattcagagcaagtagagcaggcatattataaaccagtataaacatattttaaagagataaaagaatatagataagagtagcgggctacagatctatagccagctgtagcacggacttcaagacgtaatatgtgtatgatagatgtgaccaagtattaatagtatagtaaataactattgtatgaattgactattacattgactatagatgatttgaagttagtagtgggctatactattaaacttgatcgtatagtagtaagctagccagctaaatactgaggttgagagagaggagaagcgggctgtaaacttacagccggcttgagcacaagaatcaagaaactatgtgagagaaacaggtgggccctgtattaaattgtaaagagcaaactattactacctccgccccaaaatatagcaatttttagttatgaatctgaacacagttatccagattcatagctaaaaatacttatattttaggacggagggagtatatgggtaggctaaaagaagactaaaaaaaccttatagtcaacaggtcagctgtattattaggcttgctctcaagccaaaagaaaagcctttcttcaactttttgagcattcatgtttgtctgacaactctattcatgttttccaacagtcagaagatttgcttttcgcaaatattatgcgccattcatatgtgtccgacaactccattggttttttccaacaaccacaagcatactcagttatgtaaaaaaaaaaatttcatccagtttcatagtactagaaattatcataatatatactatatatatttactttagtgtgaatgaagtatgcggcagtgtgaagcaactaaatggaactcgtttcaataatttagcatgacattaggtacaggcgtccaacatagcgaatatgccaggaacagtgtttagttaatgcaatgattggttcagcatagatcgacattagtcactacaacagcttcaatccatctgaaaatgtttttgaatgaaaaacccaactccacgacatccctcacttgtagaaaacgaggagcaccgagctacaccgatcgcatagtccgcgagaacatcgatcgacaagtggaggagacaaaggaacaatgagcatccagtgcagggaacatctgatccagcacaatcgtagtcaatgttagagcttgatcattttgatgccattttcaaccttaccaaattttaataaaattgataaaaaatggctgcatttagtttgctgccaaattttagtaactatataagaaattctgtcaaaattttgataactataccaaaattttagcaatgccaaaatttagtaaggtttttttttaacatcagagtgaacaggtcgttagtatcagagtgaacaggtcgttagcaccaacaaaggttcatcgcgagctgatactgagaacctgataccgcgaacgtcctggctgcagaaagatgagaaaattcggcggcccagtagtcaacgacaaaaaagataaacctggcccactcgaaaagcccaccttttctcacagcccaagcaaagtgcaaggccttttttctccacggacggcctctgttggaccacgtgcgcgcgagcccgattccccgcggtagcagcatcccacacgacacctgtcgcgtcaacgcggcagtagtggttcctttcccgggaacaacaccttctaccacacgaaacacatccgcagaagaattcgcaatagttggatggggaagttcttaggcactgtcacatagtatgtttatactaattagaattattaaacgtagactaattagaattattaaacgtagactaatgataaaacccattttaaaactcttgactaattcacgagatgaatatattgagcctaattaattcatgattagcctacataatactacagtaagcattctctaataatagattaattagacttaaaaaatttgtctcgcgaattacctatcatttatatgtaactagttttgtaaatagtctaagtttaatactttatactagttcaacattcgatttgacatggcttaatccctgtatccaaaccccacctataaacgaccccattgcgggcccggcccatataacctgaaacgtacttgtgccgtataaaaagggagaagatacagcccatagtctcactgacactaggggctccacggagagtgggcccatcgtgtcagtgtcgtacaagcgtatctccctttgaccgggggatattcgaaacgtattccgtttcgagtgactgacgtgtgggctcggtggtagataaactcggagacgaattcaccgccacaaatatccccaacccaccaccgggggcccccctaatccaaactgtttctcggcttccgctacacgcctcgccgaccaccatgacgatggctgcggcgccggcgaggtcggcgggggcggcggcggagaagaggatggtggatccgccgcgggtggtcggggagtacaagctgctggaggagattggggtgggctcgttcgcgaaggtgtacctcgcgacgcacctccgcaccggcgatgtcgtggcggtgaaggagatcgaccccaggaggatcgacgagcgcgtccgcggcggaatcctcgaggagaaggccatcctctccaccctttcccaccccaacatccttcgcctcatcgacaccatccaggtagtaacccctaaaccttccaacccaggcacccaaccgccatcgcaatcgcaactgaactccgagcgagtagtaaggttaacgatgtgaaattagtaaaatgacttgtggttttcaaaggaggagaatctgtacctgattctggagtactgcaatggaggcgacctcgaggggtacaggacgaagggcggcgaggacgcccggttgccggacgccaccgcgagggacttcatgcggcagctcggtatggcctcaatcgagatttgaatggagttccttgtcctttagttgttgtcttagttacattttctaggtttttggaacggtgtagttatgcgtcttttgcccctcttttttatttgtagcggaagggctcaagatgctgaggggaagatcaatcgtgcaccgcgacctcaagcctcaggttagatcttacatgcggagctattaaatttttgctgtttgagtcggtttgcaatttttagatgttttgtttggataccatatgcaaactaactgtaatgattatgtctgaagttaagacgttttgtaatttcttgtactgttgtgcaaatgggctccatatttagcatctaaagtgatcaatacctaacaactaatattgacttgattgggctgaccccagtcattattagttcaccaccaaatgtcaaaaagttgcatgtacgatttctctatacgttcatgctattatccactcagtaactcaatatatgtttgaggaaaaaaaacccaaaaaggtgtacattgtaatagtgtccatgtgtttatttttggctattgatttgttttatcctttgagataatatatttttacccataccgaccaatatgtgaaacttgcagaatcttctgctatcaactaatggtgatgccatcacactgaaaattggagattttgggtttgctaggtgtgggctctatttcccttctgttgtatatatatttgtaggcttatatattttttctcctttacttgaattaccgggggccaatccccaaatatctacagctgttacccattttccaatttctacagtttcttccctttttccgaaggttactatgaactttttgttagtaaacaatgtgtgaatgatattttggaattgttcccaggtctcttgtgcaagaaaatttagctgctacaatgtgtggatctccatcctatatggcgccagaaattatgcgatgtgaggattacgatgcaaaggtttgttcattcacctatgcttttgggtgttttaatatagctagacaataatcccaaccatatgttctttcaggcagacttgtggagtgttggtgttattctttttcagctagtcacagggaaattgcctttttatggggctaatctattcaaggtttgctcttatgcataattagatgtatgtggaccataaaaatacatatatcctgtaatattgttcttgattgttgttctttgaatatagctgaggcaaaacatccatgaatctaacggcgttaagttccctaaagaaatcaaggatgatttacatcctgatttcattgacctgtgccgagggctcctacgtcttgatccaagtaagtttgtatttctcttcatttttgtttgtgcaaagcagtgtgtattaactactccctccgtcccataatataagggattttgagtttttgtttgcactgtttgaccactcgtcttattcaaaaaaaataaacttgaatagttatgcactgtagtagattttttaggcatattcactctgaattaaaaaagtcttcaacattaaactttgacaatcaatttctcataaatataagtatttttttccatagcttatgaaattaagataatgcggaagcaactctgggatatgaatttattggtattattcttgtactgcattgcttagaccacttgttctaagctacgtagtatttgttaagtttatttctcaaaatgtttaatttatccttataatgaagtatataatctgcggtcaataatctatctcaattctcaaatggagcctacacttgtaattggactaactgtttgtcaaaacgaacacagtttgatttttttaaaataaaaatatgccttataaaaattaatggaaggaacaatttctttcaagtttcaactgtcatctgtgtaatttcgttaatcattggtcttgatcttattattccttactaattactaattggtgaatcatattaaaacacaatttctattttgcagagaagagaatttcttttgaggaattcttcaatcacaagtttttgtcaacaactgggtcgaccctttactctggtggaagcattcaaaggtctatctggctatgttgcaaaatgtgcattgttatcataatccatgtccatacctaatcttcaatttaacttaaccaaatactactctgctgctgccaatacggcattcatcctcacttgtaggcagcccaaaaaatgtacataaagagacatacatgcattgccttcaacataatataaacctctaaaatttcaagatgaattgaacatatgatatttggaatggtacattgtacatttctcaagttctcatgaatggtgaattactcaatatacagcatacttgcagtcttttcccatactctccatgtatttgtggaatagttgccataataatgtggacatgggtttgattgtgtcatatttgtctcctgtgttgaagttttctgattctttttccaggaaaagagagattagcagtgagcccaatcatcctgctgatttattaagggatacatgccagatcatttcttcggatgtcctgaaagataagtctgaaagcgtggattctagaaatttgcaaggtaaattagactcccaactagtattcagatttcatacgtccctgctctggcattaactctgtatatttttgcagcatttgattcatgggaatggattgaacgagaatatgtacttgttcaggcgaactctacttccacggaaattttgtcttcacttgaaaagtcaatgaaggatggtacaggtgcaaaacctgccagctatgataggtccactgttaaacggtctgcttggaaccaaaacagaaattcagtcagtagaggggttgctataaaaagcaatggatgcaccccattgtctacttcccatgaatcaacagctgcagaaaatctgctaaatccaccttattgttacacaaggcttcaactccttaaccagtatattgttgttcttacagaacttgcagaggagaaggtattactactgcttttactgggatataacactatgtccattgaatgccatctgtgttttgtagttgtgtgcagtctgtagctccttatgtttgttatgatgaaacagtggttttttgttgctaagcttcatctgctcatatacttactatgttccttgctagaatgcttgttgagttctttgaccagatgaatgtttgtagagttatccctagtaatttaaatcatgcaggtgatgtctaggtttaaatgattttcatcagatgtagaggtcacagccttccacatgccatttttcattgatatacccgtgtatcaacacattaagcaatactcttagtctccaagtcatgatatttctggcatatctcttcttctcagttttttttaacataaagctttgtccatatatatattgtatagcatcaaatagatgaatcttttgtgcacttctcttcagaatgtcgatgccagacaaaattctccttttgtattgatgctcatagcatagctatgatattttgagaattgagaacctattagtccagtttgatctaagaattatgttttgttgtttttcatattggcatttctgtgtggatgcagctttttaaagggctggacttggaggcactatctgttgaacttataatattagctatttggaacgaggcccttaatgcatgtagtttatccacggatgctacacatgatggattttttttgacccaagctcatgtcaatttcctgcctaagaatgaccatcgtccatctcgaaatgtagtacaaggattggatttcaccaggctcgtttctgtctgttcctgggctgaaagtggctttatcaaggcatatgaccgtgcagagaagatatcacataggttgcgggacaacaatggttagaacattggtatcttcatgtcctagtatagttttgtttttgttttttgctataacccttgtttgtttccagataacaccgagatgccagatgcagtggagatcatattccagacagctttaatatatggaacaactggtgctgtaagtatcagtattctaggttcttgtatggtttctttacagctttcgtttttccttgcacttcatggatttggggggaaagtgggggagtggtgtatgcatttcacgattttgggtaacaagcaatgatgctacaacggaaaggaaacctgtagacttgtagttaatgtgtaccagcccaggatccaccgctgtgcactggttgtccaggcggttggttagttattatcactccatattctgttagaccacgaacaaggggcagaaatgaatactattgttttaggctgtgtttgagggagagggaattgagaagattgggaagatacgcaaaacgaggtgagccattagcacatgattaattgagtattaactattttaaacttcaaaaatggactaatatgattttttaaagcaacttttctatagaaaatttttgcaaaaaatacaccgtttagtagtttgaaaagcgtgcgcgcgaaaaacgagatacaatctcccctttctcatgtgaacaaacgcagccttagactgcagtgggaaagaaaaacaactttcttttacaaatgagcaaaaatgtttatagccagccagtctctgctctctacttctattaaagcgctattcatgggggaaagcggtattcatggggaaaaaacttttatgaaa

SEQ ID NO: 20748 - DNA, 432 bp, Oryza sativa
  unsure (1)..(432): unsure at all n locations
cttgctcacatttgtattgcaagaagcaactaatttgccactgaatccgccgttttccctttcatcatctgatcagcaacgtatccataggtacatagctaatttgaggagccatctatgcagtgcccagctgaccggacaacaggagagatatgtccagaactaacttttacatgggaaatattggtgcacaaagaagtgaaagttaaattgattccgtggtaaacttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20749 - DNA, 4379 bp, Oryza sativa
  unsure (1)..(4379): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggacaggaggaacttactgtgctaatgaagcaaaacatacaagaccatgagagggttcttagtgtatcgactgttgatgctgatctaccgtccttgtaagaattaaaattctggtgcttactcttctggtctttcacagttcatttcattgtcatcttaaagttgcagttatatgttactgaaactggatctggatatcttgcaaattacaatgccatttaaactctttatctcttaaggggaaatagttttttttttttgagaaaaatgtgcattcatctgaaaatagtatagaatcaaccgatgaataattttcccatcatcaatatataagtctactttcataattttaatgatatttatcaattgatttcagtatcaacaagaagatggagcagatggagcaaacaatagctagagcaaaatcttgcactgtagattgtcgaaatgttgacaggaaacttcgtcagatacttgacatgactgaggatgaagctcactttcatatgaagcagagtgcattcctctacaaccttggtgctcagacgttgcctaagagtcatcactgtctatctatgaggttgacattagagtatttcacatcctcttcactgggttcaaatgattcttctgctcgcaaatttagtgctgcacatggtaggcactatgtcatactatctaagaacatccttgctgcttcggttgttatcaactcaacagtgaacagttcaaaggtatgtggatggtttttattctttacagtgtttagtttttgcattatattcgaggtgggtgttgcttatattcatgttggtcttttcgcaggacccaaaaaaaatcatttttcatatcttaactgatgctcaaaatttctatgccatgaaatactggtttgacaaaaagtcatacagagaggcagctatccatgtcgtgaactatgaggatattatcaaggagaagttaacaaagtttaatgtgcggcacctgtatctgtccgaggagttccgtgttcttgttaggagtactgagcaacctgctgggaagacaagaatggaatacctatcattatttagtcactcacatttcttcattccagaaatatttaaggatctaaataaggtggttgtgttggatgatgatgtggttgttcaacgtgatctttctttcttgtggtctcttgatatgggggacaaggtaaatggtgctatcgaattttgtggtttaagactgggtcaagtgagaaatctcttgggtagtacaacagttgataccaagtcatgtgcatggatgtctggaataaatgttataaatttggataaatggaggaagcacaaagttacagagaactacctgctgcttctgaaaaaggttggtatagttctggtctatttattttcttgcgatagcatatgataagaaaagggcacaacaaagggtgatctggaaagataatgtagtgctacttgtgtttttccagtctcagtctgaaaattatttgtcccactgttttttatgcacctcatggttactattatattgcacgtattaatctgactctgttgtgttgcagttcttgacgaaggatgagacatctctgcgagcagcagcctttcctctaagtttgttatctttccaacacctcatttatccccttgatgagaggttgattctatctggacttggatatgattatgcaattgatgaagacgttgcacggagttctgcagcattgcactacaatggcaatatgaaaccttggcttgaattaggtataccaagctacaggagatactggaagaggttcctaactcgagacgataaattcatggatgagtgcaacataattccctgacaaactgacacaattgaacctgggaatcagaccaaccgatagcagtgtgcatcaacgagtctcacccttatgtggcgtactgactggatgctatagctcccaaaagcttttattgtgcactacgactacaaatacagctgtggaacaggagaagggttgctatcgttggtcataaatgtcggcagaagagtggacaaagcatgttctattcattaattgacaggattgattaactattttttttgcgatgggattagtctcaaatatggggactacatgctttgcaggtattgatgatatgaatgagtcttcaagtaaaggtgggtgtcagcctcattgtccagatactcgttctcttggaagaaggcactgtccagattgttagatagggtattcaacgagcttcgggctcatggctgtgtttcacgccccatcgattcatgacggtttttcccttcctcttctgccaataagggtaaatatatgtaatcctgatagtcattgttttttggttcttagttgttgtacatggattatttatcgaattcttcacacggaaagtctgctattggaagctttcgacacctctgtgattaacctctactgtacatttcgacttgttcttcctcacttggtgattcattcattataattgaaatttggatatgaatattataaattgtactccgtccgtcctaaaatataagagattttagatggatgagacatatcttaatactacgaatatgaatagattttgtccagatttttagtattaggatattttacatatatttaaaatctcttatattttgggacagtgagagtattatcatgggggagaaatgcagctacaatcattgaacttaagcttgagattgattttccataaggtctacgtatctgagatatcaagactttcatgtcctctttatatttttggtcttaaacatttcagaacaaagtatgatctagatgtaatctgagcttccagcctcgttcgttcttactctcctccaacatgttcaatattgtgaaaataggagagtggttttaattgtgaaaaaacggttcgccacttctcttagcgatccggttatctgcttcatatgggccgcttagcaccaaagatagtaagcccgaacattaaatggaccgtaatccgtatgtagcatgcaactggcaagtatgttgggcttttaggtggtctgggccgtacactagtccgacgcgtactccgaagccaagcctgtgttggtttggtttgagggctaaataggtattaccaaattttgtcaatgctaaattttgacaagtttttgtatgactaattttggtaaggtaaagttgtgtttggattgaatccaaaatagcctaagttcactattgaaatggcctattttcaaaccaaatagacattaaacactatttaaattgttaaatattgacaagcctaatttaagtttcaaaccaaaccggcccttatttttctcgcctcgagtactcgcccacggccgccggccgacgccgcttcagacagtgcacaagacccctctcactcttttcaactcgcattttgagaagccggtgatccccgccgtgagacgcgggcggtcacccaggtatgctgctgtgtagttccggaatagaggcaagggtgtcaagcgggaactgttttaatagctcgagtaggcgttcactcgtttattgcatgtcatctaaatgagttattagaatccatcaccgtgtcaagctccaaaaccttgcattccattttttttctggagaagggtattttttacccggcctctatatccaaccggatatatacagcttttttttaataggaacttagcctaggaacttagcctatcgaacagggaactagccctcaaataacccaatctgaaattcgctcctatgaagatttgaactcaggaccttagagtgctactcagatcactgcaaccactaggctatatgccctttcacaaaccttgcattctacatattagttaggtttgttcaacagtaaactatagcatgcgaacaaccgaaaaggagctaatttgtcactcctgagatctgaaactggacggcagatcgcggtgtcgattcagagtttcagacttcatcaattaaaattttattagcacaccactctgatttatcatcaatcgcatatttggtttttttaaggatgctatgttcttcagttgcagttgatatatgagcctgaaaa

SEQ ID NO: 20750 - DNA, 13570 bp, Oryza sativa
tctcacgtcacgcgctgcgtatggtacaaaccaaggtgaaagtccgagcactgcacggtcggattgggacccatcggccatcgtcgccggcaatctcggcagacatccgcaactaactattcctccggccggccggccggcggccatctggattgatattaagtactactaatcagaatttttttagataattactactaatcagcatatgcatgcatggcggttggtgcagcgtttgatgatcgatcagacgaactaacatggatcatttataattgtactttatgccagctatctagtggcatctaacctgcttaatttgaccattgttagacgaccttatgcatgcaagcatgcatgcctgatgttgctaatcaagctacaacgcaagtcagtgtcatcaggtacgtacagttcatcgatcacgtttcacctcttttattgggttgctaattgtattgctgattccaatcacacttggaacgtggtttgtttctaattattttcctcttaaatgaactcccagggttctgttcttctttaaccaaatttgctgcaggacaataaaaaattatgtgatttgttagtagacatcaaaacgtgtcattgctgaaagacacttaaaaattaataatttgctggaggataattttaactcgattggagagaattcttctaaaagacgataatgtctaggatcgaaagcttttgatctgaagttgcaatgaggatggaatacgatgtatgctagtgatgtacttggaattatggtaaatgtggagttgcataatttttaattttttactctagcgttatatttgaagcatgttgttatatgggcattctcttctttcttaagaatttatctttcgaattgaagtaaattactagttttttaaagtgtctttcaaccgtgacatattttttttacaatgcctatcagcaacttacacaaaatttagatgtcctatagcaaaatttatcttatttttttatgttgctgaaaaaggaaggagggtacgggtcaagactccagaatggtttgaactccaacagcaatctctccattaaagaattcaccaacgatgaatctgatcaagctagctagctaatgtctactaacatgttaatcagctttaattaactagtgatcgattagcaagaacatctgtctgtcagtctgtcactagaagctcgaacgtcgttacactcctagcatatcgatttggcgccccattttaatcagcttcagtttgtggaccattgcaactagcatgtttttttagtactaaaccgaaaattgacagacgtaccattatatgctctgtaacttgggcttccaagactcttctctctaattatggagcactaggttgttgttcggaatcttctacttgaataagagggattaggttttcagcacgttgaagtgaccaatcatggtagactcctcttcaccgacgattgaccgcaatgtaaagtactagtcgattatagtattgcaatgaccaacaaccctataaatttcactcctttttggcaacatgcctccactcgaacttgctgaactttgttaggattatattgttggatccatcatggcagacaaggtgagtccttggtcctcctttctggcttccacagttttgctgcaaagcaaaggttgcatatgcattaaggtttttgcagaattaagctctgtttttgtattgcatggatgcttttatagcaaatggccagtttgatcattaaggcaaatctcgagtgtgaaaagtgttgcaagaagatccagaaagtccttaacaaactcaaaggtatgtatggatcaatgcacttgctgaattatgtaaatttaatcccataactaagttgtggcgtaaggccaaaaaggtggtacagtatatgattaagctgtggtttgaattgaacgaacagaagcagacaaggagaagatcattaacatcgtttatgagaactcgaacaatagggtgatcatatcgggccatttcaagccagaggagctcgcccataagctaagatgcaaggcctgcggggtcatcaaagacattgaatttgggaagcttgcagaggcaaagaaggaggagaagaagccggatcaggccaagaaggaggagaagaagcagcctgaggaaaagaaacctgaggagaagaagaaatccgaggaggagaagaagaagggcgacgagaagaaaccggaggaaggcaagaaggaagagaagaaggaggagaagccaaaggtgaaggaggagaccaaggccacgccggcgccgtcgtcgacgacggtgaacctgcagttcaccaacatgtgcggcatctgctacccgtggccgtgcagcgaccccacccactggggcgccggcgtcgtccacccgcagtggccgcagtgcgaagccccggcggcggcgttgccagcgttcgtccctggccaccaccaccaccagctcccgccatggggcggcgttccggcgccgaagtggccatgcggaggcccctcgtactgcggtgggtgcggcacctgtcgcggcggcgggtggccggcggcggcgccgatgcaggcgatgtgctgccctgcgccgtcgtcgtgcagagggtgcaagggttgccggctcgttcaggagggcaagttcgtgtacgaggagtacccggcggcgagcgcatgtgccgtcatgtgatgtgatcatcttcccctcgccgcaatgtcatcgttgacattctctcgatctgtctctctttctttcttccatctgcatctgatctgaagctactagtggtttgttcggtcatccaactgcagcgaagaaactcttccagctgccatgttcgcatgcacggcagtttcttttttcctcctaagttaaactatttttgctggagcatttaaccctgtaaatttttttcagtttgttctacactttattttactctgtaatagtatttctctctttcttcctcctatgtaagttgtatttttcgtagaaatttgataaagatgatagatgtattatactatgtttcaatgttttcttttagatctttttaacattgtttacataggttggaagtacttaaaactgatttaaacaccaagttcaagcaaacatccataaacaaatgaaaatatttttgactccaaaataaatgatgtgtatagagaggtaaaattaaagagacaaatactattaagaaataagtgaagcatttttaacaatttattggtacaacgaataaaaagtttaagggttaagtgatacaatgaaaatagttggagggagtaccctaagcgtgtgtttggttgcaaggttttggtgggttgggctagagccgtcccatttttacaggtgtttggttgaagaactgtgtgggctgggttgggtcaaaaaaggaatattctgcccatatgcgggttggtctcgctcggcaaaatgtggcggaccgatccatcccacctcctctcgcgcatcacgtgagaccacgcgagagtaaccctatctcttttctcaccacctttttccccttcacaatcacaagcgaaacaaatccaaatcgagagagggtggcggcggcaactagcgcgcaagggggcggcggcgcagagagggcggcggcgccggcgtcgtgccacgggccctgctgcgcctcctccttccagtcccacggccggaactcccgcctctcccgccccgtcagctccccctcacctccatagccaaggtaatgaaaccctagctatgtaccatatctgctattttgtttataatgctagatctgtgcgactccgtttgcatgaatgcccttgctgtccacaacttctgttcaagcacattgcaatatttttgtttcatcaattacacaatagttattttcatgataggaacaagtattagtatgtgaattgggcaagtattagttccctgatgggaagggaacaagtattagtatgtgatttggggtttcatcaatttttatatagcagttattttcttgatgggaacaagtattagtatgtgatttggggtttcatcaatttttacatagtacttattttcctgatggaaacaagtattagtatgtaatttgggcaagtagtttatgatgagatgatttatgcttgagaatgacatggcaatgtgtttaattttctttgattgttgttgtagatggataagaggaccaagattttaatttttgctgctgctgccaatctattgttgtcaatgatggccatgattattcattctaggaaaagaaagagagtttctaggagggaaggtgttaaatatggcccaattgttgaaagggataggatgagaattgagtatctaaacacaaaaatttggaggaacgataccacatgtgtcgacatgcttagacttagaaaagattatttctttcggttttgtaagctctttagaaatcgtggtttgcttgaagataccatccacatgtctattgaggaacaagtagctatgtttataaatacagtagggcacaatcttagaaatagattagttcgcactaattttgataggtccggagaaacagttagtcgttatttcaacaaagtgtttcatgctgttggtgagctgcgagatgaactaattaggcctccctcattggacaccccaagtaaaattaccgggaaccctaggtgggatccttactttaaggtgtgagattaatccgtgtctcattttcaattatatatttgaacaaacctcaatgtgccctaatcttttatggtgttgaatataaaataggattgtattggagctattgatggcgcacatattagagcctctgttgagaagaatatggagccctattttcgtggtaggaagtctcatgccacgcaaaatgtaatggcagctatagattttgatcttcggttcacttatgtcttggctggttaggagggtacagcacatgatgttgtagttttaagagatgcattggaacgtgaaaatggccttcttgtaccccaaggtaatagaacaatttagttcatcattttctccatctcaatagaaatgtgaccaacttctccatcatatgataggaaaattctacctagttgatgctggatatggagccaaaccaggattcctccctccatttcgtgctgtccggtaccacttgaaagagtgggggaataatccggtgcaaaatgagaaggagttgttcaaccttaggcactcgtcccttcgtgtcacagttgaacgtgcatttggggtactaaagaggaggttcaaaattctagatgatgccaccccattcttcccttatccaactcaagtagatattgttgtagcttgttgcattattcataattgggtcataaatgatggaattgatcagtttattacagatccattagatttaataagtgagaccacaacagagccatttgggcaagcaaatgaccatgcattgatggttcagttcagacaaggacttgctgatgacatgtgggctaaccgtcaaaaccatcatgggaactaatacatagctgtatttctagtacttgtgcatgttatcctggattttatggagattttgtccaagtaatttcatatgtgaggtaacctcaccaggagatatctccaccaaaacaacccacatttatccctccatccaaacagaggatagaaccattctgacccaccatatccctcaaaccaaacaaaaaacagggtccgttctatccctccaaccaaacagaaactgggtccaacccatcccaaataacaggaatggacctaacccatcccaccatatcccccaaccaaacacatgctaatagttttgcagtcacatggtgggcttttattgtgcttagttcatccgtttctcgaggaaggaaacattaaacccagcttagattgggccatatcctgttgatggacctgaacacgcaaggagaatctcatgggctggcatcaaatttcatcagccctacacaccgcgctggattagtttcgaccagagagattgtgattgtccctcaaaattaacaaagaggattatattaggggagatagccctaataaatggggatgcatgtgaacaactaatccagctcgatccgcatcaactaacgaattaaagacgactcgtattcgcattcgcattcgcattcgcatccgcatcgcatcggtttgctgcaaaaacaggagcagctagcaattaaagtcgttacgttagcgatgaacatactcaaaacaaacatggaaaccgtacacagcaagaaacaacgcctcgcccgccaagaaacgccgacacacacacacaccactccaaccccaactcggctaaaaatacacagctgatatatactactgctagtataagtagactgtctactagtagtagtactggtagagaacaaactcgtccccgtgcgtctgaaggaaaccaacctgcagacgaccacgaacgaacgtacgaacagatcgatcgccgagacgaagaagacgacggcgcggtctcccgtgcgcacggggctagtagcttgcatggtgtttcgtctcgttaatttttacttacctcggaaacctgcagcgaaccacgtaccaagggcgagttgggggggagatggagtgataaacaagaagcgagcggcagaagcaagcagggacagacagatttgcaactggtatgtcctaaacaaacaagattttctttcctcgatcgaatatagtagtatcactgtgctggagtactaccaccttcattgatgaaagcctgtctcgaatttggaaaacagtactggtaactgcatgctgcctttcaaggttaagaaatctcacaaaatgcatccttcagtagtgcaaggggatgcaactggtttggtcatatgggaagaattggactgggacaaaaattcgccattgtctgtgggggggaatgcacgaatacaattcgatcatatactaatcatcatcaagaccacacatctgattgtacaatactaccatggcggcttatgtcaggccttgtttttgtcgcagaagcaggagcccaatatccctctctctctctctctctctctctctctctctctctctctctctctctctgttttttatactttttatcaggtgaagattcagaaaagaggaaaaaaaatgctgcttttgcatgcactaagggcctgtttagatcaaaacctcaagctacaggccttgaggtttcaggtgttttttgctttgagaggttccacacttttatcaggtggagatgatgatttttatctttggtggtgttggtgctggacagacagacatgggaaagcctgctgattggggagagaccgaattggccgtgcaagagcatagagtagtagatgtaatccgaataatgaaccactggtttgtgcagggaaatatcggattagttctcgggtgataagaaagccaagaaaaaattggatacctcgtctcgaataattaattatccgtatccctttcgttttctggccatcggagatggtagcgacggcatagtctccatccatctgtagctgtagtcgcagctatgcgttggacgtagcacatccatcgtccatccgtctattctgctggaaatgcatgctaggtacctccatcctatttttttaagtgtaggtatagtttttcatgcttaactttaaccgttcatcttatttaataaaaaataaaaacatatgtcacgagtaaggtattattcttgttttatcatcttataacaataaaaacactaattatataaaaaaaattaaatagtgatcaaaattgagcgcggaaaattatggttgcacttaaaatgagacggagggagtaatttttcatcacccaagacatttcgatagaatgatagtactgagatatacttcctccgtcccaaaatgtaagtattttttaggttggcatgagtattaagaaagtaggtgagaatgattgaaaaagttgtgtgattggttgaaaagagaaagtaggtgaaaaagaatgattgtgataggttgacaggagaaggtaggtagaaaaatagcttcattttaggacaaactactgtgctagaaatagctacattttaggacgtagttagtattgcgactaattgacgtggatctatacacacacgtatgcagagttatcttacgttgctctccgtactggtgcctgtcctgtcgccggaaaatttatgccggcagcttcatcacgtaggagtagtacgtacgtcgccacacatgagcatgcagccgctgtggccaataacaacgccatggattagatctcgcatgcatggtcacaaatcaactaataacaggggtgtttgatcgatccatccatccgtatacattgcatgcgagatgtactatacatagacaaacaataatacttgtacacacttatgtcttaaaaaaaaagaaggaatacttgtagtagtattgaatcagggtgagcgagagggggacaaaccggagatgggcacagggcagtgggcacatggggagcacatgcaaagccccatctctctcgactcgaccacggtgccaatgtatcatacacacactagtactagtatcaaaatactcctcctgtagtgtaccctccagtgaggtgccacacaacaacatggcacgcacacgcacacttgccaagcaaatggacggatatattttcattaaaaatatttcattgatagagaaaagcttggattaattaaccagcccaagcgtggccaaccctgtctgctgcccatcgatgctttgactattcagccattcaggaaaggccactgtgcctttctcctgcaaactgcaaagccacggatacgtaccatccagccggtctgctctcctgatgtgctgaatctgttaattgattagggtttgtttagggagtttaagattctgaaaagcagctggttggtagttagcttctgataatctgaaacttttagtttatttttttattctacttctacaacttctcataatgtgaaccaaaaactaaactgttcagctagaagctctctaagcagagcctaaggcagggtgattacctgcaaattgccctcgtttgactggtccacactagtaattgaaagatggatcgatgatgcgcccctctgcaagcattcacgtgcatccgaacagcggacacgcccaaaagttacggcctttttactagtactagtgattactgtagtatactactatacagcgagtaggagtaggtgcaatgcattgcatgcgtctgattgaaaagaggacaaagggaaaaagttactacgtgtacaggtacaccgtacacgtacagtgcagtagctgggggcgggtagctggctgctgcaacaaatctgggatgggatgcgatgcgatgagacgagacgatgtgctccgcggaaatccggcagcaaatgggcccggcccagtgtagcgtccttgtcggatgcacgcacacacagcggcacggacacgtgggcgtcacccacgcctgacatcctgggccccacacccacgcttgcttccccccacccccttttcccgatctaccacaccggcgctgcggtgaaaacgcgaatggattaattttttttactactttgacctgggctttattcataggatgattggcactgcgaatgtagggagcaaacctaccactgctgctgcaacaagtttatttacaggagatcacaataatgggagtagaagtagtagaacttccctataagtttctatatctaattttgatcgttttatcttattttaatttttttaataattagtatttttattattattagatgatttataaaataaataaataagatagatgattaaagttagacaccaacacttatagctgtgttaaaatgggattgagggagtgataacttgtttgtgtgggtttttcttgggagtattttaattgtaccgtcgtattcacgtccatttcttttttattactggatgttgacgctgggggtggctgttggcactagcatccccaaaagcatgtcaccaaaggtgccacttttacgccttccctcttctttatccttaataatgcgttattaccactagcagagctactatgcccatttatttattctcctaaaattcccattttcgaccgaatcttcttttagaaagagtgggaacatatatgtagtcctactcaccttggaggcagcagtagaaaattaggcggcatcataatggtaaaaaccaaagctaacctatttctaaaaattttatcttccctttcttctttctatgacagtcaactacagtggacaaagtactaaaaatgaaaattagcaagaaaaaaaacatcagttcttaaataataccaaatctaaagtggtaatattaaacatccagccgcataaatctcggattaccctacgatctctaatactctactctcccaaaggtaaacaatacccaagccctaacgccgtcagtccccacccccgcgccaccgctggcgccggcgacggcaagaacaactcaagcctcgccgccgccgccgttcctctccgtatccgacccccaccccggcaccagcaccgccccatggaggcggccaccgtcgccggagaaggtgaatctcaacgcaattgggacaggtgagtgattcaactcattcagagaaatacatatggtatgaggcgaaggccatgaagaaattataaaagaaaaaaagaaacttcctttttttttcttgtattgggactgcatttgctgatcagggggaccatgaacaccaacgctgacacatctccacattggcacaacagaatggtgcagcatcagcagtgagtggtccttcccctttcatcacacctacactgactgacttgttcatcttcttgtgattttacatacactacactagctaattaagccttcctctctctctctctctctctcactcaaacctgtcacttgttcttgggtccattacatatctgctgtactcactgccttgcacacagctgcaatcaggcagtagtagtgttacatgtatcttgtggttggtactagtactagtcttgtggctaaacatcacccctaatgctataaaactagtggctattttggtggtagcttatcaagagctttggggggtaattcatcaatggtggtgggtcggtgggtggtaatagtaactaagattaactaaggtgatatgatatggtagtaataggaggggctctaaatttttatctgaatggcactgcattttaaaacattggtggtgtggttggtggtggcttgattgatgctgctgctgctgcttctcttctggaggccagggcatcctctttcttctctttatggtttaataaagctatcttcttgaaaaatgaaaaagaaaaggaaagaaaaaaaaaggggggtgactgaaactaacactatgctgcaacttctccactcttttcctatattccactattctctttttctttgctgctagtattcctgcaaggggcaagtgatggcaaggacagaggaaaagagagtaaggcaccatcattccaatggggggtgaaaagcaaatgattcaatactaggaagcatggagttgagagcttgatatagactttgtggaaaggcaagaggactgaggtgcttactaggattaggcagtagtagtattactcacttccattcagaacaactttacattccgatcgcgccgtgatcggaggccagcctgcatgcatatgaatgaatgatagcactcagcaaatcatggcgcccagatgcatactgtactaatttgcaatactaaaatagcacttggggccatacattattatgatgcatacctggacatggggaagaaataaggttttggtgagggcatgtccaaggcagaaggtaggagatggttagtgccgccattgctggcgccattgttgatgccaacataggtggcgctacaaccagtcgacgcggtggcggagatctccgcctcagtgggagcgaaaggatcgcgagcaaatcccgcggacttggtcggcgacgcaaacgggctgtccggcagattatgctccacactgccaaagagagcaagcacaatgggcagaggaaaaaagatcagtttggtgaaatgttacttgtctgcattgctggacgaaagctaagtgtggcgaaaataacaaatgattaaatgatgacgatgagacaatatgttaatcgcaaaattccacctttggtcactgtctgtgttagggctggaggactctccggtggattcctccttatcggctccgttgaccgccttcttgtgagcaagaaggaagccgcttcccttaccgagctcccctataagcaagcaaatccgccatggtaaacattagcaacactgcatctggcgcggcaacaggtgaaacgtcgttcggtcggatacaccaggtcctaccggaatcgggaggcgactcgccggtcgcgttggcggcggtctgagaagcgctgaaaggattgccaatgggggtcggcgccgcggcggcgcgcgacttgaagtctagcagctgcagccccatgaggcggcggctgtggagctcgatcgcctgctgcagctcggcggcctgctgctgctcctccagcttcctcctcagcagcatctcattcgcgctgttggagtgctgcagcattctcgcacctgacaccattacaaacagactcatgcgatttcagcaacaatcattcacccaatcaccatgaagaagatgatcgcaaaagctcaccgagctggtgcatgtcgaaggggtctctggcatcgagtccagttggagtagtgcagctggagaagtccaccctctcgcccggctggtgctgcttcctgcaaagtaacagcaagttacaaattggttataggggatcaacctagagaggcaatgtggactgtaagtaagctcggcttgcctgtacttgtcggggaccttgcccttctccttgtatggcttgacgagcacgcgggcgtcgcagatgaagtgcgggttgcccttggcgagaatcagcttcaccgtctccgggtagacgaaggtgacgaagccgaacatgcgcttctgctggtacgggatgcgaacgtcgtggacggggccgtagatgcttcaattgagagggcatcatcagattaaagctatggcatggcggtgacggtgggcggtgggattatagtatactacctgaagtagttggagacgtcctcctcgcggaaggtgctatccgccgggaaggtgaggtaaatctggcgcgagccggggttcatcatgctcgcgaagtcggcgcgctccagccgcggccgccccatgaacttgtgcgcctcgtcgccgcctagcatcagcgccgccgctgccgccgccctgcaaatcgacggaatcggagctaagttaaagggatactggtactccagaagaagctcggaggtgtaaaaagttggcacctctggctctcgttctgctgctgctgctgctggaggagcaagctcaaacacttggtggctgcggatggcgagccggggagtgagccggtgggcgagtaggggaaggc

SEQ ID NO: 20751 - DNA, 27695 bp, Oryza sativa
ttctgccgcgagagcatgaagggcgagtgggcggcggccgcggccgccgccacgaggtgggcgtcccgggcccggacgccgggaggaggccgagctccttcctggccttggccatgacggtgtggagcagcgcctcggggccgaaagcgaggcgtatcatctccttctcgccatggtcctggatgaggaggaagcccatgatcttggctgcgtggtccgggtcgagcgcctggatccgcgagaacaccaccttggtcgcctcgtaggcgtccatggcgagctccacagcaagcaagcaatcgagcttcttcgtcctcctcctccgctttctttaccacaacactcgttgcttcttggcttcttggcttcttgctccgctgctgctgctgagctgtgttctattaccaccactagagtgtgcagcaaagcaagctcaaagaagaagaagacgagagagagatcagtgggagcggcgccactgaggcagtgaagagcagaggaagagctccattttcccccagaggaagaagagctcgctcgcagccgagctagaacaagaagctaagctatggctatgtagtagaagtagtactcgtactagtgcgctgcatccctatcgatctatactactcctttctttacttggcttgccccttgcttttgttggggccgggggagtgacaggtgatgccacaatttctccagggtgtttttcgcgaaaatgtttttgcattgtaattttgagccttctttcagggtgtttttggtgaaattttttgtttttgctgtaagtaattttgcttttgtttttgctgcctgatgtgaggaggatgggtgcgtggagcgttggatagatctggatctccgtggaccccatttttatacatgtcgagctccagctccagctcctccagctgagctcggctcgatccgctccagtgcactccagcctctagctccatcactctcttcctcttactgtacactggcagtagtagtacgagtatttacgttgtacgagcaagaagatggagatttaattgcgccagtctactgcaggaggatccgtacggtaataaaaggggaatacgagacgagtatttacgttgtacgagcaagaagatggagatttaattgcgccagtctactgcaggaggatccgtacggtaataaaaggggaatacgagaataatgaggtaacaaaataggggaattagtctggtttagttatcaattttttttccaaaaacatatgtattaaatatagataaaaataaaaagtaattacatagtttacatgaaaattgcgagacgaatcttttaagtctaattagtccataattagccataagtgctacagtaactcacatatgctaatgacgtattaattaggctaaaaaaattcatctcacggttttaagaagagttatgaaattattttttcattcgtgtagaaaacttcttccgacgtccgatcaaacatcccacgtcagatacatgattttgagctttttggtgatgagtgacacggccgtaatatggggtgctgaccgggagggacccacacgaggtgaggggagcgtttctcgaggctgcagcagccaccgtcccgttcctctttgtcctttctgcccactgcgctgccgctgctgctgcaaaaaaaccgcagggccgctgcagcgagatgagatgagggcctttcacgataagatggcacacttccccatgagaaatcatatttatcgacatgaggttggattatcttaaaccccgtctctgtccccagggatactgtttcacacgctgcgacgccatttgcctctctttttttatgccttcaaactgcgggtttccccgtaagaatggccttgtctcaccatttttttaactgtagatgggtgtctctctgaaaaatgaactgctacagtggatacgagatggcgatcagaagagagagttcattcagatttcagacaaaagaaaaaaagaaggaaagcataatccatctcaactcttcacgcgagtttgagtttagtactactaatgagggattaggaagtgcatatgatccggttggaattggaattatgcaggggtggtgtgggttgaggggggaggaattgcaaaaaatgcaatggctgcgtctgatttccctgtcaaacaaacacggtcgctttcggtccgtcgccacagaagcgcgtcctatcatgcacaaatccaataaacaaatgacgggggataatttcgacatcactttccccagggacccactgcacgggtggggccccacctgttttgtttctttgttgttgggtggacgacgctgctgtctttgtgatcagggcactctatttccatttccatttccctccctcgagtaaatcggctttacatgcatgatacgcagttgccacgtcaaccacagcaggtgacattaccatttcagcaaggccagggcgtctattgtgatcaattcatgtagggccttatcgtttggcttttttctaataagctaagcttattagagaataaataaaacttttatatatgtgttcttggtgacttaaaagctaatactgaaaaaaaaactacgttaaaaatatctcaaaattaatgtcaaaattaagtttgaaaatttaaattagctttttctttgagtgaatatgccattcgatgggagctgtagtacttcagtactattgttctcttgctcccgaaatatagcagctactcgtttaacaatgaatctgaatagaaaagaaagacgattgcatagtatcaaaccacgagaacataagatatggtgtaagcttacatgaagaaaaactgatataatctgttgtcgtaccagagccgccttatgcccgtgtcaccgtcattctcccgacgatctcctgattatgacattatcctatttcttaatcatgcgatctcaattcgtgattatcacatcgtagctcactgacctcaatggtcgaggagaagagcaatgatgagtgtgaggttagctcttctctatgaaggcctatgagcatactcctatcttttggatgttgctcatgtagatttaagatgtaccggattcaatatcctgatttttaatgtgtggctatcctattgggtgaacctgtaacacttaaataaacatgtgtacatttttacaatttccaccttaccttattattcatcatttaatcattatcctagctctcaatctctattacgccacccgcacactaggtactatcccttatttttcaacaacgctcctacatcaaaccataacagtttataatttgatcttcaaatcgcatgattttcatgctcccctcctttttttccatgtcgcaacattgtattgatggccttggaagaataaccatcaatcggttatcatcgtctctgcaccatgttaatctgtttctaattgtctcatcaactgtttgttgctaactttcttgttgcctccattgatccaaggcacatcctttttctactaatctactaatctataatgccacatttcttcccatcatcacttgcgcaaactataaggtcagtgcacatatgtggcattcgatcaacccatgataatagaagattctctagcagcttggctcggagtggggccgaacgagatttgtaacctaaactgggcacacgctctttgtcagaaaagctatcgtgcggcatgagtgagaatagcgcggccacgctgtgggggtcgtggccatgcgctttcatggccttgtgcaacgcctcaactctacaccccatgcgaggctacaacggtcatcattggagagagtagttgccgcacccgctcgaaccctagccagcaagcttgtcgttctcctctccacgccgctaagctcatcggcctgtctccccgatctgtgctagagagggacgccacattgatgtctaaggtgagaagggagaggccgtcgtgaatggcctaacccaaactctaggtatttggtgtcggtcatgaaaaatagataacgataactagtttgatgaaagaggatatgtgtctatattttattatgtgtttactaattactctactttagaatataagattttaagctatataaaaatagttatactttaaaactgaaggagtaactaagtaaggttagattagactagatggggaaaggtagtaaataaacaaggtcgggtaccacgttgatgcaactggtggactttttatcaacccggttagcttttggctcatcttttggcgttccaccgacttttgtgtgcgcacgcgcgtgcctgtgcgtgcgcctttgcatggcatgccatgccatggtgcgtgtgtttgtgcgagcgaaggctgcaggtttgctactaccaatctaccatggcaaatttggcatgacggaacggaagcgacagataatacagaggccacacacagcagatactacagattgctcgcctttcgcctttcgctcgcttttgttgcaccgtcgttttcagccgcagcagtcgcagctttgttcttgcctactgtacgagtactactccacttcacttcctcagcttctgcttctacgtactgtagtactagtacctcgtatactagtatagaagattttccatacgaattctctcccaaatcgttttcgtctccaccaaacggaagaatccaatttaacaccacccggatgctccatcggcacggcaggtagcagtaattactagcatagctaatggaagtactcttgggttttaacctctcactgtcatcaagaatcccttgactcgtttcctaagcgtacgggctttaccctgaccgacgagtcaacatgcatttacctccctgttttggcggtgaaaaactctgaatcaggactagtagtaacatcttcttcgtcagaatgtcggacattcggagcggtctcactgttaactgcttgtgtcatcggagcaggtacaataacagactataagtaagctataaacatattttaaagaaataaaaaaaagaaagaaaagaacagcgggctacagatctgtaaccagctgcagcacagactccaagacgtaatatgtgtatgataggtgggaccagatattaatactatcataagcaactattgtatgaattgactattacattggctatagataatttagagctagtagtagactacactattaaacttgctcttagcacatagtatactgcttgtctgattcaattttgtgctggcgagagcgtccgtagaaatgttgaatactcctgctactacgactcctatacaatggaactgatgagagataggatcatttgtcgtcttgttcagattcactctaccaacatgtttcttttgagttttgaacatgaccagtaatcactgtactgtagtgcgggggtactatagccacttagcgtgagaattagcctaaccaatgcatggaacagacaaaacaaatcaatacggtatcattgggcatatgttgtctcggtcgtcgaaatttcaccaacagttcgcaggatttaatcccattctgaccagaatcctaagatcaagtttaatagtatagctaattatttgctccaaatcacatatagtcaatttaatagacaattcatacaatagttacttataagagcaggtacaatagcaggctataagccagctgcaaatatattttaaggagataaatgaagagagagaatatcagcgggctacagatttgtagccagctatagcacggactccaagacacagtatgtgtatgacagatgggaccaggtattaatagtgtagtatgtaattagttggctatactattaaacttgctctaaataattaatgtttggtcccacctgtcatacacgtgtatcttgaagtccgtgctgcatctggctacaaatctttagcatgctgctcttatctcttatcttttatctccttaaaatatgtttatagttggcttatagtctgctattgtacctgctctaagtgaagtagtataattccacacttgaaccagaatgaattaaatatttaaaaagtgaagaagttaattttaaaaagttttctacgaaatctcttctttctataaaactaatgtacactaatgaccgataaacatgcaaatatggtatttattaccactcctaaaacctacatacaagcatatcacatcaacccattaaaacacacaaagcttaacatgcaagtatatagtaattatatccataatttatttctttctaaaactaaacatatacatgataaatcatcattctcaaatcatttttaaaatatttcaattcaaatcatttcatcatttcttcattatataacatatatttgcagcaaagcgcagggcatcacctaatatataccaatgaagaaatttttagcaaggaaatatagggtgtgtttagttcacgtcaaaattggaagtttggttgaaattggaacgatgtgacgtttcgatgtgatgaaaaaattgaaagtttaaagaaaaattttggaactaaactcggccacaataccattaggaagcgtgcatgcaataatcaataagaaaaaaaaatgaacatgaccttagaccggagcatggtaattccataaaaatttttgaaactcaaacgagtctcacacatggttcgcaaaatcattcactgaataccactccggagtggtcttgtctatttttatgaaaaccataaacttaaacaaatgttaacaaaattctaaattttatttgattttttaaaaattgaaaagatttaccaactggtttgtcagctcgatccacaacgaagtcaacgaaaaccagaaaaaaaaagcggttctcatcgttttttttgtttttttataatccttggttcccaaacacctgatcgaaatcgaatttctactatggatcatatagaattttcagaaatcctacaggggatttgtttccggggagattgagaaattgtggaggggaggagctttcatcaaggcaggcagaaaagtttgctcctcccagttcgaatgatggatggatagtcacatggaggaagcgagttctccggatcccttgtcgtcaccaactgcgtggtccctcctgtggccgccgtatcagtccaagagtgactccaacagcagcagcaacgtcgtcctgcttggccggttgcagtcaccaccgctgctgatttcagtccagctcaccaccacctttcctctccccgtttcttccttcaaatcagcctactgttcgaaaacgaccaccaaatttccccgaaaacaacaacaatctcccggattgttttgtttcgcacggatgcatggctgcacaacttccatcatgacctgtatgatggatcataatgcaggtttgtgtttgtaccgaaaacatacacttgattctgacccaaaaaaaatctctaggattttactcctatgtacaagtccattcgccttaaaataaacaactttaatataagatttgatatatcaatctgaatagatatatgtgttaatttagaattggggagatactgaagatagcactgtggtaaaaataaaatggaaatcttagtgctggatacacccagtatgtagtatctcttgttgctgtaggacatggagcatatgcagaggatggacaggacacgtgcaagatggttgtgtaatgaagtaatagatgctgcagttaaggagcctgggctactgcaaaggacggtgttttggagcaacacaagggagcacagggtagcactgcctcctcctcctcctcacttgccataattttgccattgccatgtccattgccatttgccacaatcttcaattccccaaaattttagcacatcagattcacctaactactactacggctcctacccacttgctcaactgaaagcaactgcaccggcaaccatcactgtagctactctaccttgcaagagaccatgttgtacacgcatattctacgactatatggttgtcagccactatttgctgctagcatattacctttggttttttctatttgacgttgatttgttaaaagacgaactaactactatcaaatactcagagacgaagagagtatgatttattcatctaagtagagaaatctctaaatagagacacttctttttagagaagggtaaaaatctctggttcttttttttatggtacagaaggttatctgcaaacaaaatttaccgtacttgcttaatgccactacctccctcgcaacaatacggctgtgtttagatccaaagtttagatccaaacttcagtacttttccatcacatcaacctgtcatacacacaacttttcagtcacatcatctccaatttcaactaaaattcaaactttgaatccaactaaacacagcctacttttttttaagtctatcgcacttgtcccacgaagactttactacctccgtcccaaaataagtgcagctgtggatatccgtgcccaacgtttgactgtccgttttatttgaaaaatttgtgaaaaatttaaaaatatttaatcacacataaaatactattcatattttatcatctaatagcaataaaaatactaatcataaaaaaattttaaataagacgaatggtcaaacgttgaacgtgaatagtacaaaactgcacttattttaggacggagggagtatcttttagagtaattaatacatttaaatttgttaaaagtgcacagtattacagtcttttcagctttatatctatatgtgtgagattaaaaatgaagtatttttgggagcgagaaagtatatgatcaaagtccttactacccttttaagaggattttgccattctcttcattgagtatagaacctaatttattactactaagagggaagctagctataactttagctacaaccatatagtagctactccattcgttttataatgtaaaattttctaacattgctcacatttatatagatattaatgaaaaaacacacacatatatattaatgaatctaccaatgcaagaaaatcttacattgtaaaacggaggaaatagtatttatttaagttaatcagactggtctaatcttatactactagggctgcgttcgcatgtcctgatgggaactcattccctccgcacggaaaacagagtgatccattagcacgtgattaattaagtattagttattttttttcaaaaattgattaatttgattttttttaaaataactttcgtatagaaacttttttaaaaaaacacacagtttagcagtttgaaaaacgtgcgcgtgaaaaaacgagggagagagggtcgggaacgaggggtgtcgaacacagcctaaaaaagcgttgctggcaaccaaatattcctcactcacttacgccgagcccttctactactatgcatgtttttttttaaatcgaattagcctttttggcgccgtgagaacactgctctggtcggcaccaattgcctggggaccattactgctgttaatttgatcgtgctccgatttggtttggtcgctgttaatttaattgtcacttagtttccggttgaccagatccatctaacatttgggattcaaagcttctgtaggctttcttttaggaaatggaaagggcttatctaggctttgcaccatacataaagatttggctacctattagctgcgagaagtagttgcactggtggtgccttattactagtttactactctttcttttttcatggggtaaagcttttatactgagttcgtttattgactttcccaactccatcctatgttttacgcacgcacatgctttcgaaactacgagggtacattttttttaaaaaataatctatacgaaagttgttttaaaaaatcatatcaatatatttaaaaaatactcaagctaatatttaattaattactccctccgtcccacaatataatggattttgagtttttgcttgtaacgtttgaccattcgtcttattcaaatttattttgcaaatataaaaaacgaaaagttgggcttaaagtaacatagataataaagtaagtcacaaataaaataaataataatttcaaaattttttgaataagacgagtggtcaaacgttataagaaaaaactcaaaatctcttatattatgggacggggggagtatatgctaataaatcgctctgtattatatatgcatgcgaggggttagtttccaacttcaacgaacacggttacacggccttaaaaatgatggtgaggtgaccaagaagggggtgcagtaacccaactggcgaatcatttgcacggatctctcaaggatatttggcttcaggaggttcgctattcaggttggcaaacagcaaactgtaagattcagtatcactggaatagtcagggtatgtttttttttccgggaagcattatgccgttcgagattagtgtacgtttttaggcgagtttaccccttgtaaagtggggttcgtttctattgaaaatgaagttgaagttaaggcacggaaaataaaaaaaacattattactgcataattaactgaattttaattattaccaatccaaaagaggatttatctaatattttaaagaaaaagtttccgaatgaaatataccgtttagcaatttaaaaaacgtgctgatgaaaccaaggtaaaatatgtatgttagtcagaaaagaatgggaactgcttgtgtagtttccaaagtgagagatttcaaagatatttaatatgggtaaaacatgaaatagatatcctaattaattactcttgataaatgaaattatgtcaatatgataggacactataataattatccgttggcaaagtagaattatgttgagggaaaccgagcttaagatgtctgacaaatagatatgcccgacatgatttatcctgcggaatggcagcatgagaagttagaattgctcttccccattccaaattcatgaattggctggtcgaatccacttggaaagttagtaaatatatctgcagttgtatatagtcagtagttagatggacaggagcatatgattgatgcaacaattctgttccgagaaccttgtttagatatacaaacacaaatgatcccacaagtggggttgattaggtgattcaccatggtcatggacccaaaagagtggctcagacaaatcctccaatcgttatgtcgatgctagattctacacatacatatctgccgattgattcctccttttgcatgcttattttataatagatagattaatcaagaacctgtcactgttgcgacgttctctgttcgagagcgacaacggatgatccagctcgatctcctcctcttcctgctgatgcagctgctggtacgtatgcaagctcagtgatgcatgcatgggatgaatgattagtatagctaggagtattaattattatgattagtagtaaattaattgtgccaatcatgggtgtgaactgctgtttggttcttggctatagctagctcgtaattaagtgatgagagcatggttgttgctaaggcccagtttagatggaaaaaaatttattttgaggtgtcacatcgaatatacggacacacatttaaagtattaaacgttgtctaataacaaaataaattacagattccgccagaaaactacgagacgaatttattaagcctaattaatctatcattagcaaatatttactgtaccaccacgttgtcaaatcatggcgcaattagacttaaaagatttgtctcgcaatttacacgtaaactgtgtaattggttttttttctatatttaatagtccatacatatatccgaacattcgatgtgatgggtgaaatttttttgttttggtaactaaagagggcctaattgctaagtgccaatttgtcgacaagatatataatttggaggagacgcagacgacaagagagaggactaattgaaaggccagatggggagaaggacagatggatggctagaattgtatagttgtgtagctagatgaatggatggatggatatgccacgacctgacgcgggctagctacaacgcaacttgttggtcgtgttgctatcaaatggacggcgactcatcatcatacggtcgctgctttagttttagtactagtacttgtaccagtgattacaacaattcagttcgattcccgccagaattttgtttgacattcatccatccagtactgcttggatacaaagcttcaagcagtacacatgtttaatttatagccgattaagcacagaattttgtccataagactacaactcctagttggtagtacattgcttcatgaaattcaaaatttatgtaatttactgagggacactacaaaatcatgtcgctgctgatgcctgatggacaccacaaaatttatgtaatggttgtaggacacccgagataatactttatcatttttggcaaaactaggggagagaagtcttaaaacgataaaattaccctcagccctatccacttcagttccatcaggaccatcacctgcttcccagcactgcttgccagctctcgctgccaccgccgtcgcctagggttagggtctttggatggggattagggtagggtgcatgtgggtatagggttcggggttgcgatggttcaatcaggctaagggtaattttgtctttttaaaatttcaactctttatgtctaaatttgataaaatattgcctcggtgtcctacagtcaagtatacaaattttatggtgtccattagcagatatgcgattttgcaatgtcttccagccaattacacaaagtttagatgtccttagcaaattttgctatcaatgaaacaagaggtcgggaaaataccgatggtgtaatggtcaatagtgtgtccacaaatttaccaatcagagttcaatttatgatatacatgactatatgagagtacatttttgaaaattcaaaaagtcaaaactctagctcaaaccatctcagccgccgtcattgttgtcgagaccctgctgcactcgagactgacagtgatggatccgtgagggggttgggcactcctgaggcggtggagatgccccaaggaggcaacaccgctagtaatgtcgatgcacatcattgccgccgtcaacgtgcgcctcttttgccgacctcctcacgcaccgctggacccgctgctatcctcaagtgcttctgccagcattaaatttgactatttgaccctttttgaaaactaattttacaaatgaaccgcggccaaaacttatttgaaaaacgacccttttgtttagcgccaaatcgtatggtttagcactgtaccatttggtgttgaacaaaagagtcatttttgaaataagttttggccacgtttcatttgcgaaattagatttcggaaagggtcaaattgtcaaattttgtgttctgccagcctatagagtttgagagacaaagatgatgaggggcgaaggagagagtaagagagagggagagtgagagggagagggagaggaagagggagcagcggaggagccattgttgttgtctctccgtctgctggggtcagatccgcccgccgtcactgccctaggtgccaccgctcccgtcggccttgggtgaggagaggataagagggagagaggggagtggccgagtagagtaaggaggttttttaaagagataggtgagaagagaaaataagagggagtgaggacgagccttgtgttaggcatgtttattaagaggtctatctgtgaaaatagatttattttcatagacaggtctcttaagagagtcacatgcgaaaatcattattttagcgggtcttaaccaaacattattcattaaaagtacacatttacgggtatgttttatgcacgtgtactatgtgcctttcgtgtaattgggagaaaagaaaaggaggttttgcgggcgtgagcgtgcatcccaaccggacgtgccattgccggctggttgccggtgtacattgcacgcatgctgccgatgtgacaggcccacgtaccgtccatacatacatacatgcagcaatgcaacgttggagccttgcatctgttgctggttgtattgcattatatgcacactagctagcatggtccaccaggttgcacgcaacaaagcagctgcagcctgtgcaacaaccaacctagctaagctactagctacaactgattcacttgcgcccgtgactgataaaaccatagcatcgtatgtgcgacgaaatctaaagcttttctcatatcgcaatgtcgaatatatgatgtgcatggatgcagatgcaaatgcaatgtagggcctgtttagatctcacctcaaaattttacatcctatcacatcgaatgtttgaacacctgtatgaaatattaaatataagctaaaaaataactaattacacagattgcgactaatttgcgagacgaatcttttaagcctaatcgctccacgatttgataatatggtgctacaataaatatttgctaatgacggattaattaggcttaataaattcgtctcgtggtttactgatggattatgtaattagttttttttattagtgtccaaacactccatacaacaccctatataatatccgatgtgacatgttaaaactttacacacatgcatttaaacacccccgtagtggctggatgctgccccggccgtgtaatgtgtttcgtttgcttcagaccggatccaatatatccatccacatccaacaatttataagcctatgacagagtaatgtgtgttgtacgggcagtgatgttataaagtcactgggctcattaagttgccggtctctctgggtgagacatcgtcattaacaagccattcatcacgcacatttaatttgccacatccagcactaattaattaattactactactccagttgtgtgctcgatcaaacgcgttgcaacaaacacagggcggcttatgttgggtttgcatgtgatagagtactcctagtcctagcaaccacgtatacgtactcaatgcttatgttgcttgcggccttaaaatcatcatgattatccgggggatgagcttaacgataatgactaacaaagaagttgagttagctagggtacttacgtacctgcatgctttcgttgacagaaaatgaaacattctgtgtgtggatgtattaattgggatgcattattatatatgagatcgccaaatgcttgcatacatgagagatctcctataagctcgttgcctcccaaccaaatcacggatactgagtaaataagcaaactttaatagagtagtatcctgatctctctaattaattactagtgtactatgcatatatagaaggaggtttgatcagcttaatttgataatgaagtgatccatcaatatatagttcaaaaaaagatactcctactagtgaagtgatgatccacttgcaatctcaactgcttattgagccgaaagataagaccttaggtagcagctacttgtactgataaactttactagccgaaattagcacgactagccttcattgcccagcacttttttgatctaggagtagttcatttgtccacagctgatatcttgtccattttgtctgcatttaagatgctaaacagtatcttaacctactggggggggggggggcatgatcaatcttagattgctcaaatttgccgtgaaatgcgcatcaatcattacggacaaagcaacacatgcatcaagtttacactgtgcacttctctttgctggaaattttttaagtctcaaaggcatacagtacacacctagaaaactactgctccgtattgctgctatgctctctctctctctctctctctctctctctctctctttaaaaaagtattgtagctatagtgctatgtacgggaaggtaattggcacaagttcatttctaaaaaaattttcctactcaggctgaatttgtttgggcgtatggaggtgaaaacttcatgacacaagccattagcttatgattaattaattataatagacttaaaaatgtttattggataaataaaatttatatatagtagcataaaaatacatcgcttaacagtttagaaagcacactaatggaaaacaagacattgtcaccctaaactctaaaacgaacacaaccttactcaattcgttctaagatataaattttttcagcatttaaattttatataaaaatatgacaacttaaatctttgcatatttactttatctcaagcaatcataaccatctcttacaattcacttctccatgaatcttttcatcttaaccaatcattttttttagcattatgttgatctcatatacttcctctgtcccaaaatgtaagcatttttgaggttggcacgggtattaagaaagtaggtgaaaatgattgaaaaaagtgtgtgattggttgaaaagagaaagtagatgaaaaaaaatggttgtgattggttgagaggagaaggtagatagaaaaatagcttcattttagaacaaagtattttaggagggatgtagtatacttctaaaacttgagatagtattttagaacggaaggagtgcatggtatcatcgtttgcatggaaaagatcgatcggaaggagtagacaatatttgtggcgtagcgtagtctttgtgtgtgagctcccccatgagatgacacgacggatttgtcactggtggagacaaatgtctcggtcaggactgctgcgctggaaccgggacgccacacacacaaaaaaaaaaaagtttggcccactgcagtgcccgcaccacccaagctagctagggtacgtaccaagacacccgacatttgcctacattattgcctcccgttcttctactgctacacaccaaaaggaacggtgaaagtgtaaaacaaacaattgcagagagtccctgaatatgtttgaggaagtttctgatatttctaacttttcccaagctcagaaactcctccaaattgtatataaatttttcggatcaagagaaactgtggttttacaattcaaaaaataaactataagtcagaaactaaaaaactgtaacaactacatgtttctcagggcttgtttgattcaataccttaccaaaatgttggcaagttttggtactaccaacattttggtagggtagagttgtatttgggctgtgtttagtttctgaaaaaagttgaaagtttggggaaagctggaagtttagaaaaaaaagttgaaagtttatttgtgtaggaaagttttggatgtgatatgatggaaagttggaagtttagagtagttgggggtgaactaaagtttagcccctctctcccaaacaccccataaacacggccttggttggaggccaatttagaagttagaaccaagcattgagtagaatatagaaaatatcaaattggatattggcaatgccaatgatttggcttcaaaacaaaaccgtcatatatactaatccaaaatggccgtcagtttctcataattttaagttgatcaaacaagccaaagtcactcgcttgatctagctaccactgtttgctactttgttgtgctagtgcagtactgcagtaggagtgcgtacagtacgtgactagtttgtgtgtacgtactttttttttttactgctggcatgttttgtttgtcaaacataggaccggacggaccacaacagctcatacaaagggggacacacgacaaggccggtgatgatacgatacgatacgcaaacgcggcgatgcaattgtagctgcacatgctgcggcggcagcacacatttttgacgcggccgcacggcggtgtgttgggttcaaacacctcctcctcctccgctccggccgacgtcgtcggcagctgctaaactgccatcgaaacaacggagacggaggcgtgaattgtcgttcgggttttgggctttttatttatgtgacaaaactgatgaaaaagtagggagtagtaggagtacattttgaaggagtcgggttaacaaaaagaaccagacccgaaaggaatgggggccaccagagtgcacccaatggacagctgcaacatggctgcccctcatcactgattcagcaccatgtgcctcatgtcagtgcctgtccttgcacactcttgtcagatgcgcaatcatcaaaagtaaattgcccacgcctgccttgcagttcctcctctgcctctgcctgtcccccccccccccccctctgttcttcgttgacgagttcttggcgattattggagctatcagtgcctcaactcctagtacgatttttaaaagcacggatattgtgttatttctgtgttccatagcgaaaaaagaggaatatcgatagtgaactttcaacatagttagagccaaacataagatccgaatattttcttcagctagcatgtgcgaaaacatgtgtaaagtggtataatgtagggaaatgctacaatatggtatcccattcagatggagggatatctacgaagtatcgcttcacacctgatagatattggctgatactcgttcggacaatatgatacctctaaggtatctcttgatacttaataggtaatggctaatatccagttatcatgtaatatctttaagctctaagggatcatcccgtccgaacgggatagtttcatgtatcccctttaatataatataaggttgtgttcgtctctatagaagataaaatgaagttagggtgcaaaaaacaagaaaactattagctcataattaattaagttttaattattacaaattgaaaaataaatttatttgatattttaaaacaacttttgtatagaaagttttcatatgcaccctttaacagcttgaaaaacatgttaccaaaaatcgagataaaatatacaacttaatcacaaaagaatggagccatactgaagattaaaattaagacacgcaaaataagaaatttaattattacaaatttaaaaaattgaatatatttaatattttagaataatttttatatagaaattatttggcagtttaaaaagcgagaacgagccgatgatgcgcttgatcactaggcctgcacgtttcagctgcccgtgactgctctgcagcaacaaagctatgctgcggctcatgtgctaggtagacgcagccatctctacggctctaccgatcaatttctatgtagccaagaaatcagtcacgtagccattcactgtagtgcggctcactaacaaaactgatccctacatcaccaggccttggaattgccctagttgaagccacgaatataacttagaagtataacgccacgaatatactgtaccttagaagtataacagggtcattctttcgttacaaagtgtcatgtactccctccatcctatacaaaaccaatatagtgtaagagaagttctcatgcccctttaggcacatatatcaatttcatatgaatttaattgttctgtatgattcaggaaaagttcttacggctggagggtatttaaattggttttagtaactgaagaaaatataaattgttcagttttgtaaacttgggtggtggtcatagtagagagggcaaaatatttaacataatactcctatagatgtggaattaattatttgatttttgtggacctactgcagaccaacagagcctaaaattgtttttgagttacacgtacagtaggcaaagggactttatgggaattggccacagcaaaaaagatgttagatgccaattaaggaaggattaggtaaacttaagtgcctatcaataataatctgaggggatttcgaaactacttggtgggaggtgcagtggcaatgtctgttgcccagatcaacaaccactagcgctcgagcgaaggctgacaagccactgtctgcaaacatcagacattaaaaggtacagcagcgcacgggagcccccccccccccccccccccaatgaatgctgtgtggggtgcactgatcgatttttacgtgacagtgaatgcgatgggtaacatggcgaaccccaaccgatcagctcaagaccactcatgacgacctggacgctgtcaagagattagccaggaacatttgtttcagtactaattatgattgatgccctttgctgatgcgctcccttccttgatcaagtaggcaggtccctaatctaggagcttatctggcatcgatgggttgataattgatgctgatacaacagtgttgtaccttgggtgctttgttctccctgatgcgacatttttgtgagcgatcttattggtaagagtaaccccgttgccatcaccagcatttattattttccccattacctacctcagcaggtcaccaacctttttggaatgcaggatcagaaaaataaacatgaatcggattccaaaacacaggaacgatgatagtgggtgtttgaagggcctattttttcgcttatgtttatgcttatcaatcaaaatttaaattttcaaccttaaatttagagttgattttgagatttttttcaacgaagtttatttttcagcatttacttttagatcgctaagaacacgtttataaaagttttattcacaaattacttttcatttgcaaatatgccgtttcgcttatttcgcaattaagtgaaacgatggctcagttcgtccgttccctacacccttcggaaaatagaactttctaataacgaactatgtttgtccattattcctcaaaaaattgatttttttacggacgaagtaggaagtaaacatatatccctccgtccaaaaataaaccaactatactagaataatactgtacattactatggccaatctggataggtgctcttattcagatttactaggtaattttacatcatattctaggtttatttattctggaagagaggaagtaaattaatgacagagagaaactagagagaccgggtgcatgggacttgtcaaagaaagatagaaacatgatgtttgagctcatgtttattttcctatggaattagggtcatatgaggccaatctataggaattctggcatcctatttctttgttccaaaggacataaaatttcccaagaattccaatccgacataaatcgtatgaaattcatccaatcaatccaaaggaatcttagcacacgataaaaataaagaaaagctaataattgtgcggatacattatgccgtactttggtgcgcaaatacaacagacactaccctggttgcatatgcagggaggctagtgtgcggcaacctactgtccaatcttgggttttgggtaattgattgggcgattgatgcggtagcatggggacaaccacatagaactcgtagtaaattggcaatgtccatgctaggattttgaattgacagtgcccctccagtgtacagccccaacaggtaactcatatgaacccgtgaggggaaacagtggtttgatgtcactcttgtacgtaccactatactggggagtacatccaaaagcgaaatggaacaacacccacatgcatatgttgctgatcgattttgattcccttcaacatcaccgtctcgtggtcgctgttcgccggtcagaatttgcattgcaaccggactgcatgtctcagggtcaggcagaggcagctcaagtgagtccaacagagagacctgggcaggctggctatgggtctgcaaaggatggggcatgggcgcggcacggtgttttttgttcagcatggatttgcaaggcactacaccagtacagagtacatactacagagcaagaaaacttttcatggtcttgtgtgtttgtgggtcagttcaggtcactagacaacagcaggagatgggagcaaatagtaaccaaaacccccccaccccggatcccacccatgtgggtaccaattggacccttgctggacacagcgaaattttcgggaagagaccactccacagtggagatatctcgccgattacactagaatcactactgctatgctacatgccatcttcacaagatcgcaatatcttgaggaagctacatggaagctagaaatctatatcacggctcaattctatgagactatgacagatatgctgagattatatgcttttttgcataagcaaccaccaaagaacttgtcggatttgtttgaattttattgtcaggaggtgagaagcaaacacggataaaagggcaaggggggaaacatacctgccattctgccaaacgcaggtaggtcgctgtggtggctcaggtcgagctgtagatgtcaccattcctcgttgcctacacaatacacattacagtttggattagagaatagggatatcattagctttggccttctctccattcaaacgacaactttagtccacctgtataaattataaatctgactccctctttgcccttcccttttcaataatacactaagtaattaatagtgggatctgatcagaatcatgagatcatatgggcctacgtgttcacaataacaaatgcttctcgtccttgtctccatgcaccaaaactaaaactacagcagaaacaagtaggcaaacaagcatagatggtgcatactcaatacgattccaaatataatccactttagacctgtacacactgattattaaagcctgtcaaatgagtttgttggtacttatattgcatagaaaaaatagataacttactgtgatagtgatattgttcatttagcaagggaaagaagccatcacaagaaattctataacaacttacatatagaaaacaaccttccaatttttgaatggtaattttgtgtggatggtcattataaaaaacagtcaaacttaacaaggcttaaacgaattgtatgtttacaccactagcactactaagaaacgtcttatcatagattcgcagctatttggtgcatcaaagaggaaggaaataaaggatcataatacgctatgcatttactttctctacactttagttccatgctggcatgcattttaggtctgataaggacttctcccagattcctactaactggctaaacttgctgtaagttgaggtgcacaaacaaaaggggttaccctttgtggaagtcacttgttttcaactgcactcaggtagtcaggtataatgtttactccacatatctaccgggtagaactagcaaccaccttaaatggtttcaggtattaaaacattattctgcatcactacctaaacggcggtagttaatatttgcttaacagtagcactaatacctgctaaaaggattgaaggatcgggacagctgtttgtgttcgacccaacttttttgacactttttttactggcagttgtaaaggaaaaaaaaaaggtacagatatatacgtagtaatgtaaaaggcaatcattcttcaactgtttacaaacaagttctggcaactacagggactcaactaggtgacatgagaaagcagagagctatgatggccttaagatccattcggtatctttctgttttctatggcctgtctttgctttttcccaggggtaaggtaatcttatttaaaagatcatgattcaagaaaagaaagtgggaatcaaaaacatatctatctccaatgagtgggcctgctattatagcagatttaattacaggagaaagatgttacccttcgatacaccttcacaagagcagggaacaatcagtagcaaagctttgaaatgtaaaatatattatggcagctaaaactgtagagggaagaaaaggcttgtttgtttgattatcatccactaaacaagcataagatagtatggaaaacaagtggacctgtgtatcagttagtgctattggttgacctatagccgctctgatgttttccagtcttaagttcaaaatatacttcagaacttcaacataccgtcatatgtagctttagaacttctatttttattattggttcctcgctctccaggttcccgttgaaggccctgacaggaggacctaattgggccaggtccaggagagttgcaaagatttgacctgaaaatagcaaccaacaaacactagagttaacgacaatagatctcctatttgacagcagcaacctatgggcctagcagataccaaaagagatagcataactatcattagattgtgcttggaaaagggaagtcgtcttcataagttacagcttacaacaggacgtagctgtctacttccaaatccctttttttgttgcttcacgatcaagccttcatgatggtacaaaaccttgaaaatagtactgtatagagtgctggtatgattgattgacgagttaagaacaaacagtttctagatagccaacttgtaccagatatcatacccaggatttgtgttcacacaaatctgcataatcttgaaaaccaaactaaagtagtaaaccaaatatgctcatcccgtccaaattggcgacaaaggaaataaattgggaaaaaaaagttctactgacaaaggattatactgagtaggacttgctgtaaggaagatgggaaaaaggcgctcatcaatcataatgattcaactgacataagaaactaaaacaggacaggaatgccataatgtaccaattatcaaatgatacgcagagcaagctatgttctgtgaagatcctgaaaagctcatttggttctgaaatgcaatacgctaattccttcagccaggactcaaagaaaactgaaacagcataacagtaggtatcagcttatatattcaagcaagtcaaacatgtagtgccaaataattgcggtgcagattagaggaacctgaaatgggtaaaacagtcttaggctcaggaatacaagaatatgataatatattcagaggtatggttgaatgtaaataatagtggtatggtctcaggttaaaaagaaactggatatcactataaaaagaagtaattatggtcaacaacagcgtcaatgatcttacattatatgctgaacctagatacattggtgcataacctcttatatatatttttttcatttacatttggccgggtaaatttaaatgaaatgtacataaaaaagataagagtgaaattacaacaatatagactatgtggtattatgctgaatgatctccaaacggccagaaggagccattcatatggttggaatcgtaaccctgcaaataaaaatggagaaatatttcagttcaaaagacaacatggagacatcgcatgcacagttgcacactcatgtttcaaccataaaaatgtgatgcgggcaccatacaagattgtttcagttgaaatctagcaacaataccagcaaagcacaaacaaccaaactattaacactcattaaaatcgtctagcaagggtactgagattgctgatttgttaagaaaactataccataaagacagagttaacctcacttatctgctggagtctgagaattattcttttggcaagtaaatcccaattactactaacactggcaagtgtggtagatcatgaatgtggataaaagttacactaacatcagaatatatggaacaaagagcaaccaagtattaactaaatctgaaagagatatattgggcttgtttggctgtcatttttgtggctgcgtctgctgctagtagccacggctgtgcgccacagccacagacattatgcacagctgcagccgcaaaaaatcgcagccaagcagtgccattttgaacttcagcaaatgagatcatgtgatggccattcttgagcaacaaaacaaattgtgtcatggattgcatattaaatagcaaaaataaatatttcagaagaatgtgaaaggatacacgggacatactataaaggtccagacattttaaatttacagcatccaaaacgaaaacagatactaattcataattctatcgtttgcaaggggaaaaaaagcatcactcacagacatgtctgaagttttcattgatcgtcatcagccacccatgaggccaagaacaatataatatattcgggcgttagggagtgatctaataagataggagtgggaagtagctagataggttaacagtcttactacccatggttgaatgagatggcaccaggcagcaccaaaaaaggggagaggcagagagaacaggggatgagagagtagacttgtaatttgctcttaatttcaaagataatgccaagctctcttaaataaagccagcccctaacaaacctaaaaagtttaacaaatctcaacctaaacaaattgaatcaaacaactaaggaggtacgataggtgcggcaaatgcattgatggtctatctgctgccgcttggttctgccccctgtgcgccatccttagcacttcaactacatgtgtaccgaccatgacacacattcaacagtacacaaataggagtaaaatggagcgataaaaataagagtatagggtattaaaaaagcacgttcacagacatagacaccgttacgcttaccgattggaaatcattttcagaaaccacattccagttgcactgccaattttgctgcaaggaaacattctcatctccatgacactcataaatttgtgtttgttgagggtagaaggaagttgcaaataagcttgcaataccactgaattcactggagcttaaagtatgctgcaagtcaaagtaacgaattagtaaaggaaaacataagtagctatagtccaataaaaaagttcatggtccgataaaatgtagcactcaaggagtttaaagaaaaaataatattgcctcaggaaggtattagtagcacaacatatgtgataacgatagcttccactgaaaatttcaataatacaattactttgatcttgaagcagcaaggtatcaccatatcggtataacatcaaatgtgaaaaagatagtctcagttggatattttttttacaacataattcctgaaataactacctaacttacattttcgaattcagcagatgccccatctgtgcaggactgatagtatcccgaatgcatagcccaagaaggcttaattggttcaaatggttcatctggcacatgttcatcgggcagctgtatgtcatatgaatgtcccaacatatctgaatcatcgttgctgttatggtggttgtatgttgagaagctctgcacaaattatttaattgacaatcacaagactacataaaaaaaaagtgttctcccttgagattgatgaactcaacctgaacaagcaaatgcataattaccaaatgaagacactgtaaacagcatttgtagatgacagacaaacctcatagtactccaacttctgagaataaactgtttctgggggctcaacaagaacatgtagcggttgttcactaaactgctggttgtaacaataaataggctgagctgaaatcttactttctgcacaagagctggacaagatttcctgcacgcaaatttaatattaagcagggattagaagcgaagatagcaggcaggatctgttgaatgctacacaagagtaatgtatcattgatttttttcgcgaacgctaatgtgtcattgattaaactgtctagtcacagaaagcgactccctcaaaataaacaatccttttcgttccattttctgtcattttacatgtcaaatatgtccactgacaagattagctagcatattctcagaaaaatgaatcaaacataactaaattacagtactattgcacgcaattgagctaaatactcaggctgacgactaattgacctcattcttcttgatcagtgataagttaattagtacctgatactgagattcctcctctttgtacacg

SEQ ID NO: 20752 - DNA, 12952 bp, Oryza sativa
ttatgtttcatctttggcattgtcatcccaagataagcgctggctcaacatgcaaaacagcagacgtagcaggtgaacaacattagcaagtcaaaagtgaagtgaaaaatcccgagtggtatggtgtattcgctcacattgccgttgttgtagttgtactccgggtcgtcggcggcgtggtgccactctacagtcccggtggccggcggctccacttgtatgacgacggcttcctcgacgcctcccttcctgttggcgtagacggggacgccgtggtagtccaccccaatacggcgctccccgtagccatcggcgtggccgaagaggtaatccagcccccgcatgaactgcctccagtagtcgcggccgccgcaccgcgagtggcagcgcgcccccgcgaagaagggccagccccggaagacctccggcgtggcgtacgccggctgctcgcgcggcgcatccccgtagtcgtagggcttgggccagtagtacggctccgccacgggcggcggcgaaaccggccgaggctgctgctgctgcggcggcggagaaggcggccgcgtttgcgggggagtgggcgcaggcggtggagaagccggaggcggagtaggcgacggcttaggcggcggggccgtaggagcagcggaggagacggggtagcaggtggtgggggagggcggaatcggggagccgtaggtggcgaagatgtcgtagccgccgccgtaggggtgggggttgtagtcgtcgtactcgtcgtcgtcgtcgccgtagtagtcgtccgccggggccgccatggcgaggaatggtggttagggaacggagtagtgatgaggcgaagtgggagagggagaggatatggctgcgatggtgagatgcgacgacggctgcacgcgcgcggctggtggtatgttgatttcgagttgaccgcgacgggcgccgatgtgatggaggcgtcggtgggaagcgaccgcatgcagaggaggttggcaaggagacgcaacgctattaatgcagatcgcactttgcatcgatcgacgaggtgcgttcaaagctgtactagtacgtatcacgtcacgtttgtatacagcggcgccagcgaagcggcccatattactaagcactcgatattgatgggccttaaggcccaacccaagcgagcagtttcatacagtcctcgcatcacgtacgttgcagctctttttttttcttttcgcatcacgttgcagacttgcagttcagtagatggctgatacgcaaagaaaaggtatagcaccgcaatatactattcatacttgtacgagtcaaaaagggaacacatgcgtggattatatgaaacgttgcacgtgcgtgccacgtgaacacatggtgcatacagcgaagagacgagaaaatggcacgagacaagtcaacgagaagagaatcgagtgagatcgcggtcaaaagcaagcccagcgtgttgttcaagcatgtgcctgtgatagcgtcgcgacaacacggcccagccttcctcccagacccggcgcttgcaggcttccagcccacagactcccagagcgcgctttacgtcgcagtccaagcctcctttacttcttgcgcggctggccgattacggcccaacttttgccctcggcctagtaactcctttgactcggtgggctatggaattttgtcaaatctcttttttgtttttttttctttcaggaggttttatcttgttttttttcccattttgcaaacaaaacgtatttcaaaattttctatcacgatacctgggctatggaattttgtcaaatctcttttttgtttttttttctttcaggaggttttatcttattttttcccattttgcaaacaaaatcattgtcgacatctactcatctgcccgggaatataggggattatttctccttcatttgtccaagaatatagacgatttttgttatactgaggcaacaagggcagcaacaaactgatttcagcatataaggctctcacaaactcattaatactaatatgtagtgcattttaaaattcattcactcctaccaaactttagtagtttttttttaaagatgtactctatgcacatcattcaacgtgttaactatatatgtcttttcacacaatcagatttggtgtatactttcttccttaatttgtacccaattgggaataatcccatatatttctggatggaggtattattaaaaagggaaggattactataacttgaatacaatacataggaacgcataaatgccaatagcgataatactacactagccattggagttgttcgtcgtataatcatctactatctatacgcctaaaatagacaaacaacataatgtccgcctataaatggtacctcatgcattagaggagagaatatgctcttcggtagacatgttaggttacatatgttatcttatatgtagatgggacaagaagaaatcatgagaaaagcgtttgttattcatgatagataagcaagatatccctcaagagaagctaacctcgtgcataagaggagaggacaaagaatacaacaagagtgtactgcttatatgctcaattatagcaagcgaattattgaatattccaataattgcgtgtcgaaagattatatattcagggtcgtttgtctcttacattaacccctcttaaagaaaaagcagtaaaaatcaaaatatataattctggaataaataatattcatcaacactttaattttgtaaaagagaaaaaaagcataagccgtagaggcaagccttgtaaaggaatgaaaataaaagcattctggatatataaacaaaccacaaaagatcgatcgcattcgcctcttgatgtatacacatggtcaaatccaaggaacatgtcgtgcccgatcgtaccaaaccaagtcacggtacacgcgtggaccgcgcacagattagccaaactctgaaagcaacacgcacggcaaacgggcaaagccggtgaccgggggacgcgcgatcgatcgatcgagccggcgcgcgcacgaagcaaaccgcaccgcatccgcatcgtcgtcagcaagagcaaacctgtcgcgtccccattccaagcccgccactttgtcctcttcctctggcgctcggctcgccggggagcagagcagcagcagcgaacccctctctcgccgcagatcccaacgccgcacacacacgcacacgcacccgcacgcgcacgcatttccagctcgcgacgacgcccatctcgacgcgacgcgatccccgccaagtcaaaccccacccgttatactctccactgcgatctcagaggcagaggcagagcccacgccgcgcagatccacctctctccgccctggattccgcggagcaggaggcggtcaagccgtcgccgccgccgccgggccgcatccgctaccgcacgccctcctccccggacctcctcctcgccccgccctccgacgccgacgccaagaacatgcgccgctactccgcgctgcccggcggcggcgcccgccccgacacgctcgccgaccgcctccaccgctaccgcggcgtcctcctcgtcatcctcgccccgctcgccctcgtctccctcgtcctcctcctcatgccgcgctcccccgcctcctcctccgccgccgccggcaggaggtggggccccctcgacgccaacaagtacgccgtcattttcgacgccgggagctccgggagccgcgtccacgtcttccgcttcgacgccaacctcgatctgctccacattggcgaccagatcgagctcttcgtccaggtgatccatccacccaattggatctggatctgctagggatcctttcatctctcaatccatttttacttaatttccccccacttccccttttgcagaaaaagccggggcttagcgagtacgccaataacccgcaggaggctgccaaatcgctcgtctctctccttgaggatgccaaacgagtggttcccgtggaattgcgcggccagactcctgttagagttggggtgagttcttgtacgataccagtagagcttcctattgctgcttggtcatcttctaataataagctttataattcacacacaggccaccgccgggctaagagcgttgggagcagaaaaatcagaggagattttgcaagcggtaaattttgcttttattcacctttgattaattgttgtttgatcgatcactgaatttatattggttgtccctaatattgaatacactcacaatttttgcaggtcagggatcttcttcgcgaaaagagttcgttcaagacccaaccggattgggttacagttcttgatggacctcaggaaggcgcatatgaatgggtacaaaactggcctgatttattcatatggttcagaacattactttgtgctcctgattattagaaatgcctcacatttgtcagattgacaatataagttctttttgtttagaaaaaactattttgttcagcaacaaatctgccaattctcttagagctgacatctgccagcttcaaagatataagttttaaaggacatgataaaaaaagagaaattttcgctttcatgagtgaattaggcaaaataactattttcatttttgaaaaacaaaatttgggcaccagaaacaaatgacgaaacaaaatccaaatgacgaaagctaaacattgaaagtaagggcaccagaaacaacattttccctgaaaatagatgcagatcatctgaatccatgtggtgcactgttctgacagttaattcaccttttgagtgtttaggatctgttcacaactagtgattctatgtctagcttttagtccattaactgataacaagtgttgctcttctctatccttataggttaccatcaattatctgctggggaaattgggaaagacttacgcagacacagttggagtggttgatcttggaggtggatctgtgcagatggcatatgcaattgcagagaaggatgcagtgaaggctcctaaaccatcagagggtgaagattcatatgtgaagaaactgtttcttaaaggaacaacatattatctttatgttcacaggttagtatgaaataccgttgagcttttggctgctgctacattgtcaagaaaaaagttattcagttgtgatacggtaacaatcttcaaaatccatttaagcatttgatggcataatgtcatgcctatttttaatgtcggctaatgcaattcataggttatattctttgcaaagcagacagctgttgtaatcctctaagatactatctcgtattgataaaaatgcaagaatagcgtattaatgcaaatttgagaaacttaagtccagaccaaacgtaagggtacttttatgtgtaaagattctacctaaatatcacgtggtattctatgtaatgttctacagcaaacacttaatctgacatagccacaaacttaatactccttacttttttattatctgctgtataagatgacatcacatgacctgtttttagtctggagtctttgaaccacatatataactgtacacatttcttcacagctatttgcattatgggttgctggctgctagagcagagatcttaaaagccggcaatggcaaaggttacagctactgtacattggaggggcatcaaggtactagtaacatacttctaccatattcttctgctatcatttaactccctgccaagtagcttatgtttgttcctaaaatttcaattgttgttacccttatgcatattttggtcaagggaggaatgtaatgcgtaggctgcattcggaggtggaggttgggaacttcacctcgccacacgcaaaacaaagcgacccattagcgcatgattaattaagcatgagctaaaataaacttgaaaaaaatggattgatataattttgtaaaacaacttacatatagaattttttttgcaaaaaaaaaaaacaccgtttagcagtttggcaaacgtgtgcgtggaaaacgagaaatagaagttgggaagaggtggtaaggaacacacccttatagtggatcgtaacctggtttaaatgaggttaccctcaaattctctatgaaacaaataccttactggtttccttgatattctttccaaccatcagtctgcagttagaattatttatagtgatgtgtataaatctaaatcctcatcaacacaaatgaccaatctgtgacaatagttggagatgcaattttatcttttctatgttggtaagatagttttgttctaattgcattgtgattgtagggcaatacaaatatggcaatggcaaatttgaagcgtcggcttcaccatctggtgctagttattcaaaatgcagggatgatgtagtgaaagctcttaaagttgaccaagcatgcactcacatgaaatgttcttttggtggcatttggaatggtggtggtggcgctggacagaagaatttgtttgtggcatcatttttcttcgacagggcagctgaggtaaggttgttgaactactgaagatgtttgcttttgttgccatgatgatacaccagtaaacaattttctggtctctgctcaggctggatttgtgaatcccaaggcacctgtggctaaggttaaaccttcagattttgaaaaggctgccaagcgtgcatgtaagttaaacttgaaggacgccgaagctgcctaccctggtgtccaaaaggataacattccatatatctgcatggatctcgtttaccagtacaccttacttgtggatggatttggtatgtctcgttaaaactaaatataatcaagaccgcattacagattttgcacaaatttatcactaatttgttttgctcttgcactctcgcaggtgttggttctcaccaagagatgaccttggtaaagaaagtcccttacagcaacgcgtttgtggaagcagcatggccactgggaagtgccattgaggttgcatcttgatagacagacagcagaaagttcagcaagggagctacgatcagagggcgtcatcgccgtaaagttttggatctggagggtgttcgcttgctcggcgctgcgcacgccccaagtgaccattttgttactgaaatcgattgatttaacctgcttctatacagtagcctgataatgagtgatacacaaggacccgccagcttgcatagttgcatacttgcatgcaaggggtatatacattttttttttgtaccattgaaagtaagacgagcctgtcattcttttcttgatctatactactccagttctgtacctctgttaggggcagtacagtagagaagaagattgaccatgtgtccatgtggtgatcccacatgccagcatgactcagctgatatgtgggtcccacactttgtctctgctgccatgtcagctccttttgttgttctccggattaaattgtcgtgtaagcgtcacgtcaattccacgtaggatgaagcagcctagtcaaaagagctatgtatgaaccttatttgtataggttttgtaagttgagggattgtatttttggttaaggacgaaaatctggcgacaaattgagactttgagggaataagttcatccaaggtcccttaacttgtcaacaaatccaattttcatcccttaaccacaaaaccagatacaacgggtccctcaactatcaaaaccggtgcaatataggtcccatggcggtttggatggtggttttggcttacgtggcacctacgtgtctaaattgacctggtcttcatctgacgtggcatagatgtggcattgacgtggcaatttgatttggaaattaataaaaagagtaaccccacatgtcagctacaccaaaagaattaattaaaaatggtgtggtccacatgggccccacttgtcattcactctcctcatcttcttcctcctctctccctatctcccctctcctctctccaggagctggcggttcggtgatgcggcaggccggcggcagcggagccagggatgacctcggagacgaggacgccggggagctgcgcctggacggggacgccgacggcgagcgcctgggtgtagatgatgaggaaggcgaagaggaggttggctgcgacgccggcggagacgacgaggagccggtcggggacggggcggttgcgcaggaggtccgggtcgtcgggcgagaagccggagtccggttcgtcgtcggggaaagctgacggagaacttggagacgtggatgccgcaagaggtggcggaggcgaccgactcgacgctggcgaggaggtcagacggggggtcgccgcggcatcgttggccgccgaacctcccttgacgccgcatcgccgaaagggaaaaagaagagataaacaaaaacaccatattttaatctgatctgatatgatcaaatgcacctcaagctcgatcccattagcagcaatggcgatatcgttgattttcacgacctgctcgctgaggaatggaggtccagttgctggtgccatgggtggaggtgtacgctagcagcttggcgcgcgtcctcctccgccttccatggccccttcttcacgtttgccttgtcgcagcacggcggccgccccatctctccttctccccctctcagctcctaccacggtgagctcaacaacaacaacaccaactctgagtccagtaacaacaatcaccgccggcgtccccgtccaggcgcagctccccggcgtcctcgtctccgaggtcatctctggctccgctgccgccggccggccgcgtcggcgaaccgccagctctggagagagaagaggggatatggggagagagaggaggaagaagattaggggagtgaatgacaagtggagcccacgtgggctccaccatttttaattaattcttttggtgtagctgacatgtggggtcactctttttattaatttccaaatcaaattgccacgtcagatgaagaccgggtcaatttagccacgtagacgccacgtaaaccaaaaccgccttccaaaccaccatgggacttatattgcaccggttttgataattgagggatccgttgtatctggttttgtggttgcaggatgaaaatcgaattcgttgacaagttaagagaccttggatgcacttattcccactttgagcgcaagttgttatggtgtatcggcccatcaaggcccaagctagtgtcgtatgggcttgagatacacctgggccatcaaacagtctgaacgggagtgagacccaagtgtttacggcccaatgggctgtatatctgactgagtgaagtatgcccttgtcagttgtcactgcagctatgctaattagtggtttggctttatcaacaatttatcattggaaggtccttttccacaaaaaagaaagcacgtttttacgtagacatagacacgcgcacacacgggtgaaagaaacatcaatcgaataataggcagtagctaagctagctagctgggtacgtacgaaaggaatacgtagatctttagtactcaccgtattggactcggaagagtggcgtatcttacggtttttaaccgtctcttccacaaccagcctacacgtgtcccgtcggcagtaactagtgtgatctgctcctcgccaatgtcgacacctgttagatcccaaatcaagaaactcaccaaattaatcttcatctctctctcttttttttaccagctgtgatcaacacgatttattacatcgatcacgttggtaattaccggagccaaccattcaaaaccatgtgtctggctggccatctttttcttaggaagccaggttgtactacactactgctagctgctgatgcttaactgaccttgcttcctgctagcttagtgcttagccttagtatctcaagatggatgcacttacagaacttccctatctaacttggaccctctagttaggttcaaaagatagttatctttaaaagaaaagttaggttcagaacatgcgttcgttatcagctgttaattcgtagaaaagttcagtttaatttgtttaccgtttccagaacaagttaatttgtcagatccgtgtaaacatgcaaacactcatcgatcatgctcgtaaattaaatcaaattgttccatatgaaaagcttgcaaaatgaatgactttcaagcatgccctagctagtaaactaaattacacaacacctgcccttatatgaaggtatttttcttgattgaaaataagaacagtaaatgggagagttggctcaagttggtttaaggatctttacaggtacattgaagcttcctctacacgacattatatatattatgcgcatatatatatgcaggccttgaattcttcatgtcacaatctaaactggacgcagcaaacagtaagggaatggctgtattcatcattgagcacaattaatctaaccgtacgtccttttaccttggaagaccataactgtactaatcgacattagcgatgcttcaacggaacgtcggactctggtgtccagctgatctatctatctcagcactattattaccaaatcaattaccagctagagattaatccgaacacgtacgtggcgcccgatctagagccgtatatatacgtacgctaataattagctggccaatgagagaaaataatatatatggtcaatatataggagaggataaacatcacgttgttatctcccatgaaagttttcttcttcttattctcgtctatcttcttgagatgaactacttattcagagtgtacagctagttcactactttgtctgcagctagctttcctaagagatcaaaagggtttccaagtgcatgtcacgataattaaaaggtggccaccatgcatggttcatctttcgatcgagatcgagttctataaattgacctgtcaatggtatgtctgccagtagctagctcgaggttaatctattcgatacatattccatccgtttctaaatatttgacacagttgattttttaaacatgtttgaccgttcatcttatttaaaaatttaagtatttattaattcttttcctatttgattcattgttaaataatataccttttatgtatacatatagttttacatattttacaaaagtttttgaataagatgaacagttaaacatgttttaaaaagtcaacggcgtcaaatatttaggaaaggggagtatatattttatttgaaacacatgttaattgttttgtcgtacgtcctctctcaacgtattactactggtcagttggtttgttcttatcgtctaattttagatcgaaccggccgggtagtctgtccttttacggcagtcatttggtcaagtcatccgtgtacatgcatatatgtcgtcgcagccgatcaaagctagaacgccacataataaaatcataatcaactatatatatggtggttaatcatatatacacgtggattttccttgtttaattgtcgtcttgtgcaaagtgcaatgggctatcagcaagttgcattttttttattggcagatgattgcaatatggcagcacatatacataaatgataagcaaaacctgcagggtgtggaagacaatcatttggagcataaacaataagtacgtatataattataaatatttaaatacatgcatattattgctggagaagagaaacggtctttatatcaacgtctactttgatgaagagactctaggattgtttaattattccatggaaaaaataaagggggaaaaagaaatggctagctagaccggtcgttccatgcatgtagagctgcatgaattgtgagatggatgatcatgatcgtggtgaccacgacaaattaagccatcaaaatcttctctttccgttgagtgcaacagcacttcacttgggagtatatagctagcgtgccgtggtcgcaagctacgatcgagtcgagtatatatgaagctaccagagctgcactgctggtggtcaaaggcacccggccgcctcgttccttaactcttgcatgcatctatatatgcatgactgcatacagaaatatggtggattaattcctgaaattctccatagaaaagagaggcagatcgatgttaataagataattaatcaacacgtacaaacttagcttgtctcgtaacttaatttgttctcttgtatatttgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttacccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcaacttagcaatctacatgctcgcccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtg

SEQ ID NO: 20753 - DNA, 6875 bp, Oryza sativa
  unsure (1)..(6875): unsure at all n locations
gtcaccgacaatattaatttctctcatcagctgattgatcgatgggtctgaatttcctttttgatcgatcaatattgttaatattttctctcaaagtttttcataactattcgagtgacatacaaacaatgagagaggacatttcttcgaaagtttaaaatattttccctatttcttcagacaaccaaacaggtcgatcgtcctacataaactctcgatcgctagtcgctatgcatttcttcagagtatattcgatcgagcagggaggagccgtacgataaggggcaaggagagatcgataggagggtaggaagcatgcatgtaccggacttgcttgcacgtggggagaagaaggccacgtacgtaccacacgcgcgtacgcacgtacgcacgaatataattaatgtagtaatgtataatcacacatacaattaattaagcaggggcccgtacgtacgtgtgctcctccttaatctgcatctcctatatatgcatgtctccttcttcttcgatcgaattagctacgtactgctggtagcttaattagctaactgcttaattgtcctgatcaatcgaattgcagtcgttatgcagcttctctctttctccaagctagcttacaccattggccggctccaaccttacttacttcctttgacccaatgcaagtcgatttctgcatgcacgggcgcgtgtgtacagatgctgcgtactacagcttcaatattcagtggccgaaaagaagaaatatgtacatggagagtgaaagttagctactagtagttggtaggtactgtatgcgtattcatgcgtggtcacttattccttccaaactcaacgacccaattaaggacgacgcatggccgattcagaaaatcgatttgttggtgttaaagtgtgtctatcgttgttataatatgttaattatacttagattatgatgttataatatatagataaacaattttgctatagattttatcaggggcggaggcaggcctattgcagctagggcttgagccctacgcctgcctcctanacttgcttaaattttgttgattcaccatgtaatctatttaaaaaactaatactccattaatcgagccctaacttagctctagtcttacactggtggagaaaccatctttggtcggttggccaaattccacaatagtcccagttctaataaaaaccgggactaaaaagcatctttagtcccggttgaaaagttgaggtgtacttttttatctttaatcccggttggtgtgttaccaaccgggactaaagatcatttttagtcccggttcaaaaagttgtcgggttccagacagatccccattatttttactcccggttggtataaataaccgggactaaaaatagatctttagtcccggttgtttataccaaccgggagcaaagactatcccgagagccgcgcgcgatctcctctcgatctcctcccctctcattaatatctccttcaccccctcttcctctccccttcatccccttcctctccacttcccctgccgttcctccccttcccctcgatctggagcggcggccggccgggcggtagcggcggcaccaggcaggagcggcggcgcccgacgcgagcggcggcggtggccgggcgggcgggcgcggcggcaagccgggcgggagccgtggcggcggccgggcgggcgggcctggcggcaagccgggcggtagcagcggcgcccggcaggagccgcggcggcgggcgggcgtggcggccgagctggcgcagacgccgagaggacggggaccgggaggccggcggcgccctcccatctgctgccgatttttttttttgattttgtgtttcattggatttgatctgtgatgtatgtgatattggatctgatctgggatgtatttgagttgtgatgcatttcttttaggatttgtgatgtatttttcgtttgagatttggtgatgtgatgtatttgtgatctgtgatgcatttctttgcaatatgtgatgtatttcttcccaaatctgtgatgcttgtggatgatttgggatatttagggagcaaatcgattgagcaatgaaacaacaacaaaaaaaaaaaaagaatcaaccgggactgctccaccatttttagtcccggttggtaataccaaccgggaataaagatggatttttagtcccggttatttcacccgggactaaagatgggtatctttagtcccggattcgtactcccggttgtataaccgggactataggggggtttctaaccgggagtaaagcccctttctctaccagtgttatataatttctggctccgccactagattttatcgagagtcatcggtccttatactatagatccgctccacgcatgcaagacaaactggccgaagtacgtaggtacttctcatcattagtactaatggctagtgtacttgtgattcagttttgcagtatctgttatctgtatactgtagatctcgatccggtccaatcattttcaagctaggttctagctgatacgccaggtcatgttgttgaattcagtaatcaatcgagacaaattaatcatcgataattatttttttatttcaccaattcgtgtggctgctagctgatgaaaccagcaaattaaagaaaatcggaattaatggtcaagagatgctagcactaggttagctagctactatcagctaccagtatgcaggagattgtgtggtcgtcgtcgtcgtcacattaagtcattaattcgaccggttttctagatcatgtaatatgcggagtaatatatacatctgcgccgccatatatccacatcgaatgacccctttaatttattctcatccatctcagcagtagcagctagcatcgattatatatatatgtatctatgtatccattttcttttgcctagctagctctctcgtcccatcatatatatatgtatggcgcggcaatcagcagcatgggcttctacctaattgactgaaaaagtgaagttatttttgttatcctcttcttcttattattattccgatcgatatatgcacagcatctctgtatacaaatacatatataaatggatgacgtttgaaaggaataaaaggctaggaaaaaaaaggcatgcaactcacatactccagcacttgatatatatcaataatggatcagataaggccacagttgctgctttgatccacttgagcttagctagcttttgctgatgatcacaattagtaattgccgtcatccacatcggtgtcaggttttggcaagctagtagatagtggagtactccgtactccaaataaaggatgagcttagctagcttaattacctagagagatcgccgtctccgtcgtcgtcgtcgagaggaggcatgacatgagcgagagctgtacacatgtgtgccagtagttgcaggtcgatgtaattaagcgatggatgagatgcatatgtacagagctacagctacaggtggcggcgcgcgcacggcgacgcgtgtggcgacgagagggacaaggcgaggcgtgctacgactaatttaaccactgcacgccgcgccaaaagtttaaaaccccagccaatgcgcgcaagggcttcttcgcgacggcgacggccattgcgttcgtgcatgcacctggctgatccgacgacctatcagagattctcgccgccccggccggacggatcgatgacgagctagctagctatagcttagtgtgtcgctgttaacttgatgcatgctgaattagttagttcagttcgcgccgtttctatcttatctatggccaaagtacaggttgttcctcgttgatgcaatctacatcatatcgatccatggtcttttgtgtacttacttggattaattaattatgtttcactcgttttgtgaacacccgctattactatacacacacacacaatagtactactatgcccttgttttcaaatcacctccgtgacttgtttcatcttcttttaatctttatcttttttgtcaactaattaattaatcgctgcatttcggggtttcgtgtgctgaatcaaatagatcttactccctccgtcacaaaatataagtatttttagaatagtgacaagtctaacatttttttaacattttttactagatttattattaaataaactatcataatattcaactctttttatttaaaacatcttttttgaatactgttggtcaaagtagcatatttagaacggagggagtaccatatattgatcgttaattggttggcttataatcctacgtttgagtctttgaaagatcgatgaatatgaacgaaagggttgccaattgtcacgtacgcgtgtttggtgttctgaagacgcagctgatctcaaactgcagtgcacgtgtctgcttgacttaaatctcagctaattttggtcagaccacgaccacgttccgattaagttcacacgtagtaccgcttgatgacaattaatattccctcaataaaatggatggcaacctaacttcaaacagttagtggagtatataccactccgttccaaaccagagctgttttgaaatgagtgcatgcacacttatttcacacacttccatctgaaagtttacatttagacgaagaaaaaaaatcatatttattttctcggtgtcatggcgatgagagaggttcaaattcgtacaagttttcttcaaaatttgatatataattattcgaacttaacaaattaacccttcttaatttcaaccaagctcaataaagtctataattgtcctaggtccaaacccaaaacatgggtaagtagtaactaacatgtaggcctaacctactaggggaacaaaatagtagagtaaggagggacatcgaaaaagatgatctaaataggatgtttcgccttttattttgactagtaacatatcttgcataccaataagcacgcacgattggtttgggcgtgttgtatgggctcatatgtggctgatgataggttgggagttcgaatcaagatccaaccgctcatggatggtgggagaacaggaaggagaacaacttcattatttaagtaatagaggaaagtcagttatggatgacagtttttccataaagttatatgacaacctcaataaccattgtggccatggccgcttccctaaagcctcttctcctgccactggtgccacaagagcatcagcattttcactattgtcttagtggatgatgtgctctgttcccacacaaaactatgagctaagcaatcctaagaactaacaacaaatcattggtaggacgaacatcgacaacaatagttggataggtgaagtgaaggataagttgtgatgacccggcggtggttgttggtggtaaaaaaaatatgatatagtgagatgccacggatttaaagtcttgtatatgacttagatgtttgtctttgacttctacgttcttccatgttaagaactttatgggaggaggaagaagaacaacaagcttatactttagtaactttgtaatatcggaataatttattagtctatgacccaagttaataagaaacaaggcgattctcatttttgtcaggtctcatgaaggtcaaagatacctagatatgggttcttggattataaataatgggaaacaaataaggttctggaaagataaatggctaggaaacttggcttttaaagacaaatatccatctttatactctattgtccgaaggaaaagttctactattgctaatgttatgagatctgttccactcaatgtttcctttaggagatcattagttggtcagaatcttgcatattggcatgaattgtgtgcttatattgtacatattcaattgaatcaatcctctgatagctttagatagaattatcatcagaatggaatattttctattaggtcgatgtatctagctttaactaataatggttatattgagataaacaagattatttggaagcttaagatgccacttaagattaagatttttatgtggtacttgtttaaaggggttgtgctaaccaaggataatttggcaagacgaaattggaatggcaatttaagattttgtttttgtatgaaaaatgagactatgcaacatctttttatagagtgtcattatgcaaaatttgtttggagagcagtacagttctctcttggtttataccttcctactaccatatctaatatgtttgatggttggctcttgggggtagacaagaagaagagtaaactcatacttgtaggagcttctgccatatgttggtctctgcggttgactaggaatgatatggtttttgacaaatcaccatctatctcatatatgcaggtgattttcagggcaacatattggctccgattttgggcacagctgcaaatgtgtgaagatgatcgagagcttatgaaggttgcatgtcgtaggcttgagacaacggtcatgcaactccttgcaaactatggatgaagattcacagatagacttgaataaatgtgctctccttatcttagtttgatcttttatttcgttgggtgtgtttaattcatttgaactacactcagtgtttgggtgttacttttataataattggctatagctctgatgagcaaaggccgggatgttttattctattattgtagcgcccgttccgtcgtggcgcctagcggaaaaattatctcttaaaaaccctaattgcgaaatttgtttctttgcttgttgtctagtgttcgtgccatctcaagatctcaatccccgatctatcgtcgagtccaattccgaatccaatccttccaaatcaaattcctccgcaaaagtctattttgcctcccccgggggtcgatgggccgatttcctcccggcccatcgccccctgg

SEQ ID NO: 20754 - DNA, 27316 bp, Oryza sativa
catctccccctctcccccggccctccctctcccgggcgctctctctctctctctctctctctctctctctctctctctctctctctctatctctttctctctctctcgccctctcccctccccggtgcgctccctctccccctctccctccgttccgcccgcgcgccgcgcgcgcgtgcacgggagtcgcccgcgccgagcgccccctcccctcgctccccttctccccatccctggcgagcttcccgctcgcaaagccagcccccgcgcgccgtggttcgcgcgcgcgcccgcgtggtcgtctgcgccgtccgcgtggttgccgtccggccccgctgccctgccgcgtctgtcgcccgtgtcgtcgcgcagctccaaaccgcccgccgtcatcgccgtcgtcaccgcccggcccccgccactccgcgcgcaagccgccaagggacggaggcagcgtccctcctccctctgccgcgtcgcccccgctcccctcctcctttttcccgaatcggcaaaagggcaagcccctttctccctctctttttccccttttcccccgccggcgtcatcctacctgtcgccgctttggccgcgaccgccgagcgctagctcgcgcccttgaccgcgcaagtcggttcccaaaccgacattgccgcccatttaaaccccagcctccctcccttcctttcctctccctttcgtctccgcgccattgccgccgcccccgtgctctgttcgccgtcgccgttcgttgttgcgcgtgtcggaggagccggcacgagcaaggacgcggaagaggacttcggccgcgccctctccttcctcttccccggcccgaggccggagagattactcccgcgccgtcggcctcttgtcacagcgccccgacccgcatggtagtgcctccctccgttcttcctcctcgctccatctcctccccctagctttcggtagtagctcgagtagactccccgtagttagccggcgccgccccgaccgttgccgtcgctcgccgcgtgctcgccgccgtcaccgctcgagctccgtagcacccgcacgtcgccagcctcgctcggtgtagctccgtccaatccgacgctagcatcgagttcccgaaaccgcgtagatgctctcaccgccgggaatcgacccctcgtggcctcgccgccgtttccctcttccctccccgccggttgtcgccgccgtgattcgccgccgtcaagcttcctccggcaaatccgagccgttggctcgtctcccctcatcacgagcaaccgcccggtgtgctagcttttgcccgtatcgccgtggttcgctccgccgctcgccgctgccgcccgccgtccattcgtggccgggtcttcgtctacctcccgccggcccgcgtggcagccacgtaggcgccacgtcggcgccagctcagcctagaccgggtcgagccaaccccggtcagtccctccccgtgcgcgcgttccaccgcgagccgtgaggctgcgcgtgggcccgctgcatccgcgtccaccgcgaaccgcgcgcgtgcaccgcgtccctcccccgcccgcgcgcatgagccgcgtactccctccgcacggtgagccgagccgctgacaagcgggtcccacccgggaccgcgcatggtgagcccggtccaccggctctctctcctccctcccccgcgcgcgcgtcttgggccgctgtgggccgccttcttgggccggccagcccgttaagctcggccgagccgccctttttctcgggccgcgccctagccgcccgagggaagtctatattccctccctctccccttttcttttctttttcttttccaaaaaaaagggatttaattaaatccttttcctttagaccaaaaatccaataatcttagaaattcaatatcttcccaaccgtaaatccgtttgactccgttcaaattccaaaatttctcaaatctcgagatctatctaatggcacgcttagagttcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggtagacctacctaacttgttgcatttgattcttccattgttaattgctataccatgtccccttgtaaccatccagttgcgcctcgatattcgtgcaccctgtgccagtatcgacggttgccctcaaacttaaaatctgagtaacaacttgggtaaaactggagttttacaaaatacttggaaaacccgacacctgggtcggtgcttgcgaactaaatgaatttccaaaaccgcggaccgggaaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggatttgccggggtggtgtcggggaggacccctgggcttcctggcacagtatggtctgggacctaacctgttgttggtctgggacccctctcgtcgacatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctacagctgatgggatcagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaattaaaattaattgcaaaaacaccagcctttccttgaagcctgcattaaacacttatttcccatggcttgctgagtactcccgtactcacccttgctctatataaataatcccccccagttgctgaagaagatgaagcggatcctgctgatgaggagttcttccaggagcaagccggctatgatgagttttagggtttcggcctagttcccaagtcgcgcctgtgttgattggtccaagtcctggcttccgctttccttttgtaatgcagttgtgagctcgggatctgtccgcagcccagcatgactgtacatctactctataataaagagacctctgttgctgtgatattctgtctccctgtgataccagcactgtttcctaggactggtatcgattaacaggttaatttggagcgtcacggactagttccggtcgggactagttcggggcgcgacaattatcttaaaaaaaaggaattagtttctcatcatatttttttccttctacagtggctctcctatgacttgtgtagctaatagtatcctttgcggtgatttacaactcacacatattagcgatggtattaattaaattttctccgatcataaaagtatgctccaaacatgtgcattggtggccattccagttaaacaggtgaagtggaaatcatcccaattaacatacttactgtagtgtcatttctgagtttttccaaggcataattgagcgaggataatcctgattttatatatatagctagcttgcttcggtgtaccgccgaggcaaacctcttgaagagacaaagattgcagtttcggtgcatgaataatggatgttaatctgttagatatgatgatccaataataacgtacaccgaaactgtgtatggttcaattatagttgaaatggagccccacacacaatatagtactccttccgtttctaaatatttgacgccgctgactttttaaaatatatttactcattcatcttattcaaaaaatttaagtaattattaattcttttcctatcatttgatttattgttaaatatacttatatatatacatatagttttacatatttcacaaaagtttttgaataaaacgaatgatcgaacatgtgttaaaaagtcaacggtgttaaatatttagaaaacggagagagtattgtagcaaagagccaaacagttgtaatttctctgggaataatcaatggatgtgtgaatgtctacttcagtactattcagagatttctggcctttcgatcgataatgactagccatgtgagccgactgatccaattcatcgtctacaactagctagcgccggccactgcagctaaatagctccacgtgcaggatgtgacgtactccacaaataattggtcttctcatgctcctatttaaataaacaataagtttctttagagagcacccaagaatatgctttaattggcactgatatttattgaaatgatgaattatttaccgaaaagtaccggtggtacgattaaatctcatattgtggattcatgatttatcaatatccgtgtgcaattcacctatgagatttaaattgtaatgcacacggatattatatacttacacacgaataatgttttccttttttttccaaaaaaaagagcagattagtaaaattctgtttcttacctttgacataatcacgcgtatcatctactacatcattttttaatatatgacaccgttcactttttgataagcgtttgtctattcatcttatttattttttttgtaaatatataaaaaaataagttatgcttaacgaacatataacgataaatcaagtcgcgataaaataaataaataataagttcataattttttaaaacaaataaaatgaatgattaaatgtatctttaaaaagtcaatgctattatatattaaaaagctacataggagtatctatctacatatttctccagtcttataaaagaccaatctagtattggatgtagtatatgtaatacattctagtcatacgaatctagatatacttatgttcagatttcgttatactaggatgtgtcacgtttagttttagtttgtattttatgggacggatggagtatatgatatgatagtagtgtatatctgtcctatatttatgggacagatgaagtatatgatatgataggagtgtatatctgccctatatatgatcgatcgattccctgtagctgataacgatcgatgaaactgtatgcgagatatcacatgagattgatgagcagtgaggacggctagagatagcttagcttagcttaactagttagatatagatagatagatatagttagttgcagctggagacggatgagcatgagcatatgcgttgcaacattgctgacgccatagacgaccacgcacgagcccatgccgagtcatgccggacgcgaggaataacgaatcacccgattggccttccgattctacccctggtgaccccgaagaattacaaacatttgccactccgcgccacgtcacgctaactgacaaggtcgctcgtgcatataagtggcccttccctccgctgctccggaggatcgatcgatcgatgagcactcgctttgattcgatcaatcgattgatcgagctataggtagccaattacaagctaattaaagcagtaaccgtattagatcgtcgatggagatgacgatgtcgtcggcggcgacgtcgctgccgccggggttccggttccacccgacggacgaggagctgatcctgcactacctccgcagccgcgccaccgccgggcagtgccccgtccccatcatcgccgacgtcgacatctacaagttcgatccatgggacctgccatgtaagccttcttcctcgatcatatcgatggatcgattgagttggtcgttcggtcaattgctactggttaattaattgcagcgaaggcggtgtacggggagagtgagtggtatttcttcagcccgcgagaccgcaagtaccccaacggaatccggccgaaccgcgccgccgggtcggggtactggaaggcgacgggaaccgacaagcccatccacgacagcgccaccggcgagagcgtcggcgtcaagaaggccctcgtcttctaccgcggccgccctcccaagggcaccaagaccagctggatcatgcacgagtaccgcctcgccgccgaccctctcgccgccgccgcaaacacctacaagccctcctcctcctcccgattccgcaacgtctccatgagggtatgtacctactcatacgccatcgccaattcgccatgaccaccatctctgagcttaactactaactgcatatccatccatctcctcatgccacttgcgtgctctcatcctgttgcaccactactaattgaactactgtactcttcttctaggatattgtaatttaatcagatgattggactgacgtacgcttattaacttttttttaatgaactactagcatcactcaatcattaattcactcgctactgttagtaccacatcatgaaaccgtggatggtacgtaccaagagagatactcctttctcttttcacttgctgttaatttaatttaatttcagagtataataattataccgagagaagaatagagatatccattagccttgtcctggcgccatgcatgcatgtgtggttattatcgatttaaagtatgtagcttttgacaatgataggcatgacatttttgtgctcatcgatccatctgcttaattacgtgcagctggacgactgggtgctctgccggatctacaagaagtccggccaggcgtcgccgatgatgccgccgctcgccgccgactacgaccacgacgagccgtccggagtccttgacgacgcctacagcttctacgcgccgccgatgatcagcaccacgctcatccccaagctccccaagatcccctccatctccgagctcttcgacgagcacgcgctcgcccagatcttcgacgccgccgccgacccgccggccgaccaccatcagcatgccctcgccgtccacccctccctgaaccagctcctcggcgtcggcgacaacttcctcgcggagtgctacccgtcgacggcgtccacggccaccgttgccggcggcaagcgcaaggcgagcccggccggagactacgccggcggcggccacacgccggcgaagaggctcaacggctcatgcttcgacgtggcgccgcagtccgtggtgggcggcttgcaagcgacgccgtcgtcagtcctcgccggactcaaccaccagatgcttcctcctcagctattctgaatatattcttaactagcttaattaatggccatggaaatcgatcaaacgcagtcgatcgaatttacggatgctacgtactggcatgaacaatcttgccgacgatattaagatcggatggaagcatggacgacgatgatgattggggtacggtatagaattattgtagtattgaacaattaggcatttgtatgcgattttttctcctacgtattcatttcaggcacagtgcaaaagcaagctggagccttgatagtactttacaccgtagagagggaatgttgtacaattaaagattactagatatacagaacaataatactttactgtagccaattgatatactactagtatacaggattgtagaagatatcaaatgcaatagattctggctctgatctgggaaatggaaattgcatggatgtgttacttcttggctgaagtaggtgtaatatcaatggagcatgcatgcagtctaacggcaaactttcatcttctgttcttaaattagcaaagaagttgtttccaagtactataatctagtataatctaggctaggcggctgtagattgaaaaggacggattggatggattatggatagagcacatataaaggaggaatagatttactggaaacatactttttcaggaagaggcaaagatgcagtctgagagactgaaactcaagtctgaagattttcaacttattaacagtcagcgtttttgttaagcttgcttatttactgtactcatcatacttatcaaaagtaaaagctttcgtcagcagcaaccaccacgtcaccgatgacgaaaatactaaaagttgattgtcgatcaccaatgttacgggtgacttctgaagataggaccccgttggaatggtcaaagaccaaccatttcactgcaggttcaggctttcagggcagtatattcgggtccaggtcggttaaattcgcacggcactttacctctcaatgtacttatcatacccaggcagtagagttttacctcacgtatctctctctagtttttaccattggacggacagaagagttaaactgtccctgtcagtttcagcaaaggcaaagtagcactgttagttactgcaatctcgatggctacggggctctgcgctggaggtgttcactcctgggccgtgcttcgacagtaatcaaaagagcaatacgagaattatactgcgaaagtaatttagattcccgtattgttgctgaggatgagaggagtttattccgtacaagtgttggtgctgctaaacttgtgttcaattcaagtctgggcctcctagggagaggagggcccaaaccaagagggaaattgccaccgccgttgccgttccagtgcctggcgctgccactcacgcgtctccgccgctcgcaggccgccgcgccacgcccgcgcgtccgccgatcgttgccatctctgcccgccgcgggagagagggagcggcgaggagggaggggagagagagatgggacacgtgggtcccacaatttcttttctgtcaatgacaaatgggtcccacacatattttttaattgtaaatgccacctcaacgccacgtgtaaaggagacccggtcaataccgccacataggcgccacgtcagcaaaaccaccctctaaaaccgctaagggagtcaaattgcaccggttttaagatttggggggtcgagatatccggttttgtggtttagggtcatggattagatttcgatcacttttgagggtcactaagtgaacttattccattgtcacgtccgatgcttgtgttgggctctaaaagtctaaatgagcccttagatgggctcgggttatgcgtaggagggcctaatagggagttgtcaagcataggcccaatacggagttgtaggttctaggcccaatagacgatcaggcttcctacgggcaggcgtcgccgcgtcggcatgcggtatacgaagtagtcgcgcggtcgtcggagcgacagtagggttcggaccgcacgttgacagaggggaggagggcgtcgccggcctcgcagacgatggtcgggaacagggcggggttcatgtcggagctgtgcacgaagacgatggagggatttggtggtgggtgggcgagagatctagagggatacatacctcgatcgatggtgtttccgttcctggtggtgccaattaatggcggtgctaccattattgctgtggcggcggccggcgacggcgatggtgctgaggatgacccaaccggagtcgggagtggaagggcgttccatcgtagctatagctagcttggcgtgaggattgatggcaatggacggggaagtgggagatggaatggcggcagccgccggaagcagcggggatggaggatgagaggaataagttcactttaggtctcttaattcgtcgcccagtctgattttcatcctccgtctacaaaaccagatacatcgcatcccccaacttaccaaaactgtgcagacgaggtccgttggtagtattgtgcccggtttgagatgacgtggcgcctacatggttggtatgactaggtctcgtcccaggtggcgcttacgtggcaatcggataaaaaataattttaaaaactgtgggacccacatatcaattacacacaaaataataaaagagggtggggccatcgcccatccggccatgtcgctgagcggtcgcctccagcagccggctagagcgagagcagccacccccctcgcctcctcgaggtggccggaggaggagctcgagcggtcgccggcgagcaccatccattttccggcgtcgtcgaaggagaccactccacgcgttgctccggcagcgacgtgggagcacggggtgggaaggtggcgctgctggagtaggcggagcggcagtgggcgacggcggtggtgctgcacgagcagggctgcaaccgctcatgtcccaggtgcactgaactggtcgccttcccagccacgaactcgtccttaaatacagctacccgcaatcaatcaccaagcagaagcagagcaagtttgatttgctgtggccaattttttatgccatctcgacatagctgctgctcgattgattcatatatggcactagccattttcgtcagcatcgccgccgtcgccagagggaagaaggcgcgcgaaggaggagggggaggtgaaggtcctgtagtggcggagcgccgagctagagcggaggtggtggcgttgtggtcggagctagagtccgagcggtggcgcgccgagctgaagcggctgtggcgctgtgcgtgcaactcggggaggcggaggtggaggccgtggagctcgtgcgagggtaccagtgttgtgtccacgagctcgcccgggagctcgtcgccgccaaattaatcgtctccacgtcctcatgagatgggattttttcatctcttgcggagacattgaaatgtcatcctagaggagcaggatgatgccgctggcgtcggtgtgggcacattggtaggccagttacatgacgacgacaatccgctccactccgctgttcgctgccgcttctcccgccctgctctgccccgccgctccacccgcggcccctttgccctctgctccacccgccccgctttgcccctttgctccgtccgtcgccgctccgccccaccaatcacccgttccggccgctgcccgccctgctctaccagcttgctccgggagtcgccgctccggtcgccgccggctggagagagagacgatacagagaagagaggagagggatagagagaagagggagtagtgaggatgacatgtggggccacatgggccccaccattttttaatttgtttgtgtgtgaaactgacatgtggaccccacatattttattatttttctagatgaattgccacataagcgccacgtcaatgtcatgtgggatgaaaacctagtcaaagaagccacgtaggccaaaaccaaggacaatactgctgagagaccttgtttgcacggttttataggttgagggatgcgttgtacccgttttgtgtttcagggatgaattttagacacgacaacaaattgagggacctaaagtgaacttattcaaggatgagacaccaccacggggaatggcccaaataccacctgcctgggccccgtctctctcctcttgtgtgcgtgcaggcccaaacccaaagaattccttgatgccggagcgaatgaatttgtggtcagggaaactatctttgatcactgcatgggatatcctatttgcatgttacttaactgttatgaaaaaatttgagaagatatatcaatatgtgatataacactccacaagcttacaagttcaaattcatatctatatctcataacgaaaaaacaaattaaaccgcagcttgttaacgtatatttacaattaaatttgttttttccgttacaagatatagaagttaaatttgaacttacggagtgatatatcacatgttaatatatcttttcaaatttttttataaccatttgactgacataaagacaagacaacgagggttatcccctcacgaatcaaaatcaacatcctttgtggtcatgtaatagttgaaagttgaaaggtgtgacgccaggtgtctgtcgtggatcatttaaccggtgccttgacagagaagagactacccacccggtgaccccgtgggggcaacggggacttggctgcggaaacgacaagtttctcaaattttctttcctaaaaaatatcacattgaatatttagacatatgtatgaagtattaaatatagataaataaaaaaactaattgcacagttagagaggaaatcgcgagacaaatcttttaagtctaattagtccatgattagccataagtgctacagtaacccacataagttaatgacgggttaattaggctcaaaagattcgtctcgcggtttccaggcgagttatgaaattagttttttcattcgtatccaaaaaacccttccgttattcggtcaaacatccgatgtaacactaaaaaatttcttttcgcgaactaaacaggccctatgtactccagaagatgacatgacacgacacggtgggtgtggtctcatcgatcggcaccacgtacgcggcctcggtctcaacgaacgaacgtctcgccggccggcctccagcttaatttgttctatataacccgggaggtgccatttgcaacgatcgaataccagcgagacaaccagacgccggcccttggaagctagctagcatgttcagccaccatgggcacggccacggccaataccagcctccggcgactggtccccagcacgagccgacgttcaagatcttctgccgcgccgacgaggggtactgccttaccgtccgccacgacgccgtcgtcctcgcgccaaccaacccccgcgacgactgccaggcaccaccaccataatattttcttcttctgctatgctatgtggctctgtgctcatctcttaattactagcttctctctaatccggaccatggcatgcagcactggtacaaggacatgcggcacagcacgagggtgaaggacgaggagggccacccggcgttcgcgctcgtcaatcgcgccaccggcctcgccgtcaagcactcgctcggccaatcccaccccgtatgtcaatcaccattagttcatccacgcatgcagtcttcgcgcgccatcttaactgttttacatgcatgatcgatcgacgctcctgtcctgatgcaggtgaagctggtgccgtacaacccagagtaccaggacgagtcggtgctgtggaccgagagcaaggacgtcggccatggcttccgctgcatccgcatggtcaacaacatctacctcaacttggacgccttccacggcgacaagtcccacggcggcgtgcacgacggcaccaccgtcgtgctctgggagtggtgcaagggcgacaaccagtgctggaagatcctcccctggggccccgaggcgtacgcgccgccgccgccgccagcatacgggcaccaggcatacccgccgccgccgcccaaccgtgaacctggccacggctaccaccccgcacctgcgttctacccgccgcagccgccaccgagccacgatgagccgggctacggctaccgtccaccgccggtcggaccacccggtgcagggtacggcaaccggctgccccgcgcgctggcgtcggagcccaccgtgcgcatcctgtgcagggccgacgaggcgtacagcctcaccgtcaggaacggcgccgtctgccttgcaccaaccaatcccagggatgacttccaggttatttccgttgcatacaattccatctcaaattcttaacaccgatagatcaactccatcgtgatcttgtctaactattctaatcatgttcaaatccgatttgcagcactgggtgaaggacatgaggcacagcacgagcatcaaggacgaggaaggctacccggcgttcgcgctggtgaacaaggccaccggggaagccatcaagcactccctcggacagagccaccctgtatgtacatacatacatacatacatcttcttcattagataattaattcagtctgtttcatatatgtcaaaaaatcagtcaacgtagtggttggagcgtcgtagtagtagcaatcaacgcttacgatttctggaatggcgtcacatgatgtgaatttgtcgcaaaaccactactacactagtagttgatgatctgacacgttcgtctgcacgcaggttaggctggtgccatacaacccggagtacctggacgagtcggtgctgtggacggagagcaaggacgtcggccatggcttccgctgcgtccgcatggtgaacaacatctacctcaactttgacgccttccatggcgacaaggaccacggcggcgtccacgacggcaccaccgtcgtgctctgggagtggtgtaagggcgacaaccagcgctggaagatcctcccctggtgtaagtaattatcaccgatatatagcttaattagtcagaatctttcaactgacattgtttggttttgttccttctgacgcagaaatcgagagaccgtcaacaaaagcatcgatcgatccgtcacctgtgcttgcatttggcactgttcgagttcgaccatgcatgcatgtcgtgttactgttgcgtgtcctgtgtttatgtcactgcagaataaatcagggtctcgctgtcagcagagatcagatgaccccctccctgctatttggtgtggatccatgcgtatatgcgcatcttttgtacgaagttctactagttcatgtcatgagatgcctgtctactctgcccagtttgcttctggcgagatgagtactgctccggtttgatactctactacagtactatgcggttgatctatgtttggtacatctgcttcgacgactcaattatgacaaatggttaatcccaatgacaccacacctaatacccgcgattaattccgctagctataaaaggccgtgagtaattaagtcaacactgaagattattgtcatattattgcacagagcaggtttgttaagatcgttgtgatcataaaattaaatcaaaatttccgtgtaacaacgccgctcttcgcgccttcctcaccagctgctccaggccactccctcctgcgctcctcccgccgcctttgccgctgccgcctctcgccgccaaggcggtggaggttgtgccgaagtgcagtgagcgtatcgctgctaagatggcacttgaggcgcttgaggggccgatccacgcagtgtcgcgcgcccagcgcaacctgatgcggaagctcggcctagttccggagaggggcccggtcacggccgaggcgatcgcggcttacaacgccctcttctccaagccactttcccaggagcacatcatcgcgctctcctcgctcttctccggctccttgcccccgggcaaggctgcggaggcgttggtcgtgtgcggctgatcggtttcttctcttctactctcggtgtggtccccctcaatgggatcatgcaatgagaacgttttggtgtggaacgtgcgaggtctgaactcgcgtgcccgcccggatgctgtgcgtgatgtagtccgtgatgagcatgtctctcttctctgtcttcaggagactattatggatgtaatcccctctcgtactattctggaaatgctaggcctcgactttgattattccttcttgtctgcggtcggtcggagtggggggtgttgcttgcctggcggacgactgtctggtctgtctcagatgttcaccttgcggatttctctcttaccgcgttggttcgacactcttctgatgtcgccccctggtggctctccatcgtctatgggccacaggaggagccttacaaacttcgtttcttagatgagcttcgttcgctgcgctcctctcgcacggggccgtgggccgtcgtaggcgatttcaacctcattctcgaagctcgggataaaaacaaccttaatctcaatcgtcgtatgatgggtcgttttcgtcgactcgtcgacgagttggaactccaggagctgctgcttcacggacgtcgcttcacttggagcaatgagcgcgagtcgcctacgcttgttaagctcgaccgcgtcctcttctctgcggattgggaggagcttttcccctcttgcctcctccaagcggcctcttctatcacctctgatcactgtgctcttctccttcatacctgcgtcacctccccgaaagcgcatcgttttcgttttgaggccttttggcccaagttcgacggctttcttcaagtcgtgcaggacgcctggcatccccctaccaacctaccccctcttgctgctcttccctggtgcttctctaccacggccaagcgcttacagagctggagtgaacatcacattggcagtgttcgtctgcagcttcagatggcgaaggaacttgtcttccggcttgatgttgcgcaggagagtcggtctctttcccccttggagacctggctgtggcgagatttaaagttgaagtgtcttggtcttgcctcgcttgagcgtactatcgcgcgtcaacgttcacgtttggtctggcttaaggagggtgacgccaataccaagttcttccacctgcacgccagagctcgtaggcggaagaacttcatcacgcgccttcgtgatggtgaccagcttgtcgtctcccatgatgcgctgcaagagcttgcctcctctcacttttgcgccatcttggggacgagcttcgagcgtgaactcgccctagacctccactctcttggcctccgccctgcgcagcttgaggggctggactgtcccttcacagaggatgaggtctgggcggtgatcaagtccttgccctctgataaggcgcccagtcctgacggttttacgggccgtttctacaagtcttgctggccggtgatcaaggtcgaaattctggcggcccttaactccttgttcctgaccaacggccaaggttttgcttccctcaacgacgccctaatctccctcttgccgaagaaggacgaggctgttgatgttaaggatttcaggccgattagcattattcacagctttgggaagctgttctccaagatcttggcctctcgtctctcccctcgcctggacgagcttgtggcgcctaaccagagcgctttcatcaagggccgctctctccatgacaacttccgctatgtccagattgaggcaagggcgctccacgccaaacgcgttccccgacttcttctcaaggtggatatcgcgaaggcctttgacatggtcagctagcctttcttgcttgaggtgctagcccagcttggcttcagtcaacgttggcgtgattggatctccctcattctcagtgcctcctcttcccgggtactggttaatggggtgccaggtccatggttcccccatcggagaggtctttgccaaggagatcctctttcccccatgcttttcattctagtcatggatgtgctcaatgcgatgctccgcaaagcctctgattcgggtggttttcttcccctcaatgaccgtgctattcgacatcgtgcatccctctacgccgatgatctagttctcttcctttcccccgttcggcaagaccttgagttcatccaaggcatcctctctgtcttcggtgccgcttccgggcttcggaccaacttcaccaagtgctcggttactccgatccgctgctcggttcttgacctggagctggttcagtcctcttttccttgctcgatctcggagtttccctgcacctacctcggcattccactgtcagttcgcaagctgccaaaagcggccctgcaactgcttgtggataaagtctcccatcggctccccccctggaagggccgtctaaccactctggcgggtcgctcggttctagtctagtcggttctccgtttctatggcgatcggcttgccaagctgggttatcaaagccattgacaagaagcgtcgcgccttcttgtggatgggtacagactcggccaatgggggacagtgccgggtgtcctggacgagggtttgtcgtcctagggatctcggtggactgggcattccggatctcagggtggctggctttgccttgagagttcgctggctctggcttcagcgctcgggacacccctactggtctgatctgaaggcccctattgagtggagtgtctccgacatgttcgcagcatccaccttctctatcctgggagatggtcagtccacgctcttctggactgatcggtggatcgatggtcgctcgatagcttctatagctcctgacctcctccacgccgtgcctccacgcttccggggatcgcgcacagttactgctgggttaccgacaactcctgggttggtgacatacgtggcgccctcactgtcccagtcatctctcagttcctgttagtctgggacgcggtgcttcctacccagctctcgccgggtgttgaggatcacctcgtctggcgttggacgggtgaccagtgctactcagcgcgatcggcgtatcaggcgttcttccttggccaacactcttttgcctgtgccgacttactctggcacgcgaagggccctgctaaatgcaagttcttcctttggtttgcatttcagcagcgctgttggactgccgatcttctccaaaagcgtggtatcgatagccactctgcttgccccttttgtgctcaggagcttgagacagcgaaccacatcctcattgattgcgtgttcgctcggcaggtctggctccgtgtgttgtcccctcctggctgggctgccctctctccccctcgtggcagttggctccaggattggtggtcatcctccagggtatatttacctgagcacctccgcagcggcttcgactccttggtactcctagtctcctggcagctgtggaaggaacgaaactccagggttttcgactctgtgctcgcttcggttgcagtggttctggagtccatccgctcggagggccagctgtggtctttagctagtgttactttttttggggttttcttggaaatgtagcgtggctctgccccctcccgctgtttggagttgtgtttttaaccgtcgtagtagttcctagcttcaagtccccccccccttttaggcataagccagtctggctgattgttttgtgtaacaaaaactcttttcctgctaatatactgacgtgcaatccttttgcgcgttcgcaaaaaaatttccgtgtaaggccataatcataaaattgtatatatacataaaaattgtaaaaatcgtaaaatcagctaactaaatttttataacagaatcgagatttcagattaagggcttgcaaaagtccgagtctaatgttgttgttaagaactactactcctaaggactagagacttctaggttgccatcaagtcagcccatcgtcagtactctgcaggtacactaccgtttgttcgcatgccgatgggtccaattcaattcttatcttggaaaaatgcagattggtctaactcttaactcccaagcgtccaagtcttacatcacggacgaaattaacaatgtagtgctgttttttcaacaaggccgaacagctaaacatgaagaaaaaaaatgatgaactgctcgtcctcttatatataggattggcaatgcacttttgggtgtgagatgcacacgcaacacaatcagatttagtcaaagagcagttgagcaaacctacgttaattatctccatatgtgcaccaaaaaccgtccaaactaagcaaacagtttggattgagaagctgatgtatcaagtacagacgaacaatctgcatcttctctttggaagagtagactagtactagagtatagacggagacaagaagcaaggttccaaacgggccaaaattagtgaaaagtgtaatagggcccatatgtatcaaggggtgggcatttggtcagattgaaaattttgatcttgatatcttgatatcctgtcttttttcggttagttcggttattgaaaagagactggacaatagtagaaatttatcaagaccaccaaatttggtctcgatcttgatcatgattaaaataatcaggagataaattaagaaaatcacaagaaaattatccaaaataaaaaaaatcagagtggatgggggctggggaggccaggttgcaatcttcgtcgatagcccctcaaccaaccaccgactattgcatgtgccctcctgctccgccgccatctccaccttgtgcccaaatcaagaaaactgctagagggaaggggatgacggcttgatgtatcgtctttgttggagtcgaggagtagccgccggtacgtgcaggagtggacagagaggttgaggggaggccagctgtatgtcgccatcgttggagtcgaggcgccactgccagcatgagcaagaaaggaggtctgagtagaggactggaggggagtcggaggtaggctatacaatggcggtgtggtgcgaggaggaggcgcgagcacaacgcgatggtgctgaggcgattcttgttgggcggagggggaggggggcgctggcttggtcaacacgcgaaggcaagaagaagcgggtgacggcgacgcaacaaccaaaaggccggggtggcagggtgggtggtgtggatgtggggtttgttgggacttggaggggtggaaaattagagtttctctatcgggcttagtgggcttatagggcttagaaggtatttcggttgattcggtcaaccgaagcccatgaccgaacaaaatttggttagttcagtatagataccgaaattctcggtcttggtatggtcagtttagcttggtctttggtttcagttttttcttgcttacccctaaatacatccattttttccgaacaaatatggcccaagttttgttattggacctccacttcgtaatatgaatggcccacctattagctgtacatgacgacgatgatccaaacattcagtacgtgaatttcaccagcccaaaacatccttcctcaagagaaaatgaaggcatcattgaagctgctttttttttctttgctaaacacatgctcacagcctccgtgcacccacaaacatcctacctttacagactgtgccaatataaagcacacccaaagattgtgccaatataaaaaagcactcacggtctccttgttgatgaatacgtcgtctacaaaaaaaaaaaaagagtctacctgtagcgctatcgatcgattttaaacaaaaaaactatcgatgtaactcgggtgtaattacagcctagttatactgtgactacactataagtagtacttcctccatttataatgtatgacgtcgttgacttttcataacatttgatcgttcatcttattcaaaatgattatataaatattattgtttattgtgatttgttttatcatcaaataaaatataatcttaccttatacttttacatattattttttaataagattaaatgttataaaaaaatcaaaggcgctatacattttgaaaagaaggtagtatgtaattgagttcaaaactttaaaacacaaggcaacacggtgccatgcgaatggaaaggtcaaggtatccatttccgttctaattttaaaaataattaaccataaatagtactcccttcatcccaaatagattaaccataaatagtatgtttatacaccaagaacaagaataatttaaatcgcatcaataaagacaccatacacatattctttcacaatacatgcatcgattaaaataccatgccaattacatttttagcatgcacacattctctcttgctacattagttgtattccgatgaaattcgtgtccatgcgcacggttatatgatgattaatttaagaaattttaaattttattatatgataaacaatatgggaaggagggagtaatatatattagtaaccctttgcgaaaacaacattttttcttaaaccgagcccctgctaaaatgcttttgagctagggattgttgatccacatccacatggcacttcatgagataagcacccttgttttcgattatgacgagggagatatcatagagtaatacttttctcgtctaaaaaacttaacctagaagaggttacatcctaagacaataaatctgaactagaagagatcagtaggttgagttttttttaagggtggagggagtatacgagcagggtggcaaaacgtgtgcctacctgagctaaacccacacacccatgatccatccagtccagataaacccagccaagcttagctaacagattagattagcctttttattttctgttgaaatcgtcaaggttggtttgtggagtactatactagctagacaggacaaaagtgttcacctaatcacaccaagacaataataaattcaccattaccaatttagcaaatgcaacatcatctgctccaacgtccacaaactccacaggacaacctacacatagcaattactactcctaattgtaaggtgagtttaaggacaggcttcacctactcctctaaagttatcactggttatttataagctctctacaaaagatctatgtcagtatattttcctacttagaaggtattaaatgaagagagagagtaaagctatctactaacttagagataatctatagagaaaaacgaggcaatgcatgagagagctatagatacaaatgtagacatactattaaggtggtttactattaatcgagtctattgctgagatgtatatgttttatagagagtaccttattttaccattgcgggagctataagggtagaacggttgaaacaacggtactatactactacaaaccagcaacgcgttgctatctgcacagcactccaaatgttcgcgaaaacttgacttgttttcgtttgagaaagttaaagagtcgaaacttttcatcctgacaagttgagagagtagtacgtgacaacaaaaatcaaagggagatgcatgtagctaacccgttttctgcctgctgcattgttgttaagcacaacaacaaagcttaagcctgtaaaagcattgcaaaaggcaggcgacgcgtcgattaattaggtgttgaaatctggaacgttcttggccatacaggcgctgcgtggccgtgatatagagcagcttgccgggtaaaaagattattctcttatcagttaacaacttttttaccacctttcatgcatcatgcatcattcaggtcagattagatgtgctcattggaaacggacagggatgatcgaaccatccatccatgggcgatccatggtgattcagaaaagtaaaactgcctttgtttcttgtgtagcacagggatgcaaacgtacaaaacgaccgtcacaagggtcatctctagctggaatcacatctcttagcttgttttatggatttgcgtcaggtgcacgcttcaatcctgggccacggcatgcatttcgatcacctcgtccttcgtggcgacatacctttcgattttggggaaaacaatggtcgaaattcccggacaatggaaagcgagcaagcagcatctctctttgttcttttcttaagcaaagattgtttttttccccttaatttttatttcgggtgaaagagtttatgcttttctgaaaaagaaagtgttgttttacaagttggaagggatccacattctctatcataatggcagcactaccattacaagcactgacgtgtggaacaataggagtatatgacccacatacctgtcacggtaatggtagtgatattatgttatccggttgtaagaaatcaggctgctccaaaaatactcaatgaagttggtgtactgctctagtcttccactgagtaagtagagcaattaactgtgcaccagtaatcaaatctttgcatttactcgcacatttagtaatgcaaatctcagcacaatgaattactggtactagcatccaagtcaagttcatggaaccgaatctgagagtacattaaacaccaaagatatatcatatcatatcaaatattcaaatcaaacggctagaatgcaaaacatacacgcacgcatgtcacgcgtttgagccagtcgaggaccaccggtgggcccagctgtcagcgaacgtgggagttggcacaggagagcgcgtcatcgagccgagccgatcgatcagtgggtgagggtgagagtggccggccttggccttctataaaacgtggcacctctcgctcctcctcgcatcatcgctcgcagtcgcagcacaaaaacatttctctcgcgagtcgcgagttgcaccgatcgaattaagggtcgaagatgtttgggttcgggcaccaccacaaccaggcaccggcggcgccgtcggacccgaaccagatcttcaagatcttctgccgcgccaacgagaactactgcctcaccgtccgcgacagcgccgtcgtcctcgcccccgtcaaccccaaggacgagcaccaggtcaggtcccccttcttatatatgccttttcttttgtttctatattcgatcggattttgatgtatactgaaatggaatgaattgaaatgcagcactggttcaaggacatgaggttcagcaccaaggtgaaggacggggagggcatgccggcgttcgccctcgtcaacaaggccaccggactcgccgtcaagcactccctcggccagtcccaccccgtaatactatatttctattttgctgctagctttgtgcgtgctgccatggaagatcgaagaacgttgacttcgatgtcatggactcatggcgggtgatgggtgtgcaggtgaagcttgtgccgttcaacccggagtacgaggacgcgtcggtgctgtggacggagagcaaggacgtcggcaagggcttccgctgcatccgcatggtcaacaacacccgcctcaacttggacgccttccacggcgacaaggaccacggcggcgtccgcgacggcaccaccgtcgtgctctgggagtggtgcaagggcgacaaccagagctggaagatcctcccctggggccccgaggctcactcctcctcccccggcgccgccaccgcctgcaccatcggcggcgtccccgtccacaccgtccgcgtcttctccgccgcaggcgaggactactgcctcaccgtccgcaacggcaccgcctgcctcgcccccaagaaccccagggacgactaccaggtacgtattctcctcttaattatatactactattcagatagagaaaaaccttgagagatttgtggttgtggtttgtagcactggatcaaggacatgaggcacagcaacaagatcagggacgaggaaggctacccggcgttcgcgctggtcaacaaggtcaccggcgaagccatcaagcactccaccggacagggccacccggtgagcaaatcttttcttacaaaataaatattttcttacatatgcaacgaatctctgaatcacaacgaacgattttctctgcgcatgcaggtgaagctggttccctacaacccagagtaccaggacgagtctgtgctgtggacggagagcaaggatgtgggcaagggcttccgctgcatccgcatggtgaacaacatctacctcaacttcgacgccttccatggcgacaaggatcacggcggcatccacgatggcaccgagatcgtgctgtggaagtggtgcgagggtgacaaccagcgctggaagatcctcccctggtgtaagttccaccgctaacaatgcacaatgccatcgctgatcgattaatttccttcggatcctctgaagaaatcagagattctgacacttggattgctgcttctttgcatctgcagagattccggggagggggagctgcattgcattgccatcgtcgtcgcgtctgctctgcttctactctagctaataatttgatcgatctgctaccgaaataagaccgtgttcgttcgttcgatcgatcggagtatggcagtcaatggtgtccgtccgtcctcgagtttgtgtcagtgtgtgtccttttgcgagccagtgattgctatgagatgaaacagtgggtgatgtaagtgcaggaggaggggccatatgattcagaaatctgatgcaactcatcttgctttcccctgtactctctacttttcgtatgcctaatgaatgaattatgaatggctcatttgtctcgaccctgttgtttccccttcttctgtttgtgacgtgtaattttgctgaaaaaaaaggcgtggtactggaacacgttctccaagtcataatgatgaaacaaaatgctttgaatttgggtaggacgaaacccgatttcgtcgaactcgaaaagcagagaggcgtccaaggcgtcgatctcgtgaaggggttcggatttttattcacccggacgaaccccttctggccgtcgcgaaccgttggattggaacgggcggctagggctaggccacggaggaggacacacgatcgaagagcaccaagcgcaggaggccggcaaggcagtcctggttgggctttagtgcactgggctgcatcatggcccatacgtacaaacagtgcaggtagccacaaaaagaaaagagttcacattagatacctcaagtaatgggtatagagcgtcccctactatcaaaacattgtatatcgagtcccgcggtggtttagacggcagttgtatcatatgtggaaaaaatattgacctagtcttcacctgataagtcacttacatgtaattacaatcagcggaaaaaaacaaaaaaacatatgaagaataggatccacatgtctgatttaaaaaaaatcattggtcccagatgttataatctcgggtctgttcactttaatatcataccatttttggtaaagttgccaaaaaatatgtctatgtttagtttgttgccaaatttgatcacaaatcctgctaaaattgtagcaatattgtcatcttgccaatattttggcactgccaaaacttggtaacgtttattttggctacaatctaaacatgtccctcctccttcctcattcctcactctccaccttacgcctttggtcgatgggtcgcagagaccccaacctagccaatgaaccatagtgttacgctaaagcatgcccacatgcccacaaacgagccatagtgcccgtccgagagagagagagagagagagcggggggatagggagaggagaggagaggagaggtggaggtgtgaagggagaagatgagtcccaccttttttttccttaccggatgcaacttaaccatagtggaaaaaaccggaccgtagatgacccagtcacccttctggttcaccggtctcggacagtttgaccatgacccagccgatcgaaccgagtttactaagtgcatgcatgtaacgtatgtatt

SEQ ID NO: 20755 - DNA, 4522 bp, Oryza sativa
  unsure (1)..(4522): unsure at all n locations
tgacaccgttgactttttagcacatgtttgaccgttcgtcttattcaaaaaaattatgaaatatgtaaaactatatgtgtacatgagagtatatttaacaataaatcaaatgatatgaaaagaataaataattacttaatttttttaaataagacgaatgatcaaacacgtactaaaaagtcaacggtgtcaaacattttgaaacggagagagtacatccgattggtaggatggccacgggagttgccatgcatcccattgaccagggatgaaccggccatcgtgtggcccattcattcattgacttgccttagtccggctggaccaaaggcggtttattgcccggttcatcacaaaaccggccgccaacctctggttccgatttttttccggttaaactgtcagtccgttccagttttttttccactatgcaattaacgccatgttgtagaaaaccaccgtacaacttgccaataaggtagcttccttcttctttcttttttttttttgagaactaggttagcttccttctagagctccttgtacgacctcgttggaaaactcattgttggacctaattcatcactctttttatttcaaactaaagggtttcctttttagacttttctaattgttccaaactaatagaggtggcatcaatcaaatttgctctttcttgtcctatctaagagtatcttgatgaaactcttatctttatcgactttcgtaatcaaaattttagttttttcaagctgctcaatggtcactttacgacatgattagtgttatgctcggtattattgtagttgagggagaataagtgtaacttccgttcatgatcggcccgttaagaatttagacccattagtcccacccccaactcccttttcttttcttcctttttggccaaattttcaaatttctggtggatacactgcacgcccggggaattttctgtcgaaaaattgtataggtaatccctaataaatttctaaatgtgcttggctgattccttttcttctcgatcgatcccgttattcctttttaatcttttcttgtgcggaattgcagcactttttctctgcttgatcacaacgcagcaaggacatgagaatacgtgagattctccgggcgatggagctgcaccgtgtgctttgctatcgtctcgcgtcgcgctcgcctgcaataatacggcagccagatcgagatggttcccaaaacgactagaaacggaatcacgtaaagcaccatggatggatggaatcaccttttccccaggaaagcgcaagtgtggaatggcatcatctatcctaccaagttcctaagcccctgaccatgcagtgcacgaataatgcacatcgatcagctatctagagagagagagagagagagagagagagatagatagcatctcgatcagtgctactgatcaatcgatcatcccctataaatcccccatcccattgccatgcatagaggcagcacatcaacgatcgaacgaacaacgcactctgcagctagctatacaatctctgtttaattagctaggtagctagcgagtcataaatcaagaagccatggacttttacgggcggcgcgagcagtacggcgggtatggcgggtacggtggcggcggcgccctggcgacgccggggtacgcgccggcggcgccgtacgggatgtcgcaggtgaacatcgaggggaacgggtgtggcaggacgctgccgccgcagccgacggtgaaggtgtactgccgggcgaacccgaactacgcgatgacggcgcggaacggcgcggtggtgctggcgccggcgaaccccaaggacgagtaccagcattggatcaaggacatgaggtggagcaccagcatcaaggacgaggagggctaccctgccttcgccctcgtcaacaaggccaccggccaggccatcaagcactccctcggccagtcacaccctgtaagctagtctcagcgttctttctctgaatctgaatccgccggccattgatggcgatcgacgacgatgctcttgcgtgcaggtgaggctggtgccgtacaacccggaggtgatggacgagtcggtgctgtggacggagagccgcgacgtggggaacgggttcaggtgcatccgcatggtgaacaacatctacctcaacttcgacgccttccacggcgacaagtaccacggcggcgtccgcgacggcaccgacatcgtgctctggaagtggtgcgagggcgacaaccagcgctggaagatccagccctactactgagctgatcgatacatcgatccagctctctatcaaggctcaagttgatatcaacgaatctggtgcagaataattattctctgctagctacccacctatatacgtagctaagagtaacttatgctcgtccgtaccgtatgattatcgtgtggtgtgcttgtatcttgtacaagttaattaattacctggcaataagagctcctctcgctgggcgacacatatataaacacatacagttggggcttgattcaacttgcatatatgctgtgcatatgcgcacgaatttttcaggtcatcggactacgcacactatttttagaaacattaatttcaaaaacagcgctagatagaaattccggatttcaactaaagaaatgttaatggatggcaagcaggctttaacaggccatatgggctgtgacgtcggaccgttccatattggaataagttcacttaccgtcccacataccttatttcttctattttttttctcttttcttatctttcttctcttctcttctcctttcctctccaatcttctcgatgcacagccggcagcagatggcacggctgtcgccactccgctccgccggccgcgtgctcacccgccttctccggtcactcgccgccggggttacttattccttccgaattactcgtgttgtgttaacgggctattcttggaggatgtgtggtccaagaccagcccggggttgctgattgttaatgggcccgccaagctctacgatagaacattcatggtcctctgttgggccatcacctagtaacaggccccactttgggccgtcagttgttatctctgttcgatattgggctgtaactgggacaaatcgcatccgaggaaagaagcggagtgtccttctgttcagcgtctctcctctcctcaagacacgatcgccgccgcccgccggagagaaggccggccggttcgacttcgacgcggcacaagttcgccaccagttccgtccatcccaattgaaattcaggccctccctcctctcatcttgtccttccatcttttcatcatttccaaccgtgtgaggttagtggtaactggtaagatccatgaaaatctgcaaattttgtgcttcccacccaatttatcgatcttattttttgtgttatgtacttgtgatttatccattcttctggtagttatcacacctcagatatttttcaagtcagttcatggatgatccagacactttgaggaaaaagacgacgacgattgtgccacaagttaaagacggccaaaagcgtcagctgcatgactgcatcagaaattgacaatgcccttgcgaattggatagctcttcttcatcttcatcttcatccaggttgctccccttctgttgtgtctagatatttttttcgatgctgaactactcttttcaatcgctgttcttttcccaacctgacgtgtcaagttctgtagttgagtttccaaactctctgtcaagacatggcttttctttaccaatccgaattgtccagttctgcaattcacttccaaattcaaccctatcaggattttaccgttttgttctgatggtaaacaagtgtatagctgattcctgcgtaacaatatccgtaacgactctatccgtctgtacaagacaaagatgacaccctcatgtgagtgcagtgacaaggacctactacagccatgcgttaccttccaactcgcaatattgagcccactacgccgttgcctactcttccatgacaaaagaatcatgctctaccttacccatgatctctcaataatactacaaattggcaccgctgtacccaattgatggaacagaacaatcaacaatgcaattcgtattgctctcattttgattaggcagcagtaaccttcttcctgaatcatgacatggtgtaaagcagcatccagatccaagtaccgacattttcgacacaaccaagtacactcattcagaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20756 - DNA, 370 bp, Oryza sativa
ttaccggtgcaagaagtgttcgaatagccatgcacgaagaaccgaaacagcacgctctggtagccctctttgcgggcgccatatgttgtgaggttggctaaacgaattcacattgtttccccttagtaggccagcgccgccgcccataagcccaaagtttgttgtgtcttccttgccgagaccatcttttgtagcacccttgcccgtattgcgcagctggttcagtataatgcccttcaaatacttgaaatgcttcgacattgtcctaagagccatggaagcaaaaggagcagcattgctcagacccgcaacagtctcaaaggacgatactacagcttggagttgctggtagtattgcctgtatcgcttg

SEQ ID NO: 20757 - DNA, 836 bp, Oryza sativa
aggacctgctcgccgtcgcacgcgtgccgccggccgtcgaccaggtgaagtgccacccggtgtgcaagcagaccaagctccgcaagttctgcacctccaaaggaatccacctctcagtatgttgctcagcactgcaaactaccgctccctttattctcagatactccctccgggattttggttgaataggatatcctatatacgtgtattatcaaacaaaaatctcttatattttgcgatggaggaagtaattaacattggcattatttaagcataaactttgaacctttttttacagaaagttttataaacatatgaaaatacactatattattgaagtatataagttataaatataaccatacaatttcatcacaatataatcatttgaaagcaatatgtggtcaatgtgagataacctcagtttactgtgtcagttattcatgaatgagtacatttataggggagtggattctaattcctcgatgggatgtcccctcgtatatttttttttcaaattcgatacaaatagtcgtaaaaaatatgaaaaaaaataactatgttgagtattgtgatatctatctgtcaaaaaaaattaaattcgacttacacatcgagaaataaaaaagacaaattcagatgtgaacagtacactactattcatatgctgaatttatctttttatatctcgatgtgagtttggacctaagattttatggagttgtatagataggagtacatccattttttaataaaatgacacagttaacttttttataagcatttgatcatttgtcttattcgaatttttaatgcgaatataaaaaataagtcat

SEQ ID NO: 20758 - DNA, 7952 bp, Oryza sativa
aaattgggaatacctccctgatatcccccatgatttataggagctccaaaaacagaacctcccattctaccagtaaaattctctccttgagtaaacacagttggctcaggtcgagtggtgtcaacacctgggccactactgccccccatttgacaaaacagactcttctgattcattggtgcagagggtatcacaacgttgggttcgatttcaaaacgtacctcaggtgcagtggagggaaaaaccactccagtactcggcccagcagcgtcagtaccctgtcccgttgatcccttaactgctgtagtagcatctgctccttctccaccctgatctgccattttcttttgcttacagagttcacgcagcagctctttgatttccttgacctcccccttgagcgatttcagatttgttacctcctttttcagggtcaccatgtcagtcctgaactcgttcatctcttccaaatccaccatcgattcgctggagcgcgtcttcgtcatcttactctacaggattggtttggaacaagttcctccccactagatcctatcagagatgggtttaccaccgccaattcttagttgcgagctccggagatttcataggggcacacaccttggtggctcccaaacccttgctcgagcaaccaagaacaccaccacgcctccggattgattctgcccgggttcaggaattttacgatggatctcaccgccgccttccaccaaccctcaccggacaagatcaagagccaagaatcgtgcttgctctgatacctctgtcaagaccctgagtgcgaaatggaagaaacaagggaaaacagagcagcgattttagggttctaagctactttagctaatcctaagacaaagtaaattgtagtttgcgttctgttcttctccagggccaaaggcctccattagtagcttacaattcaagcattacatccagctgtaaaaacataaagacaagaaaagtagcatcaaaacagcatctgaagcgtgattcctgctaaaaatgaaaaatgacaactacagtggtccccaagtgatctcgtccatccgatctcccttttttttctccactgccgttggattcattacttcacttctgaatcgttctctgaacattctgaacttctctgaattcccttgtctgaatttggtccagaattccatttccctcctatgctcctgacagggggttcgacgccgacgccgcgctccctcctggccgacgacctcaccgcgcggctgcgggcagggcagaggctgggcgaggaggccccgcacaagcgcagcggccgcgaccgctacgtgtgctccgggacagcgtgcaaccgccgcagcaggccctcaagcacggcgccaaggcctactacgacggcccggcctagttcttctgttcagctggatttggtttactactccgtccaggttcataatccttgatgttttagataatgatatggcctctaaaatatatctttgatgacgattttgttttatattatgtaaagagttgaataaatatataattttattaaaaatactttttaatactaaattatacatcatgctatagtatcttcaaactaaatattttaaaaattgtaattgtctgaccttattcaaaaggtcaagaacctatggaaccagaggtttcattaattctcatttctaagataattttaatgaacgtattgtgcttgggtagattgaagcccaatgttaagattgcagcatgaactagattgaagaactaagattctataggatacaattttaacactttcctctctcttttttttggcaaccatgcatgtatatatacgtgctttgtacatgtacacactttttttattgccatattcctcgatggcactatacacaactctcaactttccactctaattatggtgcagagatctccttgggagaacttgcacccatgcatcatttctgcacattttcacaaatcacaatctaaaaagaaaagaaatagaaaaaaaacagtaacatatactgcaacttatgctagtataatattcacagttgctcaatctgcatgcataccacaattaatctaccaacctccattcctaccacctaagcaagtcttcacttgctttgcttccatttgagttgcttaatttcttctgttgccagttgccaccttgcacttccatcaccatgatatgattcatggtgttgcggtcgccggccgacggtgatgcaccgtgcaccgcagcggggaccgacgcggcgccaccgcgtcggaatcagccgtcgtcgcctgagagaagaggacgctcatcgccgcctgctgctgctgctggtaccgaccggagtcgccggggaggcggaaataggacgacggcgacggctcgtcgaagaagaggtcaccgacggagacctgcccttctttcctgtactgcacgatggccttgtagatgaacgggatgaagccttccatgatcagaatcttcagaagctctgtactgaaattttcagaaagagagtttaatttgctggcttcagagagatggagagaagttgttaggacacttgagagagaggttttctttgggtggcaatggaaggtgatgtgggcttaaaaagggagggaaagaagcctgaactggatagagaccaaaatggagtacttgtcaaggatctaactgaaactactagtattatagctaggcaatatgctaatgcaattattaattttcctcttgacagacttgagcttaactctgaattaaatgtgtcatgttcagagacacagggatggctttcaggttttatcttgttaataaatagggtttgtgcactgggatatttcctgcaaaaaagaggccaagacttgaacgcaatgggtgtttcagtcttagaaggcgagttttacaggtggacagtgatgtggtgagtgcagggatttctttttctcaaatttaacccttggaagcatgcatatatgggttacctgctacaaaagaaaagaaagctccctctttcagatcatgattgagcatcaagatgaagttttttttttaatctcatgttttccggtggcgtaatcggttggaaaacaagaattttcgcttcgacttgcgtcactccagccgactctgccaggttaagccaaggcaatcaatcaattcaggtgatgacttctgaatcacttgtttttgagttgttgcataccaaggatgattagagtaaagaaaaatttgcagttcgtgtggctaagagagaagaatggaaggacgactgcagaattgaccagcttaaagtaagaggataggttttgtactcttgtttatttgatcgtctggaagacggaagatgccgatcagacgacagttcatacggatggatatttcatcggctgccagttgtgctgtgtcagcaacaagctgatttatcttttacctggatagctgcatctgagaagctagatggcattttaaaattggcactgatgtgtttgtcccaactaactgtatttagattgggatcaagagaccacagaattcagctaggttcacaatttcggttcaaaattcccgaaacattgggtctacctgaatttgtttagctttagaaaataaaaatggttcaaattcagtgaaaacctattcaatcttttttatactgaaaaaaacagattcttctgaaaatttagaatttcaaaactattttgcattcctaggttctgagccctgagttcagctaaaaccggatatgcccgtcgtttgtaaaaccccaggcttgagatttcgcatcaagattgcatacggccgctttctttgatatccagcatactgtgcctgaaacagttatctccacaatccacatgccgttatctgatctaccaacttaggacttaagagcgacagtttcgcgagtagtaggaatgattatcccgtgggtgatccgttggtggacaaggtttttctgttggcgctgccggaaaatgcagatagttggtactttttggcggtcgaactcgacgtcgactcggcaccaaaaacgggaggacgaactgaggaagttgcatcctaggcgacttgcagatatattttttaggctctataggctttaccaggacgccggatactgcctgttggatgttggctgatggatggaggatggaagaaacagttatgtaacagatacatgaaacggactgcaggtgtgaaacagttatcccagtctaacggcgacaaagggctcatctgggatgaagccaaggaaaggcactagtgtactattcacttcatccagaagtcacgtgtttattttatcgttcagatcaataagaaattactccctccgttccttaatataatggatttttgacattttacttacactgtttgaccaaaaataaaaagttgtgcttaaagtactttggataataaagtaagtcacaaataaaataaataataattctaattttttaaaataagacgaatggtcaaacagtgcaagcaaaatatcaaaatcccttatattaggggacggagggagtaacttatttcacatacaacaaaaccaagcattgtatgtctgtacgcatgtatgcaactagcgagtattaactattaagatgactaaatctggttaacaatttaatctatcattacacaacctgaacctcttcatttaagtatttgatagaagaagactacaaatataactatctgatttgtaaaaccaggaaataaaatatgcttaaaacttttgtatggagagagtactctctactgcattagaaaataaggcaagcatgaccacatagggatggagcaaggttcacaaaaccaaagaaaactattcaatattctacaagtttaaggttttgatctagcttgagttgacaaaccgtttaaattcaaaaaattagactgatttttatttctttttggcaatttgtgtaggagttttcatgagaaatgataaaaaccacttaggagcggttttcaatcagtggatgattttgtgaacactaggattgcacaaaggaggcattgcggaaccaagagctctaaaggcttccccttttagtgcccctttgaatcttagaataaaaaaacggaggaataagaaaaacacatgatcctgacagaaatgtaatggtaaaacagaggattgcaagacacaggaatgatcgtttgattggagcgcaggaaaaacatagaaatcgaataagagagatagacttaaaagttttttttttccaaaaggttagacctcctactaaatttcctccaaaacctatatgcaatgagccattccataagaattttatataatttgaaaaacttcaatcctttgaatcaaatgactacatagaaaaatttcctatagaatttcaatcctataaaattctttcataattcctttgaatcaaaggagcccttaaagtctcctatggagtttttttcattcgtaggagtctgcaaaccgcaaatttaagatgcagctctgcatacaatagttcatagatgatcaaaaaggcctctttcaaaattgctcaaaggaaaaggctatacatagagaaatttaattgcgaaactcttacagcactaaagtagcatgctatgagtaaatctatatttcttgtagctcctatttagttaaatcaaatggttgaattttctttataagaatttatttgtttataagactttattaagtacgtagagcagtgttcgtgttaaataaaataaaataaagggcctatgttgaatgaaatgctttttcatgttctactgaaagaggaacacatggcgtttgtttaactccactttgatttggtagtttgtatttgttagacaactgtccatatataaaacaaaaaaaagggaaaatcaacgtcaagcataacaactcctaactatatatctctgggagtcaacatgaagcactgtgtagtttctactatgttagttgcttttgtaaccgttttatgtacaacaacagagcatcatacattcaccctagcgttcaacaaggtctacagaggttattacttctagttgctactctttgcatatgcacagcaacacaagcttgtttacattgcattgtaaaaagacaatgaaaagaatgatattgcaagcactgccatgtatgcgcattggggcagtcgggcagcatggacagacagacctcaaacctaccaaattcctaggagaaccgaaagcatgcatcttcaatctttcatcaggtaggatattccgcgagaaccaacgtgtgccaccaaccgcatgaaacgtttagcgggttgtacgcttccacgggcacttggcatggtacgtttctgtctgttgagtcgcccaaaccaagctgttggcacaattaaaagtttcagacatggttcgatgagttccattgacagatttggacaaagagcagaaggcctacctgaccgtacttgttccaaccccagcagaagacatctcctttatctgcaaaaaaaaaaaaaaattcctgttaaattacagtgtgcaaaccatttgagtacaaattgaacctttggaaataaatgtatgggaccttaagggtacaacgttcatagtacaacacaaaatgctggatgaagcacattccaagagagagcaaaactctatcaattgaaggaaatgcagaatagagccaggagtgtacctgttatgactgcactgtgtcgggctccacacgaaacacctcttgcatgattattttccaatttcgaggcttctaccaactttggaacaatctgcataagattgatggtcctggcattaattgatcatttttatttctaaaactagtatcaatgcagtatagatttttggaagtggaagagattgtcaacaggacaaatctacattatcctagtatgaggtgcctgaagattagaattctacctcagcttgatctgatccagttcccagctgcccaaactggttacctccaaaggaatatacatcaccatcagcagatgtacatacagtatgccatagcccagctgctacacgttgtatcttcactcccataatagccgaaacacacgttgggcttaaaatatcatccgtgttcccttgtccacactgaacaaaaggggatacaacagtgaataatgtttaaaaaaaatacaacagtgaataacgttgacaagaagctctacgggcaacagtacatactaaaaaacaagcttctccaccagattaacaaaatgcatatctgaacgcccccaatagtttgtacttagtactgttttaaaacactggttactgcaccagtcaaatgttttcatttccatgtgctagtccaaaggcccaacacattattatctcaactctttcagaacacgtgttactgcaccagtcaagtgtttctcgtttccatgtgaaggctcaacaggcccaacaagattattacttcgtatactggactgtattctctccaggctacccatttaattactagcagccgctgttgatgaaactaagcaacaccccacttaattccagcaacctttagtcgttcttaccgggtaaacctacactttttttttttgggggggggggggggggtacattgtctaaatagaacccttgtcaatacagttgatctggatgatgactctattcgtatggttggactggacctctcagcaaagttattacaaaacaggaggtggtttgtataaaaatatgaaaatcaaaatcaaacacaatttataaccagttcacatatttggtataccatgactaatggttgagctggcctagattacaggttttttttaatgcacaaaaggatattttacagtcacagaactcgcagcatgactctttacaaccaatcagttattataacaactatttcaatcaacataccaagcagaatagactaacagaaagtttaatgatttcataaaggtaaacg

SEQ ID NO: 20759 - DNA, 2344 bp, Oryza sativa
aaaaaaatggattctaaatttttaacacaactgaaaatgttcagggcccaaaacatcggcataatatatgaatgacgattgacattactttagtatgaataaaagagaaataaagaaaataagaggaacttgattcaaagaggttgagtacagtagagtctgacctgtcaccacagcactatgacggcctccacaggcaattgctttcacgcaagttgctgctctatcatttgttccttccaaagttctgctacccatcacaattcctgtacggtccttgctgtagaacgccgattgaacacaaggtatgggatgtggggaggaaactgtccggatcctagagcctaaacctagttgtccttccccaccatagccccaaccccagacctgaccaaaatctgaagctttggagaaaatatttcgctgatcagcatgcttacctaacctagttgagtgtgaagagaatacagcagtaaacgcccaatataagttacctgacagcactaatgtatgacggccacctgcagctacttccactatcttcactcctgtattaaatgtcacaacacaaggtggtgctgaaagattttcatcactagatgattcactttcagccccgtgtttcgatgaagataacctccgtcgctttgtgctatcctcagaacttcggctttcagcaggaccagatgctgccttggtgcttgtcctagacacctttgacctggggctcactgtaatcgagtttcctatattacctctgtaaacaacggatgtagaaaagcttatattttttatgtagaactgtaaagaaataagtagtaagcaccaccaccttggtcagtggcaaccccactttgccttttatcacaatccatagccccagttgcagaatggtctgcaatgacccttccagttggaacgcattctttccaaccccatgtgtagacatcacctttacctgcttgagtggaattcaatcagtgtaatgcaaagttatgtgcagttttcactaaaatgcatggatcaatacacaacctgttattgcaacacaatgtgcccatccagcgtcagcccttacaattgcaatatcactaggaagaggaaatgcctccggagtttcctgagaggaacaagatgtttacttcagtaacagtttataagtttatcaagaacacgttggaaacaaacaattagcccaaaggtacagagatacctcatgcttcccagcagtcacgtaactttgtcccatatcatcggtagagccccaagtgaagagttttccttgctctgcatcaggcagatacaagctgtgtcagtgtcaagctcagttgacgtacggagtaaaacgctaatagcacacaatccgaccaagcaaaaatgcaatcttctaatggttgacagaactacctaaaaacatagaataatccttggagtaatggagttgttatggaaaattagtctaactaaaagcaattccacaaaaatacactagctgacaatatcacataacacattcccacaacacaatacggggcaaaacagtgttctgatattctctgtcgctcgaccaaaaaaaaaagtcgaaatcactagctgcttgcactatcaatcacaacttagtcagacagcatattccaccctgatcaaccaccaatcaggaaaatagtcatacagcacattccaccctcatcaaccacctatccagaaaaaaaaatcggcaataactgaacacccggcactaagctgctcaccaatcaattcacagacaatcactcagattcttaagaccttttttatccaattttatactcgcgttttcatggaacccaccatatacacaaaaatccgcacaactaactactaaaccactgcacgctaatcatccccgataataaaaacctcacacaaaccacaccagcaccctactagatctcccacgaccctcttggtgccacagatcgaacgaactcgaacgcaacgataacatcaagcaatggaagcacaggaacgagagagaaaggcaacatcaccggagacggccatcgcgaagccgcacccgccgccggccacatccctccacgcatcaccggccgccgcggccgcgtccggcatcctcacgggcaccggccccagcagcggcgaccgctgctgcgacaccccgggcaggtacccccacatcagcaccacccgctccttcctcctccccgcgcctcccccatcctcctccatctcctccccctcccctccccctcctcctcctccattcatctcctcctcccaacccaaaccccccctctctccctcgatctcactctcgctctcgattctcctctcgatctctctc

SEQ ID NO: 20760 - DNA, 1807 bp, Oryza sativa
  unsure (1)..(1807): unsure at all n locations
gggggggttgtggtgggccaggagagtgacgtgtcggagtggcaccgcgtggggaccaccggggagtcgttgggagggtgggacccacgaagacgtggctggctgtgacagtagcacccgccaattttttaagtgtgggcatgttcggattaggacggtgatttggcttaaagaaatgttggacttgtatggttttgtaccctactaataagttgttagtgtcaaactctagtcaagttttggcgctactaatattttgataggtggaattgtaaatgtgtgtctttgaatttatgctaattgagagataaattttaaattatggtaaaaaatattctagtattatgccaaattaagtataagtattaccaaacatttgtcttcaaaccaaatcatcacatttactatttatactaaaaaaattggtatgataacactttggtatcaaaccaaaacgccccgttaagtatcagtgtatcacagtggctgcagctcacgtaaggggaaaaaaaagtataatcgctgatttaactctatgcctcttgactctcggtctctcgggtataagctacggagtacgagaggagctgatcctgctattacgagtcgctaaagtagcactgttgttacgagtacgtaataaatgtcgtattaggtatgcgaattttagtccgaaatgcacataaatgtactgttgaaatgctaccctagcacgaaccatgttgaatgcattgctgaagcgtttcgaaatgagcattttaaatgcgggaaaattttcgattctaaaatgttacggtacggtgtggagtaagagcaggtacaatagcatactataaactaactataaacatatattgagcagataaaaaaggaaagagaaaagcagcaggctacagatttgtaactagctgcagcacagacttcaatacacaacgtgtatatgacagatgagactaggtattagtagtgttatatgtttatagctaactattatatgaattggctattaaattaactatagataatttgaagctactattttttttgaacagtcagggcgttgccgatgttttatataaaaaaagaagtgttccattttaagaagagaatgggaccaaaccatacaatgcacaattaattaggaaaactgggcaaaaaccatggctatcgagacattccaccagctaaactaagctaccaaagaaacgagagcaggacaaccaggctcaacactcaacaaaaaaagttcacatgaacatgcaacaagctgaaaagaaaacaagtttcccaaacattggcaaatacgcaacgttatcgtcatcatatcaaaacttgggcgactccgacttcgtcaagaacactagggtcaggacagcaacctagcccatgccaaagcacaaatcaactaggctcatgtcatcgttgccacacgtcgagccccaccgacgtcgcagctccaacttcgcgaccaccagtctcgttaaagcaaggcctggccaaatcgacaaaccttgtagcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20761 - DNA, 677 bp, Oryza sativa
atcccgccgtgcccgcgcgccataaagagggggaaatcactccccgtgattccctccctctttccccccacttttccctctctctctctctcggattcgtttggaaatcctcccgcaaacttcgccggcgtcattgatggagccgagatcgccgcgccggtttccttcccctccggccaccctctctcgcccccggctctatttaagcactccccgtgcctccctcctccgtttccgacccttgccgctttctctccccgtcagaatcgagctcgcgccgtcgtcctctctctccgccgtcgccgccgagcttcggttcgccgccgccgtcgccccggacctcctcccgcttcggcatcgcctccttcggcttcgccgcgtcctcatcgacctcgtccaccccttcgtttcgcccgccgaccgctggaacgccgccgtccccgtctacccgagccgtgccgccgccttcctccgctccggtcgccgttcccgtcgccgccgtcgacccggggtgagccgtggaccgccgtttcgcttcccccttccctcccctctctcgggcgccgctccgccgcgccggtggtcaccggcggcgaccatcggggcgcgggtgcgccgcctcccgtcggctgagccggcgtggccgccttcgggcgtgccccacgacagccatgtgg

SEQ ID NO: 20762 - DNA, 9991 bp, Oryza sativa
  unsure (1)..(9991): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaactcgaattttggaagcttcaaacacgaaatttaaactttcaagtcaaatttttgaaaacatttgactcagatttgaagattttcaagtaaagatttgaaaatattcaaatcaaatttcaaaacattcagccgaaatttcaatatttgcgaattgcaacccaatttcaaaacttcaactcaaaagtttgaacttccaaatcaaattttagaaaaacaaaaaaaaagcgtcgatgctttgcgtggcgaattttttggcgcgacgtgaaataggtcacgtggcaacattttttgtcgcgaagcgtagggaaaggggaaaacgccgctaccctagctcggtcaacgtgcgaatgacttgattggttggcgcacacgcatgccatataggagcccccagccgttgaaccactcctcacgacaatgatggccttggcgaatgatcgccccaatgcatccatgccatgggcaagatcgatgacccactcaagctcggtgaggagttcctggaagtaggctcacatggtagcagcaaagatttgtccgtcacaggagaccttggggggtgcagtaggctgcgtcaccgttgctccgcctcgaggctgctatgtcagctgcggaagcggctccgtcgaccgctgttcgagcctgtcaccgtgtggcattgtggtgaaatgagaggggagcaaggaagagaaaagatgggagaagaaaaatgtggtgttggcatatggttctcataatgattcagctggtcgaaccaagtgaacaagccatgtaacaaatacaactatgaataatgccttggaagtcaaattagatcgcttttaataattggaggggggaagatacctagtattgtgattgagggatacaaattatattaaacctatatttaaggaaataaagtggacttattctgctcgtaaattactgtggttgagagatacaaattagattaaacctatatttgagggaaacgaagtggacgacttattccacccgtaaattacagcggcacgaaggtcacttgttctcctacaactccactaagtgtgaaacgcatgtacagtcaacagctttaggagtcattgggggcaacaagggtaaatggtgcgcacaattaggcctggtttagttccctaaaaacatcacatcgaatctttggacacatacatggagcattaaatatagatttaaaaaaacaatatagataaaaaaaactaattgtacagttggagggaaatcgcgagacgaatcttttgagcctaattagtctatgattagccgtaagtactacagtaactcatatgtgctaatgacaacttaattaggctcaaaagatttgtcttgcggtttccagacgagttacgcaattagttttttcatccgtgtccgaaaacttcttccgatatccagtcaaacatccgatgtgacaccctaaaattttcttttcgcgaattaaacagacccttagtaatgttgcaagtagcaaccttttcttttattgaaggctacctgttgctgccctaccatctcatcacatttcatcaggtgaaaacagcaaaacaaagggctacctgttgctgccctaccatttcattatacttcatcaggtaaaaacagcaaaacaaagggcaagaggaaaaaaaaaggaaaacaacacacacatgcacagtaacacacacaaccacatctgctcaggtgaaatgacgcatccaaatactgcctccaccggtagaacagatgtatagttccactatgacttgcaaaccggcttggaccactccttttatttctggtacaaaacaatcgaataagatgcacagaaattgctatcgcaatgatgaaagcattgtatggatttttatatagaacagtctgattacaaaaccttaaaaacttaataggataatctgaaaagcttaagttcctactgcaagtcactgggaattggctgcatacatcctcatcctgtttggatgtagaggctctgttttaatccattttctaaaagaaaaagtcactaagctcctatcaaatgttttcgtcatatgccaacaaaaggagaaatgacaccaaatatgcatggattgcttaacaataataagtttataagggaaaacctgacaaactatggttgtgagtcattgtggcctacaaattaaaatgccttggggagtaactaaactgtaaaatgttaaacaggtttcttgggttaagaaacgcgtaaaatgaacatcttcatcagatgttcatatcattctaaacatgaggcgaaattgctctaagcatcacccatgtcagatgtatgtactttttagaaactactaacaagataaacttttacttcaagacatttgaccaattttgcagtagagccatcattgtcaacctccactactatccaatgattgtgcgcagatatgacaagtaaaattattggcaccagaactatgaggacggcactaatgtaaacaaggatattttcctaagttcttaatgtctgcattaggaacgaaaacagattatatcattgagcctatgacaaggcagtaccacaaagagcaaattagattatccttagttcagctgcttcagaagttccacatctctaatgataatcctcttacacagcacatagttcatggtcctttaataataagaccaagcaagctctttattgtaaatattcaaaacaaataaagagtatctactattagttgactctaccagagaaataaatgtcttagttgcgtctgagtctatgacagataggtcatataacacaaacaatcgaatactatctgatgctgccgccagcctatcatgctcaaactaaagatagataatgcttacagagactttttaaaataaagttgctgctatagtataccttgtttgacaaaaggagagccctctgcaaagtacttagtaatagagtgaacctgccagtagattatagtcagtacacaacttcacatgtatttcgtcatgtataaattataaacaatatccaaataatacataccttgccaccaatcacctctggtagccagggagccatctggattctgctcctgctccttttgctggattggacatacaaagagaacataaaagtgtcagtgatacaagcaaccagaagctgataattaagagtgtcaatttctacgcacatttcctggtgatgcatcaccctgctttggtggagtgttgccataaaactcccgagcaccgtaatgcacagaagagccaaaatatggcgactccgatgactcgtttggatatgattgtttaccatccttgtatgcaccacgagctttagtagggctgtgcgatttgccatctgcatgacgaaagattgcagttaagcggctgctgtatcacatagaaatggagaatctcctctccaaatcaagatgatgcattaaacatggttgaaaaatttataagaggtagcaaaattactacaaagatcaatgtgctttgatgttggatcaaatgcaacagcgtgtgtgcgactgtgcgtgcatgatcgttgacgttagacataacctgaaatcctaaatccatttctcaggacaactaatgacatgaaagatgattatcctactctgttcacaagtttagccgcaattaaatactagtgtcaaataaaaaggatatcacacaaactacctgcaaagccaccgccattctgccctttggagttctgcttgttcagcatcgcgtacaggtccgcctgcttcgcgtctttcgtatttgcctttcatgtaaaaacaagggcagcaacatcagagggatacccaaataagatttcctagaaaccaagaactcatccaacacaaatgaacccgcccgaaacaattcccgaattcccgaattcagaacaacaaaaaatccaccaaaggaggagccaacctctcgcgcgacaatcgcataacagaaacagagaacaatccttaaaaatctcacgaatcgaaccaactacgagtctacgagggcgcgagaggagagagacgcggtataccgtgggcgacgcggagaagacggtgctgaagtacccgttcgccgccgccggcgcggccccggcggcggtggagggcggcgatttcttcctggagtccatacacgtcggtggtttgggtttcttggcgctcgaggagaggagaggagaggagagatgaacctagacttccgtggaaggagaagaagaagaggaggacgagctcgtgagcgaggaggcggagaaagatagggcacgtgaagtggtcgttataggcggcggcgcggctcggggtcggaggtgggaagcgacacttctctgctcgcctcgtggcgccctgctccggcctccatctgtgcccgcggccccctccttataaagggctcgagtcgaggaggggcgggcgaaccccctgttctgaattctgatgtttgtattccgtagatctgcaggggctgaattgccaaagtgcgatcgatatccgaacttctggccgccgtgagtacaaaaccggcgatgtagtatttttttggcaaactttttctacagtacaaagctttcaatataaatttgatcgcacctggcacattgcgaaacgaaaaaaatagggcgatgtttcattccttatgaaagaatgttgcagcacttagaaaaaatatttcagatctttaaaaaagtgaaacacaattggatcatcagataaaacaaattatttaatgccattgaaacatcaacaagatccgagtgaaatcgaagataaaaaatgaaataccataaaaacccagtgaaacatacatatacataggccaaaacattaaaacataccacccccggggtaaatggcaccacgatctggctaataaccggtagttagccagatcatcagtggcatatatcggagacatggctgacgatggcatgtagctgctggagatagtgatgggaccgacgatgacctacaaaccatcaccatccactcctacagtctctcatgacaatggagacatcgtcgttgtctctgttgtcacacaaacttagccaagtctacgccaccaccgcttcaactgcctaccattgttgcccctatccgccaccgtcgttggcctgctgctgtcttgctgtgggcttctgccttttactaccttatcgctgcctctgttttctcacagataagagaagatagaagatagaggaaagaaatggtggtcagagagagaaaggaggggagtgaataagaccaagaataaaatgagagaaaggagggttgttgagcgcaaggcgcacaatatttttcttcctatcggtgtccgaaccaaagcattttcggataaattgacaataaattttgctttagaggtcgtaaacttctgaaggagaaaagaggacgccactacaaattgaatgtacgatcttttttaaaaattgattaatgtttcatcacacgtagagaaatatttcatagttagcccaaaaatatttcacacacatgcaatatctcctaaaattagttgaaataattttctacatgaaacaacaaagataagttgaaacatgaaaaaaatcacaaacatttacacgcccgtaaacatcaatacacattgactgaagcatcaaaatttcaataagataccaatacacgctgctctctcctcttcggtggccaaattttcggctcctttttctgagccgaccactcaacagtgacaagagttggcacctccctcccccgttaacgcagagaggcacaatgccatctagaactcgtgccattgcgactgaggcaaggccacggtgacactaagtgcattggctgctacaacctgcttggtccgcaccaacccatctttgacaagctcccaccccagccactagctgcagtcccttctttgcgacctccgcgcatggcactaggtacatcatggagttcatgggtatgaaggttagaaacggcatgttcgacctaccagacttgagaatcgatcaattacgattcactaactacgaggttgcattgcacgcaatcatgaagtggccaatgacctccctcacctcctacatcgaggcgaaggcagccacacaacggtaatgatagcagtagatagcactgttggtagcacgggataggggagagagaagagggcctacgtagattggagtacctgataaaataaggggcgacatcaggcgaccgaatgcaagcatttttagagaacgtggtttaaatttgctaattaatttactacacatgacaacgttcgccatgtcgtaacaacagtactcgatgccactttgatatctcaaataataatgtagcattcgatctatatattcattttagatcaaacggtataaaatgccaaccaatgcacactattgtgaacccatagaggatcccaatagctgagaagtcgtcatcagtaggtgtgcgtggcggatggatgataacaactgaagatgctgggtttcccttcttgtgtggagtgtagtgcaaaaggaggaaaggggggaaaagtttctgagaaaatttgtttttccggagaaacaaagaacttgccgtttctataaacctccaatctcatcactccctttgtcccttataggaagtcaaataaatgcacatgcttctgtccttatttcagttctttcagtttgatgacgtgccattttttcccccaaaatgatcgtaagaattatcgcgttccagttcttttcccatgcttgacaatctcacatttaaaaccggtacctatctagctctatagtccatgctagaccaaattgacaaattccttccacggtttcatcagcagcatcggctgctgcacacgtgaaaggtagacaaagcacgtgtaggctgcataggatgataggaacatggtacatggatatcggatagcacgctagcatccgtcacttggcttcctacaccctataattaatcgtgtgcactctcctactacatgcacacagaccaaaagcagaggctggttcagcgaacagatcagcacgcaagatgctgccaattcctttcacctacgaccacgagcaagtggatgatccatcaggggtagggtgctggttatccatctgagaactttttgactaaccgatcgagctcttcttctactgtgctggtctcaacgtatcactcatcggcatcatccctccaaatccaaatcttaacgatcccgctcgatcggagagatcggcatcgatgcgggcggcgaatctttgcccccggtctgaaaagctactacttcacaacaataattcagtgaacaggaaagaaggttctgagctcggtttctagatattatcacgcaattcacaacaagtggtgtggggttctcccagctgtagatatctcgctcatctcacccagacatccacgagagagagagtgtgtgtgtgtgtgctcactcgtcacagatgcgagcaagcaccaataattagctcatccttatctcacagaaatttctcatgcttttctccatcgggctgaccagcattgataggtagcagcagggggccagaggccttccctttttatcctcttgccgtccaaaagcggctgcacgatgatgcaccggattagcttagcatccagtctttacctatcgcgctctctctctctctctctctctcacttgctgcatgcgtttggtggtgtggttccctgaaccagtgagagacgttcagatttgggttcaggttcgaaaccggaaaagcgtcgacgaccccaccaccaaatccggagcggcgaggaggacggaactcgccgtggttatcgcgatagccgactagccgaagccgatacgatcatcctaccgggcgcgcgcgggcggggatatgatacgcgtgacgcgcggtcggtcccgggggataatctagtttattgcgcggcgcgcggtggtttttatcctgatctgcacgtatcttccgcttcgacgcgtcggaggagcggaggtcgtcgccgcgccgccgacggttggggcttgatgggccaccaccaccccggttgacgacgcgtgcgaacgcgtcgctttcgcgagcgagctagcaagcgcgccatggggtgcttgctggatagatgaggcagtgtggcgcgccgaaaagttggcagtgtgcgtgcgccgctcacacgcgagcgagcgatctcgcggctggcctcgttgtcgccgcgacgtgagcggcgtttgtgtgtcccttggcgctgcggagggacgcggctaagctcgtcgaaaaaaagagatggtccgtcatgggtcagcgtcacacggcgtggggtgcatggttgcgtcgctcgtcgcgatggagactgtgtgggaggtaacgggttgatattcgtacgtgtcgaagattttaggctcgttcggagaggagctctgagccatagagactactacctacggtacagaggattatttttgttctgtgagaggagatgaatggaatctgagaagtttctcattacggcatggggtgtgtttacttcacgctaaaattagaagtttggttgaaattgaaacgatataacagagaagttggaagtttgtatgtaggcccatcacgtcaaaactttcctacacacacaaacttctaacttttctgtcacatcgttccaatttcaaccaaacttcgggtgtgtttagttccaaagtttttttttccagactttcaactttccatcacatcaaacctttcatacacacaacttttcagtcacatcgtctccaatttcaaccaaattctaaactttgggccaatctaaacataaccttcgttccaatttcaaccaaacttctaattttagcatgaactaaacacacccgtagaagagggcaaaaattatatgtgagtgctgaaggtcgaagactgcgacaaatgtgtcgtgtgaacagcatgaacaggtaaccgtgaacgcctcttggttagacggtggaattgcgaacactactacagataagtaggcgtagtttagttttgatgactgtcactacgtatagataagtaggcgtcaattggtacacagtataaaatactatgaagtttatgaatttaattttattcttcgtcagtttatgtatgtattgttgagaatatagacatataatgatttaatatattttataaataaatcatgatattatagatgtatactagcattaacgcatcattagatctacacatgtaaactaagcagtaaaatatgaacagatgaaatatgcgcaacatgtcgaacacgtaccgaggtggtggaaagaccgtttgctcggcaggaactactcgcggttgcgagcgtcgacgaaggcgcgcagcacgcgagcgaagaggaaggcgagccgtcgcggacgaacagggagcagtcgcgtggagcgcttcccaaaaaccttattgccgtcttctcccggtgcaggacgtcgaaggcagaggttccggagacctgctctcccgatcgcaggtgcacgccggcgagcgggatggagtagtctacgagcgacagcgcagcacagaggaggaggcaaaccctagattgatttcgtgtgttttgcgtgaaggcggcgcctcggtttatatagagataggacgcttgatcaaggcgcccgcacgatctccactccgcgtaaccgaaccggataagtcgcgcgtaacttatccggactccacaccgttttcacgtaccggatttttcggaatgtttccaaaacaaaacaaatccgaattttccagcagcaaaacaaaactgcaaaaggaggctgcatctgcgcaatggtgaggatccaattttgcggaccattcgacgcgtacgtcgtgcacgcacgccgcctgccaggcgaggcgagcgagcgcgcg

SEQ ID NO: 20763 - DNA, 5359 bp, Oryza sativa
ttgatttcgtgtgttttgcgtgaaggcggcgcctcggtttatatagagataggtcgcttgatcagtgtgcccgcacgatctccactccgcgtaaccgaaccggataagtcacgcgtaacttatccggactccacgccattttttcacacaccggatttttcggaatgtttccaaaacaaaacaaatccgaattttcctgcagcaaaataaaactacaaaaggaggctgcatctgcgcaagggtgaggagccaattttgcggaccattcgacgcgtgcgtcgtgcacgcgcgccgcctgccctgccctgccaggccaggcgaggcgagcgagcgtgcgcgtgtgttccccctcttctctccaccacacatgtttcaagtggctaggagggcatcctcccttttaaggaggccccctctcctagaataagtaaggtggtactaaacttcacatgcatgccataccatgaggtgggcttttgtgattttccaaagaattaattttcgaatgggccttagcccatctattaattccaacaatcccccaccaaatctcaaaatcccactgagatttgctttttccaatgtacttttatataccacggttcgatggagaccgatcaaggttgaacatccgcctagaactctaagctacacttactcacaacttgaacaatggactacgccttgaattgcaagtcttgtgcaagcaagtttcattcagagtcttatctggtactagaccgtctgtagactacccctcgggtggagcgtataagtcatactcctaggtactttagtaagattcctagaagattcactcaaaatcttcatagactgcgaccaacagtcaagcttacaaaggtgagttctttcaagaatgctctgcaggatagcatattcgctaattaaagtcagcagaactcattaaggcatagcctacctgccttgcagctcacgagagtacatgcatcttcacttagagagggtatagattggtactctcctctagtttactaatggtttgttcttcccaggttctaattcacgggatctccaatcacatagactgggttaccaccatagtataactcacataggtctcaaacccatctccttcgatgcattatctatcacatttcgtgatagtcccttcgtgaaaggatctgccaggtttctagctgtttggatgtaatccaatgttataactccggagtttctcaatttcctgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagccattctgcctcaacagtagcagtatctagtgccatcagttctgcttccatggttgacctcgtcaaaatagtctgtttgcaagacctccacgaaacagcagcaccacctagtgtgaagacatatccactagtggctttgatctcatccacatcagagatccagttaaaatcactatatccctccagtaccgcagaatacccagaatagtgaagccccaattccatagtacctttcagatagcgcattactcgctcaagcgcacgctagtgatcatctcccggattagaggtaaaccagctcaacttgctcacaacaaaggagatatcaggcctagttgcactagccagttacatcagcgagccaatgatttgggagtattccagttgattcctagtaattctcttgttcttgcgaagcaacaagctaggatcataaggtgttggagaaggcttactatcaatgtagccaaagcgattcaagatcttctccacataatgggactgcaagagtgtaatcacattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcacagaataactccctcaccccaccatggcgatagtacacacatttatctgcctcattgactgtaaagcctgcagatgtcaatgttttgtcaaatttctcatgcctttgcttaggaacttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattatggtcaatctagcaacaggtgagtaagtgtcaaagaaatcttcgccttctttctgagtatagcccttagcgacaagccgagccttgtacttttcaatagtaccgtcaggcctgagcttcttcttgaacacccacttgcaccccacaggcttacacccatagggtcgctctgtcacctcccaagtcccgttagcgataatggaattcatttcactacggacagcctccttccagtagtctgcatcaggagatgcgtatgcttctgaaattgacttaggagtttcatccacgaggtacacagtgaaatcatcaccaaaagacttagtcgtcctttgtcttttgctcctttgaggagcttcactgtcatcctcctcagtaacatgttcatgtgtatattcagtttgttctggtggtgtgattgaactgggaattatttcagagggttggctagaactactatgtgtatcattcattgggaaaaagctctcaaagaaggtaggatcacgagactccataattgtaccaacatgcatgtcaggtacctcagatttaactattaaaaatctatcggcaatgctgtggtgagcatatcccagaaagacatagtccatagtctttggtctaagtttgcgcttcttcgttattggtacattgactttcgccaagcacccccatgtgcgcaagtaagaaagtgatgattttctccctatccatatctcatatggtgttttgtccttatttctgttaggaactctgtttaacacatgattcgaggtcaacaatgcctccccccaccatgccttaggtaatcccgcggtgtccaacatggcattcaccaagttggtcagtgtgcggttcttcctttcagcaatcccattagactcgggcgaatagggaggcgcactctcatgtataatgccatgttcctcacagaataagtcaaactcgtttgagaaaaactctccaccacgatcagacctaagtctttttatctttctatcaagttgattttcaacttctgccttataaattttaaaatagtctagagcctcgtctttcattttcaacaagtacacatagcaaaatctagtagcatcatcaatcaacgtcatgaaatatcgttttccacccttcgtcaacaccccaatcatttcacagagatctgagtgtaggaattctagaggtgccaagtttctctcctcagcagccttgtgaggcttgcgaggttgctttgattgcacacaactatggcacttagaacctttgacaatggaaaacctaggaattaaatacatgctggaaagccgagacatcaagccaaaattaatatgacataaacgtgagtgccatacattagcctcatcatccacactgccacaaatatggttcacagacttattgcagaaatcagaaagggaaaagcggaacaggcctccgcactcataacctttaccaataaaatatccatgtttagacatgactactttattagactcgaaaaccaacttaaatccgtctctagtcagacgggagccactaacaagattcctgtcgatagaagggacatgctgcacgttcttcagctgcacgatctttcccaagtaaactttagatctaccgtgccaacaccatgaacagaagcatgtgacccattccccattaggacggtggaaccccgtgtgacctgataagaagaaaacaatgagatgtcagcacaaacatgtacattggcccctgtatcaacccaccaattagtagactgattaactgaaaaaacagtaggtaaattaccatacccgcttccatctccagtgttgccaatggtcacattagcagacttagaggtctgccctgcaagtgccttcatcctcttgcgttgtggacacttcctggccagatggtcaggttgatcacacacaaagcaagtcctctcatcctgattagaattgttgttgttgttcttcttcttgaagttggtggtctgctgagctttgtatttccccttgctcttgttttgggccttgtgcacaacattggctgtggactgcccaccatcgcccttagacgcggcatctttttcctgagctttctcctcaatatcaagagacgctatccacccctcaacggagtattcctgtctcttgtgtttgagtgcagtaccgaaacctctccaagatggaggtagtttcgcaataatgcacccggccagaaatttgtcgggtaagacacacttaaggagttcgagttccttagccatggtttgtatctcatgagcctgttcgactacagaacggttgtcagccatcttgtagttatgaaactactccatgatatacagatcattgctagcatcaatagcaccgaatttagtattcagtgcatcccacaactccttagcgtcggtcatatgcatatacacctcgaccagatgatcgccaagcacgctaagaatgcatcccacaaagagagtagtggcctcatcgaattctttctggtgattagcattaagaacgcccataggcttgccagtactcacaaagaagcatttcatagttgtcagccacagagtgaccctgatctgccatctcttaaagtacacaccggtaaatttatccggcctcagtgcatcggcaaaaccagccatagtaaaatcacagcgcctataataaggtttttggattgttgagaatatagacatataatgatttaatatattcaataaataaatcatgacattacagatgtatactagcataaacgcatcattagatctacacatgtaaactaagcagtaaaatatgaacagatcaaatatgcgcaacatgtcgaacacgtaccgaggtggtggaaagaccgtttgctcggcaggaactactcgcggttgcgagcgtcgacgaatgcgcgcagcacgcgagcgaagaggaaggcgagccgttccggacgaacaaggaacagtcgcgtggagcgctttccaaaaaccttactgccctcttctcccggtgcaggacgt

SEQ ID NO: 20764 - DNA, 2882 bp, Oryza sativa
aggacggtgatgcgggttcccgggttggggtcgagcagcatcttgatgagcttccgctgtagcgtccgctgccggacctccccgaacctgccttcacgcggaccggcggcgctccgattggggggcagcgccgaccacgcccgccgccgccgtcggaactcgcctgctccgccgcccacccgcgccgtcctctgcccgggaaggagagagagaggggaaagggaagaatagagagaagggagagggaagaagagaggagtgaggctgacatatggggcccacgtgggccccaccattttaaatttttttttgtgcagctgacatgtggggtcacgctttttattatttttccgagatataattgccatgtaagcgtcacgtcaatgccacatgggacgaagacctagtcaaacaagccacgtaggcgccacgtcagctaaaccgcctttgtaggatcaaggaggccgactagagggggggtgaataggcggttttaaaacttaatggcacttaaacaaaactaacctaagttgctaggcaaggtaaggtgtaaggttaactaagcaactaagttaagttttgcaaacctagatgatatgggctcaaatatgtctctatgaatgtaaatagcacaaatgtaaatgcaacaaataaatgaggcaagagacaaggaatttttcaccgaggttcagaaactcgccggtttcctaatccccgttgaggcgagcccaactccaccgctcaaccacgaagccaccgcacgcccccttcatcaaggggtgggcaaggcgggagccggcccacggagaggactacccaagcctcgatcactcggggtagttcttccttcactctgaaggtggtgaactccaaaccactcacaaacggcgccgggcctcctccacaatctcctcggagaggtcaccgggcaacacctacacaagccgtctaggaggcggcaacctccaagagtaacaagtctaggatgcttgccgagaatgatcaagtgtcacactagctaaaaaaatgaagcaatgcagttggattggcttaactcactctctaacacctcactagataaactgtcgcgaccgagaaaattgccttttcccgaacgctagtgtattaatccccgtcccaggaaaagccggggtacaccacacaaacatgatacaaaaggcacatctttattatatcgagaatatttacattattacagaggcgcttcaggcctggcaatcaaaaataaacagcagcggactagcgggcctacggctccatcttcacaggcgctcaactggggaataagccaggactccacctaagacatcttctccaaagcttctcttactgaatgggggaaaagattgagcaagaatgagtacaaccacagtactcagcaagccacaccggagatgcgtaattaatgcaagggagtacaaggggataataatataggggttaagttttgcagtaaacagcatttaaaagtcacttagttgcccaaagccattttaaaaagacgatcctagagctacacagtattattaatcagggtcgtgaacccacacgagcctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacagattttaggggctttgaaagaggaagagaggggtatgtccaattccaccataagccaaccattccatagtgtccaaatgatatgagaattcccaaagtctaaagttataaaaccacctaatgttgcctaattaaccagcgaagcatctacctaaattcataccagtggaaccatgaatagagtacccactagttggggttttattttcctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcaacttccatgaagagaggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggcccagttatggccatttgaaatttatatgctcctttaaatggatatttac

SEQ ID NO: 20765 - DNA, 1683 bp, Oryza sativa
gggaaaaaggactttttagagcttttctttttataaaatcattttaactttgtttatttcttaataattattatttgtgctctgaaaattccactaaaatttgagggctcctttagaccaaggagaatttaacaaaaattctccgggccacatttgagtttttcttgtacgtattttagtgtttgccaatttcttttcgaattttaattaattctattattccttttagcgaatgatttttaattcgggatgaatttatcaggacgtgacataaactaagtgcacaagggtgtgagagctcttgaaagggttcaagataatgcaatggagtgccaaaaccttacccttgctgctggggagtgggtatatatacccccaaccaccaaaactagccgttggaaacgaaatccccaactttgtgctctgccggtcagaccgtcgttgtgaggccggtcaaaccggactactttgtaacggctagaaaactagccgttacagggcaatcattgagcccactcaacctggccggtctgaccacagtgtagtggccgatcagaccgtccacggctcggtcagaccgccatcggcttggtggggccggtcagaccggccttaccacgccggtcagaccggcctaaggcccacggtcagaccgcaggtcacttttcagctcaaacgaccattagtaaaacgactatatctcttaactcggggctcataatttggcgttcttggactttatggaaagcttattcaaagggctatccaacccatgaacaatccatccaagaaacacaacttttctcagggagaaagggctcacactccaaaggatactccaccggacataaccacatgaggctacccaaacctataggatttgcccacatctctctttgtttaggacttgagaaaactcaacacacttggctagacaagcccaccaaatacacctatatgcatatgaactaatatggcacaagatcatccacaagctcgcttcatagacccctcttgatagtacggcgtctatctagcaaatccggtctacaccaaacaccaagaccgggaaaagactaagaaaacattcttagctacattatacctttgccttgcgccatccatcttggggtcaagcttgagtcgagatcaacacttgtgaccatttgattcaaccatgtttataccaaggtatttaccatcatttgtcaagactttcttctcatcacaagcttgatttcattcttgccaacatggcgatgtccttggcatggtgaccattaacccatggtgtcatccattagcctcatcatagtgggacctattccttttcacatctcaaaggagaacattagtctcaacaaatcggttgtcatccttcacttgatgaccaaccggttgcatatgaaagatatgtatatgtttgttgagtattcattaacatcacaagtgtcatatactcgtatgcaagctcaagtgcaaagatccgatataaataataggtgaacaacatggatctaaaacatgtacaataaatgtataggatttgctccccctaagtatatgcatacaaagaaatatacaacagagacaagtgtatgcataagtaaagaagaaccaatgggggtttatcctatacacatagagaaggcatatgtagtaatgatgaagataaacaaaaaa

SEQ ID NO: 20766 - DNA, 24816 bp, Oryza sativa
  unsure (1)..(24816): unsure at all n locations
tgattaaggtccatcaccaaagaatgcatatctaccacatctcattatcgggaaataaccttgttgaaaacttatgtaaaagagaggttaatcccataaacatcggtttatcatctatcaccaacgtaacaattacacaaattgtttaatccaagatctttcaatcttttctctcttttgtgataaataataatccgatataaacaatacaaagaaatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagacaaagttagaatatgtgaagtttaatacatacctcccatcatttttactttcatatccaaataagactagtcaaagaaagactcataaaaacgttagtctcgtataattagatttgtcattaatcaccgaaaccaaattaaggcacttgaacttacagccttcaaaaccaccgagggaccatatttacccggttttcgtaagttgaaggacggatcatacccggttttgcggtcgagggacgaaaatcagactgagcgacaaataaagggacctaaagtgaacttattccgacacactatgtatatggaccagacatcggaagtacattcggctaagcatttgtagttttgggcttcatctacacctcaccaatgggctcttgttgggctatcaggatgaagtcttcattgtttgctgaaaattccagggcaccttttgtttgctcaaactaaggttaatatagtgtgaagacgtcttctactcttttatactccctccaacctataaaaaaacataacttagaataagatgtgatattttttatgtttagattcattgtaccaaaaaagttacattccatcataggttagttttttaatgagacaatcagagtacgtgcttgaaaaaagtactactgaagtttcaagttacagtagtgttttttccgaaataagacgaatatcttctaagtattccttaagaaacaataaatattaatttacaaatcttagtaatagtacttctacacacagattgtggaagatcgaagaaaaaaaaaacaagcatagaagacggatcctaggcaatccgcatgcctgcatgatgcacatcaggaaaatttcacgactgccgccgcgcatcgggatctgaaaacgcacgactcctcccgtgacaaaacgtccatcccttcgacgccgcacgccgctgttcccgttgaaaatcaccaggacgaggtcggcggcgggcgtgcggcgcacagctgccacggcacggcggcctcgtcgcgcggttggtagagacaggccggcacgtccgtcgtgtgaatcgcgcggatgccgcgcgggtcaccatcgcgatcgaccgataacatcggcgcgacaggagatggatcgccacaacaccaccacagcggatttgatctcacatcacgtgacactacccgtcacccgccatcggattaacgacctctactcgacaccaaactagagctcctgctcccgtccgctcgatcgcgtcgtcctggcgatgtaacggatcggtcgatttgcctccccaacgcgacgctgacatgggaagattccgtgccctaccatatgccgacttcaatttttactcggtctatctttgacacaagcgatctacgaatctcatcatgcacaagtacagaagctagccggtccgtgcatgcatgctgcaatatcactgacgttgcgaagagaggccggaggtgggtactaccgtactagaatcttatcgtgacgtgaatgtggagttttccttcacaatggcttttacctgtgcaggttagacaaagggttgtaccaaaccaggtcgtcggatggtcgctattattttttttcccgtttttcagaaccacttttgtgacagcaactggcagctttgcatgcgttggaggcggtaggccggccgcgagagcgagagaatcccttctccccgacgcagccactacgtgtgcaacgcattggccgcacaactagcttaagccggtcggcccggctgttgcctgttgatggcgccgtgtagactaatcgatctatcagcaaaccacccgttgctgtcattggccagggtcgaaattaggtacagtactccgtacgtccccggcactgctgctcgacgtcacaatgataaatgaccagcgtttcgccgagacattctggtcgtgcgtgcgtgcgaggggcatgggccaccatgcgcctcgtagttatcggcaggaacaggcatgtgacgtgacacggccttgcccggaggaggcagcgctttgatgggtcgaaagatatgggcagcgtccacggacgatgtaacgacgcccttgaccgtgcgtgacgcggtactacaccgtaatagtaccgtaatatcaactatagccgcctcacctgtccggttgattacgccgcgcgacggctgtttcttgccgcgtcggcaggtccgcgcgccgcgactgacgtgatgatccgatattgcaggtgtgtcatttggggtgcgtccttgcattgcatgcaccacatgaccgtgtctagtgagcaagatcaggagtaatcaatggctaggctgtttgtttggaggggctaattcataagtccctctactttagtcccttttagcccctaaaatactaaaaaaggagggactaaaagaggctaaaactacctagttccataagttcctgtgggaggtgctaatagctcacctactattgaatggatgaagcatataagtgccggatgaaatgctcctagataggtcatttaatgatgtttcagtcccttttagtctctccaaacaaagtttaacctctctttcaaaaatataagtccctcccctagagacttatggttttgtgagtttagcccttctctcccaaacaccctctaagtaggactaaagaggacttatgttttagtcttagaactaaattttaaccctaggacttatgtaaacaatcggggcctaaaagttgctgcaactgatagcagctgatctagctttcctttcccatcagactagcgataccacagtatagtctcgttagagaattatgaatttcgcaaaattagttaggagtagtctcgatggttaattcaaaagcttactccaattactaaacgtaccactgtatctgctagtctaacatgaaaattagtttactactgcctctatcccacaatatatgtcgttttaactttttcatgcaacgtttgatcattcgttttatttaaaaaattagtataaatataaaaaaggataagtcatacttaaagtacttttgataatgaagcaaatcacaaagaaaataaataataattctattttttttaaatagacgaatgatcaaacattacaaacaaaaactcaaagcgacaagcaatatgggacggagttagtaagtcccataaaatcaaatctattatacgatatactccctccgtcccaaaatataagaacctaggaccggatgtgacattttctagtactacgaatctctgtcccatccagtcttagattcttatattttgggacgaagagagtagcacattctaagggcatccacaatatagtctaaaactagtccataagcaataaaatattccattcagccacctaacaacattgtggaactagtccatagcaagaaaatagcaaaagccacccataagcatatgggctgaccatatagaataatatatgttatttctctctatttcctctctcctcctaatactagttgctatctatatagattgtgaagataacaatagttatggtccatatgtgtgggtcccatctatatggactatttttgctatatacattgttgttgccctaatactactacatatctaatattagaatatatcacattgaagtaataaatcgtaatagttgattaaccggggctctggctagctcagtcgttggaagctttaatactccctccatctcaaaatgtacggatttttaggattgaaacgggtattaataaagtaggtagaactaaataggtgaagattgtgactggttgagaagtgaaggtaggtgagaaaattgaatggtacggtggaggattgtgattggttgagaagagaatgttggtgaagtggttatattttgggacaaatcttaaagagctaaaagttgttatattttgagatggagggagtagaagatataagtattttgcagataaactaagacatatggcaatgttttttaccctgtgtgttgagtacgaaatactatctctgccgccatcaaaattttgcccttctgtttttttcactgttccgttaatatttgtgtctcttttgacactgtcgttgattaacgaccatggcatttacttctactagtgtacgtgatttgtcacacgtaattcaattctacaatataagtaacttattttgtgaaacatttgagaaccaaatcccatggtgcaatttcaaaaattatccaattgtacaccttttttcccaatctattatctttgaagcggccataatttagttttgttgataactttatggtatttgttagaagtacgtgtcgagtgctgcattatttttgcacgtttacagggtataatggtcttttagaggcaaacgtaatggtgaaacgtctttgaagctgtggtgccctggtttagaaaacgtacgtacggcaaatgaaaaagttacagatgtggaagagagaatacagtcacaacaaatggcaaaaatagaaaaactttcccgctggaaaaataatagagtaaggccctgtttagtttccacgcaaaatttttttatcctgtcacatcgaatgtttggatacatatatggaatattaaatataaaaaaactaattacacatattacgtgtaaattacgagacgaattttttgtatatctatttgtactagcacaaatactactataagtataatcttgtgagattttgtgcagacattgacgccaatagaaagcactctttccgctaaaataaacttaaaccttgtatcggagtacattctacttatatgaatatgaatagagatatatctaaattggtactctatttgtcccataatataagggattttaagtttttgtttacaccctttgatcactccttattcaaaaaattttagaaatattatttattttttgtgacttgctttattatacaaagtactttaagtacaacttttcgttttttatatttgtataaattttttgattaagatgaatggtcaaacagtgcaagcaaaaacttaaaatcccttatattatgagacgaagggagagtaatgtatcaacgtccagtattatcgatcggttcttttatgtgataagggaagtaggcaaagaaaaaagagttaaaggcgcaaagaaaaaagagttcaggccgtgtttagttcgtgtaccaaaatttttgttgaatcatacggacacacatttaaagtattaaacatagactaataacaaaacaaattacatattccgcctgtaaactgcgggatgaatttattaagcctaattaaaatgtcattagcaaatatttactgtaacaccgtattatcaaatcatgacgtaattaagcttaaaagattcgtctcgtaatttacatgtaaactgtgtgattgtttttttatttatatttaatgctctataaatatgtttaaatatctggtgcgacgaaatttttagaagtttgaatgtaatgtctaaatctggaggctgtaatgatgaagagaagacggcgagagtttacgaaccgtcttgtgcttgtaggagtacgtcaagtcttcaactcttcaagtcacctactgctactgcatgcatgtcaaactctcacatcggcgtacaccatacaaatgtaaccctgttctaaatttttttttcgaaacttcaagctttccatcacatcaaacctctcatacatacataatttttcaatcacatcgttccaatttcaccaaaaaggttatttgggaactagttactaaactttagtccctctcacaaaaacataagcccctcctctagagacttatggttttgagtttagcccctctctcccaaataccccctttcaaacttcagtgtgaactaagagggtgtttagatggggctaaaactttttagctaatgtcacattaaatgtttatatgctaatttagaatattaaatataaactaataaaaaaactaattttataaatgagagcttatccgatgcgacacagcttgccgggaagtttacgtgctgagtttactccaagtaccacccttgcgctttgattaccactgcagttcagagaaccatgcatgagagaaaggcacctcagattagacagcgaaatgattgccgtcagctgtctacacgagggaggaaatgagtgaaggttgcacacactcctacaggcagcagtggtttcttgtagcgccaggcaaaagaaagacaggtctctctcagggagtcagagatgacagaatcatttctttctcctgataatcacagttaaaccagctagtagtagtagaaaactctgcctcggtacttccgctttttccacggagtgaaggagtatagtagaaaactccttcgaattatacgtacaaaagtactcctactatactcgttagttgttcttattagtactaaacaatttttgagattttcggatgccgtttccggtttgcgcccatagttttagccggtagtattaaataattgtgagtgttgaaaatgagaatagtaatatcttctgaaaataatagtggaaatcaggaaatggaatgaaggtttttctgcccgtttggtcagaaacctgttcgtatgttaatttctgttaaaattttgaaagtgccccggcgatctagccagctcaacccatcggaaagccctaggacatggtatgtatcctttgctgaattttgatcttctcaacttatcgattttgaagtattgttgaatttggtttatactgttcgtcaaacttattatcatatcattaattattatataatgatgtaatgtagagtgtgatgattataagaatgaagctttaaaatcattttaatacatagttaagtgcgtgattatgccacactcttttttttcatacatgaatttcgatttcctaccaatatcaatagatttcattccaacggttcagtttttgatataataatattaccgatatcgttatcgttttcagatcaacatttcaattccgtttcaaaaaaaatataaaaatgaaaatagtagagggttttccgaccgttttcatccctagttcctactcacgctgatgtgaatatacagtagtaggagtgttatagtgagctgtgtttagtttgtgtgccaattttttttaaaagtatatggacacacatttgaagtattaaacttagactagtaacaaaacaaattatatatttcacctgtaaactgcgagacgagtttattaagcctaaataatccgttgttagcaaatgtttactctagcaccagattgtcaaatcatggcgtaattagactcaaaagattcgtctcgcgatttacatagaaactatgcaattagttttttttgtccacatttaatactccatggatgtgtccaaacatttgatgtgacggaaaagttgtaagtttgaagaaaaaattttaaatctaaacacagcctgagttacgcaatgtaggtttgtgaagtggtactactggtcagttgcgcagcgcgagaaaacgttgctcatatagctgttgatatcgaccacgtaaggaactgaccaaatgaaaaacaagtactaatattatgtagtgagattacccatactataaatttgaacatcgtaatattatatagtattacatacctttaaaattttttatattttgaaacgggaagtatagactagggttgagagaaatagtagttagtagtaaggtactaggagtactactctttttatcctaaaaataatccaattctaaagattgcagcttctgtcgcctgttaagcgagctcgtccgcgctcaatctgaatatggtttatgttcaaattaaattgtagaattaaagatttttatgggaggaagaaggcccggtttagatgctgaaaattttcgggtctgagcgaaaagttttggcatggtccagttttcgcgttttgggaactaaacggtgaaagatttcggggtactgtttatgggtggacgagtagtacccctcaccctgcatgcaagcaacaacaacacctaggagagcattaaataggggcaaatcaggcagcattaaataggtccccaaaattttatgccaaaactttggctgtttagttcccagaatgccaaaaccccaaaattttttcctccgcccaaaaattttggccaacttttatgatgcctgagctcactgagtcacgttcaccggctcactgcctcccagtcttccagcgatgcatcggcgaccatcaatggcctcatcgtcctccttgcgccgcatgccgacgccacgaacgtacgccgcgcgcatgcatgcggggtttctcgtgacacgcaggccccacaggcagacacggcaaggacaaagccccatgggcttgcatgcacagtggccgtccctgtgcgagacctcgccccttgggggtcgtgtcatgcgatcgacgggaaactcgggcgcctctgcactctctctctctctctctctctctctctcaatgatcttggtcgagtcgaagcaaaagatcgcgtgtctgtcgagtgtcgacaagccaagctatccaaaggagtccgaacgtgtgggggtggccgtggccagtctcccgtgcatggcagtgtctctgccccctgactgctcgccactaccaggccgggccattctctctctctccctccgctagaagagattttaaatgggtgtgacacattttaatactataaatttaaatatattgtggctgtgtttagatccagttgtaaaattttagcgtatcacattaaatatacggacacgtatttaaagtattaaatatagtttaataacaaaataaattacagaatccgcttataaaccacgagatgaatttattaagcctaattaatccgtcattaacaaatgtctactatagcaccacattatcaaatcatggtgcaattacgcttaaaaaaatttgtctcgcaatttacacgcaatctgtgtaattagttattttttcgtctatatttaatactacatagatgtgtccaaacattcgatgtgaatggtgtaaaatttatcaagggatctaaacaggtcctgatctatgtccagatttattgtattagaatgtgtcacatatatttaaaatcagttatattatgcgatgcagggtgtatctccttgccgcgcgagatgacgggtttctgccaggtgggcaagaaaacaaagcaagaccgggcgggcgctacgtgtgctagcttagccccccggctacactacagtcactcacccccgccggcccgcccccggccgggcgtccttgttgtgatcgatcagcggcacacggtggcgcccacggtgcgtttcccccggcccgtgaccggtcgcaggggcgggcacactggcgcggtcaccgcagcaaatgcagcggtaggacgcgtagtttatgtgcgcaaaactgatcggaaccgacggacgtaagcaaaatataaagagaacattgcaaccacaacaacgtcaaacgtgaaagttttttcagacaaggcataaaaatactaattcctttcgtttcagattataagagtttataatattatccatattcatatgagactgcctatacatcatgtgataggcacacatatatatctagatgttaatgaatatagacacatatatgtataaattcattaatatatatatgaatatgaataatgctataaagtcttataatataaaacggaggaagtatcgaactataaaaattttctacagaataagaatctacaatactatatttgtctcacttattacctcctatttaaattttctgcaaataccaattttattcaggggcaaagtcaagacccggtcactatggacaagtgcccaggctccgcccgctgcaaaagtacgtaccagctgcttgattaatcgatctaacatgttatgttagatttagtctactatattacatctgggttatgtcatttttcttctataaatcgaaatactccctccgtattataataaattcatttttaagcctttccatttatctcaatataagtttatttttttaagtaatcattgtatcaggagtttatgaaagtatatacaaatgtattgggatttgataaaatagaggtattatagttatttgggttttgattggtatgtttgggataagtaaaaaaataaacatattttaggactgatggagtatataattttatgaattttacatatgcttagggcatgtacaaaggtaaaatttaatatgagctctttatattaattaatatcactagatattgtactcctataatagataagatctctaaacctttaatgcactaaataattttttttatacttcttttcttttctccaccctcatgcaataatttttccattaataaatgctaatagtcgactatgagtcgtcgtcatgcatagcaacgatgtttctcttttcttccttttctttcttcaacgtcaccaaatttatctgcattacaatgaagagaccccgttattagacaatgaagagaccccgttattagacaccctgcatatgccctatctcgtttgttcaggctcaaaatacgtcattgttcttaccgtcaatcactgtcaccattttgccatgtttatcctcacttattaaaggcataatagatgtcttccttttggacggcgttgtaaccattaacggatttgctatcggagcttttggtttgtgggccatcatacgagtgtcaagatatgtgctaggtatggaaaaaaattcattgcacatgcaaaatgctagctattattatattctgtaacggaggaaatagtcacctgttttttcttgtttatgttatgacaagttacatataaatatatttcagttatactataattatacttatactatatttaccttccaaagttttggactaaaagaaaaactgtcgaaagtctttagatagtctcaacaattaattaagcacttcaatgtaatgtaccgctacttgcgaacgtccgaattgtgacggatcggatcggtttatgcttttgacagtttttcacccgtgctagctgctgcgcgcggtgtcgtgtagtcgtggcggagacctggagtaaatggtcggcgttctacgtgcgtcagccatagcttgaccgggctgcgcaggcagtacctccttgacgccatcgacgattatccaacagtgccgcctcagtgcacctgccaggtggggcccacctgtccacgtgatacggcactgttgccttgttgtacacacactgttgctcagtgctgctttgagtagctgggtaggcatagctgtacaggacgcttagcaatgaagtgggctaggagtagggtagagtacatcggtgctacagaaaaggctacagttgcagcaaaagcccacccacggaggactagttcattcacccagtccagtccagtgccactagtactaaaacacctcctctccgtatctccggttctgtctgcaaagcttctaattgctgtagtttcttttaaaatcaaagttctcctagatagtttagcttttgattcagattaaaaaaaactgtaattataaaattcaagtagtaataaatttaaagccagaagtcagaaaacctagtatttctagattatcggaaatagctacaacgtgttatttttcagaattttaaactctccaaacgtgcctctctctctcgggtgacgggtggatgcgacgttaaatggcaacagcggccacgtcacctccgacgcctacaccgccgtagtactcccaaacctgattttcgtgtccttgaccgtccgtcttatttaaaaaaatacaaaaaaaattaaaaagataagtcacgcataaagtattaatcatattttatcatctaataaaaataaaaatactaattataaaaaatttttatataagacggacagtcaaatattgccacgaaaatctagggtttgcctttttttggacggagggattagacctcaaggtatctctcatgatcccctttcccaatactactgcgtactcctaccgtattttgcgtactccctccgttttcaaaataaaataaacgtagctataaatttctctgtgtccaattttaatcgttcattttatttaatttttttttaaaaaataaaaaaacataaagcacgtataaaatattatttatattttataatctaataataataaaatactaatcataaaaacttaaaataaaacaaacaattaaaattgaatacgaaaatttatatttgtgtttattttagaaacgagggagtactgtactactactagcggcgtagcctagccctggcctggtgatgatgatgcaacggcgccggggatttgacacccccggagacgtgacgaccgtagtgcaatcccggggaatctgcgtaacaatccccctgctgctgctgtcctgctagcctaaccgggggtggagtagactagtagtagtactaccagtagcagtgtaccacacgtagatcgggccccgtgtgacagggagagcgacgccggaggggggagatgggccgtgcaaccgctgcttatgtggtgtcgagtcgatggtgggggctaccggtcgggaggggtctcgctctcgcccaccccaccggcccgtcgtggtgtacagtgtactcctacgcggtggccaatggagagtgtgttttagggcagcgttaatggccaccgtacgtgtggtttgccgatcaaatcaaaaaccttgcgctggaattttgtggactaaaatctgtgttggcgactgcgaggggtggaagatgacgacgaacgaacgaacgaacgctacgggctcactcggtcaagtcaagggcatgccgtgctcgttttggaagttttcgatgttcatttcagggactccggagggacactcgtattgggtttacgaataggagatggcctaccgttccgggcttaaatgaaatgatggttttcacgaaatccggtagaaaatcagtagattcaataaattttataaaccaaaatttgaatacaaattccctgagtttatcgataagctcgtgaaaaccggtcggcttgatgaaattctgagcgaaatcatcgaaatttcaatcggtaactagtaaaggaggtaaactgatttttttcctttttaaattcgttattcttttctttactactgtaaatttcagtaaatacacggaatatattaatttttttgaaaatttatattccaataggttctataaatatcgttaacttctcccgtcccaaaatatagctacctagtacaggatgtgatattacctagtactactctcggtgacatggggccgggggtatcgtgactagaggcttgggtagccgcggtcacccacgtggcctgacccccttgggggggtcgggcccgagggtgacgtggccacccctccctctgtctccccgaggggtcgggtcgctcccgtttcggccccgagggctggggcgccccgaccccctgtggttttggcgccacgtgtgtgggttaggtgagcacagcgggctcacctaaccgcatttatagcaggttggacgagcgcgccacgccgcatttaatgcggcgcagcgcacgcttatccggtccgtgaccggtcgcggtgtgtgaccggtcacagaccggtcagatcgcgggttaggtggcaacaggcggcctgtcacacgcctcgccccgtcccgtcggaatgataagagcttcctggctctcgtccctagccggagctggtgtgctaactcctggagttggtatgtcagtccccgtcagattcattccaggcttcagcgcaagtatagcaaggaagtcgctggccattaaatgaaggttgaaatgggcgtccaccgggaaagcaggcgagcggggcaggaggcgtgtgctctgcttgtcagaggtcacttccggctgtgactagccctgattgtaaaaagcatgtttcccttcttaggcagctagaggcccatgtggtgacccctgaccagataaaaaggaggcccaggcctagaaaaaaaggggagagaggaaatgaggggagtggggactctggcgaagggtttctagagcctgaactctctttcgctctcggcctctctgtattccttcacgcacagatccaccagaacacaggagtagggtgttgcgcttctcagcggcccgaacctgtctacgtcgcccgtgtcttgcgcatttcctctctcgctgacgttcctcagatcgagggcgaagaacctcacttagcgcccccggccgaaccggcaaaggggggcctgcgcggtctcccggtgaggagccccacgctccgtcaactacgaatctggacaaccctcaaaatgtagctaactaatataggatttgacattacctagtgactatccagattcgtagtacaaggtaatatcacatcctgtactatgtagctacattttaggatggaggtagtagtattcaatttcgcaccagacatattgtattccgaccaccatagcagtagtgttttatttcggttgagtttaggtcatcaataatatatgtaaagagatcaagtagtagttcatagaaataaaacccacactagtgattttattgttttcattttcataatatatgtagatagcaattaacattaagatatgaccacactccaaaaaatttcatatccaaataccatggttctctcgtgcagaagaagcaagacgagaaagagagttttttttatctatatgagtaatctttatagtcatgagtagcttatcatatgactctttctaatactacatctcacaatgacaatgacaaaggtaccagtatagagttttaaggacggtttcttatcatattgtggatgcgcttacaaacatcattgtatactgtactacacggtaatttttcttgctgcctcccaagtggtaaagctaaaaaacgattagagcccaggcaaaccaaactatatgcagtgtttactactccgtattaaaattcttctaccagtattttcaatcacaacagttacactaggagcaagtttaacagttacactagtgtttactactccgttttttaaactaactgccaactatttgttcatcttaaaatcaaaatatataatagattaattagacggttggcttcagtttttttctcctctccttttctctcggttatacatttaatcaatttatcttggagcatgtataaagctagttcttacataagagccaacacccttatttaatattgttacctctcctctccatataagtttacagtagatttatagtttgctattatccttgctttaaggttgtgttctttctgcttccttcccaacttacctccctctcttttcacgcacacgtttttcaaaatactaaatggtgtgttttctgcaaaagttttatattgcaaagtttctttaaaaaaatcaagttttttggttaattcttaattaatcatgcgtttatgactagcactgttttttgtacgggtaggttatcgccgttgtgttcctcgccggctacaccttgctgcttcataggtttgtagctagcccaccaagattcggagaagagaggaaaggggaaaggaagaggtggacggaggaagaagataagacattttagtccaaaattttgataagtgcatgcaaagggtaaatagtggcatatctcgaattggtttaattaaaattttaatggcactagtccaaatacataaattataatggtattcttgtaaccggaaaagttatagtggcacatatccaattaatcctttcacaaatttgattcaagttggtacaagaaaatgaataagggtgtgtttaattcatgctaaaattgaaagtttggttgaaattggaacgatgtgatggaaaagttgaaagtttgtatgtgtagaaaagtttgatgtgatggaaaacttggaagtttgaagaaaaaatttggaactaaacttcggccttaaaaaaagaaagacgagggagggaggaagaagcaaccacaaagtccacaacctcacgcgattctatcacaaagattgttttcaggttttttttccccacaatggagcccacataataaaaagcaaaatcttactttgtcatctctaggttttgtgatggcaacccttaatgacttgatccagtagtggagctacaatttttccaaacctagagctcaattagttgaatgttatgatttttcttttatattctagtttttgaagttttaaaatggaatttcaatgaatatttaggatcaggagtagggctacagccctagttgccctactcctatcttcgcccctgacttgatacacatactagaaccacatgagggcaagagtgctcccgacgggtggcgccatacacatagggcttcataaggaatntgggggccagtgaanaatataaaactactatgtcctcttattcaatataactagaaagataattatgaatacaatccgaatataccttgtagtatcctattagaacttcatttctccttttttattcagaacacatccacatatgaggcttgatttcatattggatttgttatgtgatgggtcctatcgagttttagtacataagtaatgggatcccgtatttaggatactgacatatatattcactaaagttgcataatatatcaaggtagactcatgttttcaattaacgctaagaagaactatgtctagatgcagcgatttagttttgattaagtgaataaatggaaccttaacatctaaaacacaggttcatattgtcgtcatgatccatagttctttaaaatagtcatgattactatcaaacatttattagagctgattctttttcaaaaatatgaaaaaagtggtctttaaacatgttggaacttggaacacattggcatgaattaaaatatgaaaataattgaagcctctaacttttgggggcctgttatacagatcatctcgcacgtgcttatcgatggccctacatacaccatagcctaacctcttcaaaattgacaacaccacaacaatgtattgagtgctacttactttgtaacatactgtaagagacagcttgtgagttccttcatggattatacacatgagaacgtttgaaatagttgtttggatgaaacacaaacatatagtaattaaaaaactaaaaaagggaaaaaaaagctttgttcggaaactccaatgaaatatctcaaaaggaaatttgaagagtcacttatattccatatgactacctataattatctacgagatttaaattcttatggacacaaattcttcggataaatttacttgaactttggtgaaagaaccctaaacacatgtatgcatccagacaatggaaagcaagcgtgccatgagattttctatttgggccgtgtttagattaaaatttttttcttcaaacttccaactttttcgttacatcaaatgttaggacatatgcatggagttttaaatgtggacgaaaaaaatcaattgcatagtttgcatgtaaatcgcgagacgaatcctttgagcctaattacgccatgatttgacaatgtgatgctacagtaaacatttgctaatgacagattaattagacttaataaattcgtctcgtcttttacatgcggaatctgtaatttgttttgttattagtctatgtttgatacttcaaatatgtgttcgtatatttaaaaaaaatctagcacacgaactaaacacaaccttggatggccttctaagactgtctccaacaagtgacccataagagcacccaaacccaaaatgggtctccgatagtactatttcaacaaaagacccattttgcgtgctataagaggcataacctaaatctgagtatcctctctcctgaagacctatttgcagtaagtgttctcttttaggtcttattgttggagaagaccaaaaatatgtattgaactctttgactgtagcgctatgcaaacgtgaaatggttcttgtattatgggtttcattgttggagatagcctaagttgcttatccggttttattgcctgccatataagaaccccatcatccacatccgaagaggacatatttttgttgcaaaactttaaaattataataataatgtaactacaatataacataactagtacatgtaacgtttgttcaagcaattatactactaccatagtacgattgcgtataaagtttttcaattcaaaaatgttgctgccgttttctagatggtgaaaaacaaacttcacccatctccgacgaactacaaaaccctcagctcgatctccgcacagtcccgggccacgcccacaccaccctgatccgctcaccccttccaccacagggtccaggaggacctcgcccccctcctcctcctcgtcgcacgaccagaccagcagcaccaactccctttctgcctttcgctttcactgctcagtgctgctcctacacaccatttccccgtccgtccttcgccccccgcgtctcttttccgcacccatctgctgcagctgcgcacctttaatttgcagaaagaaagaaagaaagaaagaaaggaaagcaaggcccccccgagcgcaacagctagcccaacacacctcctccatcaccaccgagaaggcaacgcatatcaaaagcgcgggcgcaaagcaaagataacatcagatcaggtcggcgccccccgctcccggctgccgcaaagcccacccgatcgatcgatcgacgcctcgttctcctcctcctccgaggctactctctgcagggcgctcgcttacgtctgcctctgcgtacgtgcaccgcccagcgcgggcgccatgtcgtccgccgcggggggaggaggagggtacgggggcggaggcggcgagcatcagcatcagcagcagcagcaccacctgctgcttgggcaggcggcggggcagctgtaccacgtgccgcagcacagccggcgggagaagctgcggttcccgcccgaccacccggcggagtcgccgccgccgccgccgcccgggtcgtggccgctgcccccggcgttctactcctacgcgtcgtcctcgtcatcgtactcgccgcacagcccgacgctggcgcacgcgcagttggtggcgcatgggatgccgccgggggccgcgacgagcggaggggcccagatcccgagccagaacttcgcgctgtcgctgtcgtcggcgtcctcgaaccctccgcccacgccaaggaggcagtttggcggccccggcggcggcggcggggccgccgggccgtacgggcccttcacgggctacgccgccgtgctcgggcggtccaggttcttgggccccgcgcagaagctgctcgaggagatctgcgacgtcggcggccgccccgcgcagcttgacaggggctccgacgagggtttgctcgacgtagacgccatggacgccgcgggaagcgtcgaccacgagatggacggcagcgatcgcgccgtcgcggacgcggtcacggtctccggcgccgagcagcagtggaggaagactaggctcatctcgcttatggaagacgtgagtaatcgcaagctatatttgttgtttcatatcgctgcttctgtttttccaaagaaaatactatactagactttacttttgctaccctgcattaattaacttcatgaataagaatctaataacgaacacctcatggtcacatcatggatgcacttactgttgttgcacagattatttcttgtgcttgtgatttgatgagggttgatctggattagtgacacatctcttctcttttggatatatttttgttctttaatatgtctcaaatcaatcaacagttcaaggctcttttaagctcccttctaaaactagcaggaggtgatccgcagtttatctataatcaaaaggtagcatacaattctgtgaaaatgcacgatagaagctaaattcctcaggatgctcttaattacatcataaagaaaaattcagtttgctagtacttgataagattccagcagtttgtcctctttcacgagataagattcgttgagtttgtcagcagaaagattctgattatatagttactagtacatactgaaaatatgttgagcaccagttttttttatttgcaatggtgtcaaatatgatcctcgttccttaattaggaagcttgcgttggtgtagtgtccacatgatcgtaaagtaggtctgcacaccttgatgtattattaaacaattaattgggttacatatcgtgatgtcctcttaacagttacaaaaaaccttgtaggtttgcaagcgatacaggcaatactaccagcaactccaagctgtagtatcgtcctttgagactgttgcgggtctgagcaatgctgctccttttgcttccatggctcttaggacaatgtcgaagcatttcaagtatttgaagggcattatactgaaccagctgcgcaatacgggcaagggtgctacaaaagatggtctcggcaaggaagacacaacaaactttgggcttatgggcggcggcgctggcctactaaggggaaacaatgtgaattcgtttagccaacctcacaacatatggcgcccgcaaagagggctaccagagcgtgctgtttcggttcttcgtgcatggctattcgaacacttcctgcacccgtaagtatatgatataaatcatcgcaacagaatttttctttttaggtatgctaatctggaagcacataactgaatatgcgtattgtgcactaattggaaaaataaaaggaaaaaggactttatggtatatatactgcatgttgcatttttacaccgacaagggtgtacatggattcctattagtggagaattatccatagaccctacaaatgggtaatatgaaggatattgcaaccaaaccgttggtgaaaattgttattttgctttattgaaatcttggattttttttcctcctttagatgcattaaaatgattgtggttttagtgcatggtttacacaagtcattgttgtgcacttacaggggagtcttggtctccatcacatataacctttattgttgtttcaattttagatgtgattgccgttgaacaatcattagttgcatgttatgtttattggatacctgtatgggtcccaattgatatttggtttgagatgatactacaacaacttgaaagtgcattttattttccaccaatttagggcaaccattgtgtgtagtttctatccacacataccatatcttcattcttcttggcaacttctattttggtacagtttttcctacagtaaattcctccttttgtggccctgacgaaccattaattcatgtttgtactacatcagatagaaaatatatatagtagtacacagtttcaatttatacacgtggtcttgaaaacttcaatgtttactaatgcctattggatggatagtttactcgaaaagtgagtaccatcacatactaacacttgataattgtgtgtaccttcattttcattgtggttattgccttggcataatggaggagaatttttgccataggacatccaactgacttgctgacttgcacatggcaacaacctttttgctgtaatttaattaatttgttccatgcaataattgttgaaaatattgttttttaatctagaattctttcctatcctactacacgtaatgtgcaatgagggttggcttgttgtttatgtttagtttcatttgttcttccatattttgtatgtggtgcttcatccttgtgcaattgtgtatgtaccggcattctaatgttggtgcttgatttcaggtatccaactgacagcgataagcagatgcttgctaaacagacaggattaactaggaaccaggtaaacaaccatttcaagtttttcttttcccaaatttatatcgatgtaactagctagtccgctacagttgtccactagcaatatctttgggtccataatgttactagcgttgtaaaacattttgatatctcaattcttgagcaggtatcgaactggtttatcaatgcaagggttaggctctggaagccaatggttgaagaaattcacaacctcgagatgaggcagctgcagaagaatccgtctcttgacaagaatcagctctccatgcagcacacccaacattcgtcggacagcagcgggaagccctgtgatccatcaaactcgctgcaagggcaaagtagcagcatgaccaggaatcacagcatctccgcctcccggcacatcgaggacggcctctcccagatgccccatgacatctccggtcaggtgagcttcgcatacaacgggctcgccgcgcatcacagcatcgcgatggcgcaccaccaccaacctgacctcattggcaccggtggtgccgcgaatgctggcggtgtctcactcacccttggccttcaccagaacaataaccgagcttacattgctgagccccttccggccgcgcttccgctcaatcttgcccatcgtttcggactggaggacgttagtgatgcctacgtgatgagctcatttggtggtcaggaccggcatttcaccaaggagatcggtggccatttgctccatgactttgttggttgaagagcagatatgattgtttcaccaaggagatcggtggtgattattgtaggatgcagatgtatgatctacctatattgtagttggaagtaggaggtgaagaaaagaggggcattggcacgcctgtcgtagatccacgaatgcttgtcgatatttgacattgtggggctatagagagcatatgactatacctttgaagacctgtttgtagtgttgttccctatttgttctgatccgcggttaagccgtgttaaccctgtactattcatctgacttgcaaatgtggttgctcccactctggcaaataaagggtgctcagttaatttgtcgccagcaagatgaaatgtttattggcagtatacctatacagctgaaggccttaagcatcagcgtgtaggtctaaaatatgactgggtagctaaatatttcatcttactccatggttagcctttccatgtgctcctattaaactaagcaagcaaatgacagagtactaagctgtgctagatcttgtatccttagatggagtagaacctaaagtttagacaaaaccatgatttggccatctgccaacctttaactggctttgtcatcaccctaaccatatctgttagggctgagttgtgcctattgtaggttagcttttgccttgatcagtgcactaaacagctggccaattagccccatgaccatgatggagctagccaagcccttgttcttttttcacttctccccagcgtaaaaagcccatgttacctgggatcagttatccatggccctcggtgttgcagcatctgatttgatgtacactttggcaagcactgcaactagtactagtataactagcactgcaacagctggggggctccatgcacgttctttttcgcgtggagggaatccatgcacgtcaccgatcactactactactactacaactgctgctgctagtactcgtcctatacttctcccaaaagtgagcactgttcctgtttaaaaagggcactgttgttagctttcaattctaggctctggttcctgcatgggtagattattgcggtctgattctacatgccaactgaagaaatatgattccatgccttttccttcgtggataaagctggtagtaagagggtatgagctatcattaccactcatggaagctagcagaaactggagtttagctcagagctccactctcttcgtttgggagagagatgtgaaaaagaattaaagaaggctgcaagcgaagacactcttttctgtttggctactattaccactgatcattcctgaagtgaagctgagcccgctgtgaaatcaaaatcacgtgctaattcctcacatcagcagtgcttgagctcttcggtaatggactggctagttcaggatgatgagagctgtttgaattttggagcattgaggggcatctcgtgatgggatagagtttgctggttcagttgctttgttccttctattattgtcaaattttctcctggcaagaaatgacgggttaacatagcaatccacccaatctctatcatttcagtttgccaaggcaggtgtagaagaaggccagaaatgatcatccattgcagtgatccttgacgaaactgatactcctacattaccagcacaggcatccttttctcctccagcttcctgtacctccttcaagtacagataattattaacgcttttaaaatgaacctctcatttcttctttttttttctctgttaatcatgggccaaggggacaggagccaactcgaaaggcaaatggcctttttccgtagcctaatcttggagggtaatggggcggggttctcgttaagcatatgctctttccactcgttaagatatgggcgatttgatgatccgt

SEQ ID NO: 20767 - DNA, 6851 bp, Oryza sativa
caccaccaccaccaccaccaccaccgcttcttccttcttcccgcggatggcagtggcgcaacgtgcttttgccttggaaatgacatgcgctacagtcccgcatagaatatggattgcttttctcgggaaatgcaggcgatatggagactgcagtggagtaggagtactgaactgcagtgcacaggtgcaagtgagcgcccaagaaagcccaagtggattggcattggaggatggcttgttgttctgccagcctgcctaattagaatacggatttcagaactccttttttttactagtccagggaggcagggacaaccggacaactatgcggcattcgtttgagatttcttaccaaggtcaacgattcatcctgtaatttttcgttgtcgtgttgctataatgttatccataactaatactcaaactgacagctttaattagttctagcaaaaattaatattcaaactgacagctttaattagttcaagcaaaaactaatatttttagcggagctgaggagccctagtttgctctatcagccgtaaaaaataaacgaagcaaccagaaataattaaaaattgctatatgtaccacggtacgattttggtacgaccctcgtgcattattatccattggccatggaaacatgttgggccatatatttaaacatcgatcgcatgtcgattgttagagattttatcatatgtattgcagtgctcaaaatagtttatgttgaaacttttatactatttgagttcttaatgaaaccaatacttaaaattaaacttcgaccaaaaaaattcctcaaaattaattaaatttaaattttaactccacccgataagctaacaaacaaacgatacgtttgtagatgtaaacagagctagtaccagtatataaacttatgaataaaaataataataacagggagcgagtggtagcaagctctcattttctactcgatggtttattatagctttaacccaaaattaaaattaaaattttatcagggttatgaataacacatacataatagtagtcaattaagctcggcaggacccatcatatatcaagtcttatatgaaatcatatatcgtatataaaaggagttccggataagaaagaacaagaagagttctatatagaaactagattactcgaattgtatccatattggtctccttagttttacttggacaggggatatctatgggtataaatacaaggctccctagaaagagaggagacacggaacaatcagaatagacaacaatacacgtccccaaacatcgatataagagataagtctagacatacccaatctagtgcctacgaaggctgacaaaagggatctagtgctatctctgatcttgccgagtacgtattcgagaaggaagctagactacctcatcgtcgactacgtgttggttttccatgctgccaagtcgacaacgactagataggttattccaaatattgtacttgtgtgattctgatgaataagtcgacgacgactatataggttacttgtgtgattctgatgaataagagaaataccggcttcggccaatatgagtaggactattaactgattctaatgaataatgggcccgaacttatataaaaatccttgtctctgtctcttttatctcaatctcacatataccatggtaccaacgatccacataccatacaaataccgtagtcgtgatctaaagcattgacaaattttcaatttgatttcggggttctttttttttatcttagtctattttgccatctctgcttttaaaaccccagtaacataaaatatatataccaatttataaattagcatccatatgcataggtcaaaagatgagagccggccgtgttcatgtaaaaatcaggtggagtttacgttagcaataccatccggcatccaccgccttctacccagcatctgcgtgtttatgtttagatccatttgaaatggcaaatagtaaatgataaaaaatggcaaatagcaaatgataaaaaatggcaaatagcaaatgataaaagttttagtggtaaaagttttggcattgcaaaagtactagttggtgtttatgtttagatgtattctaaacttttgccattctagcactttttggtggagagagagagagagtagtcctaaaacacttttttgcataatttgctattataaactagcaaatggcaaattgccaacttttactactagtgtttagattcaaaatgataaaaggtgctctaaaatagcaaaacttttgctattttggaggatctaaacagggccgtagtgtgcttccgtaattccttatctgccgcatgatcgtgtacattatccctgcaaattttttttcgttgcaagacttctccgatatattagggttgtcaaaacttgacgcatacaataagctacttagtgcatgtacaatggtgtctaacaatgggctatcttcgttgccatgcaagtaaatttgatgatgtggaagaaagagagggaaggaaagacaaacatcgttgctatgcataacaatggctcagagtcgactcttagtatttattaatgggaagtttgttgcatgatggtggagaaaaaggaaagaagtataataaaaaaaatatttagtgcattaatgattaagagatcttactgattctactattgtatgaggatggtctctagtgacataaattaatatagaaaactcatatcagactctacctttatacatgcccttatagcatttcacagaaagccagatcatttttcgttggctggccaggttacgatcacacgaccactccgcagaattggcaacaagaaaccgggcccgcccgcggggatccaatttcccgcttctcgacggaaagcccaaccgaacacgcggcgctcccgtacacggggcaagggcaacgaagcaaaagcccacacctgcgcagtgtgtaccgtcgaacgcggcccatgcggcaacgggccgagctttttcgccgggccaacggggccgagctaacacggcgtacgtacaacagtgaagcaaacgagctcgccgtgctgcccagcccagtaataaacgacggatgaaaaaggctttcttgatagatgattctggaggcagctccgcagcagtaggcttggcaaggggagcaaggcagcaacggcttatgcgtcatggactcatggatgggttggcaaggtcgatcggtttcgatggcgcgcagcagatcgatcaaaggtagagcccgactgggatatggattggattccggttggatgagtttggataatgtaatttgatttggtaattatgttttctttaacgactcgcaatagacagtgtgaagtttatattgatagagtaggaaaaaaaatacaagattataaccctaggatgtcataactagggaaaaaagaaaaaaatgaccatcacccacgcaccgacagcaccaatacacatatctgggagaaggatagcaccgaatcggccatcgctaagcgtgactggccgccactaggccaacaaaggagttacaaccaggatcgcctaatgaccaccataacaaacgatgcaaaattacactctatccacgtcttcgggattgaggaagagggggtgagagagaagaatagaaccgctctcccctttaggtcctctgacatggccaacttgcataagtgttgacggtcattatagaccattttcgaccatcaacataactaaaatggaggagaactagctatgctggcaatgcatatctattttagaataatatattttcacttgtacttggagtatggagtattatttgtttgcatagattagcacataaatgaagaaaaaatgaagaaaaactcactcctaagcaagctcaaggaaagaggggacccacatgtcaggtgtaaccgtcctgaaacccacatgtcaggcccacctgtcaacatctctgccaaaattggaggcctgctgggtcagcccaggttcagccgaaccctggcagtggccgttcagctcgggcttacacgtggacgtataggattgcttgctaatggcggttgcggagcatttccgacatttcacatgctctacaaccgtcatacctacctatttaaggagttcttcatttcacttcactcgcacactcaagcaagaagctttgatctctctctcaagtttagtttagtgctctagtgctaagtggagtagaatataacagttctcggagtccttgagtcttcggaaggtttcgagtatggctctagtagtttttcttttttcttttgtaagactttcggaattaatagaatattattctttatatactttctatcgacgagtgatactcatagaccggatgatttgggttttggggtacgttggaacgaggatctacgtaatacgacatcaagcaaacagaagataaggattatactggttcaggcccttatcaggtaatagccctagtccagtttatatgaaattgatgacggaaaaccacatattgcaatagtagacgaaactggcgatactgtcgagatcgtagtcgaggtactctacgagatctcccagcgacttggttccgagtactccagcttcataaactatagtgggtgtgttggcgatgagattcaataccttgcacccctccctaggggtcccttttataccgtggatcatcttaattcccaagtaagactcggagacatcagatcttgtacgatataacagaaactctatcccttccgagtaagactttggaatttacttaacttgtagagatattttccataatttgtaacggattccaatgggaacaatctgcatacgtgaaggtatgccatatccgcatattccataagtcgtaggataggatgtatgccttatccgtaaccctgacactttcagtactttactttgcctgagtactggctttaatttatatttgtgccgatatagttgtatgactagcctaccagagaggtgtagtggtgtgggtttaatgttcatgcgaatgattgctccatattattctcgagtgtatagagtagtatttgataatcaaagcatggtgcttagattattagatatcattaattgggcatatatactatgggacagtagaggcgggtcgctgatggtgacagctcagtacgtgtattcttctacgttagtatatattcctaaggcactttcctaggaggatactcctccctatttagctccgattggatggccatgacaggttgtcgtaagaaactcgacaacccagggtactgctagggggtattggttacataactatatactagcaaatgtaaactaaagttgagtgtatattagaaatataaagatgattacctttctatctcttcttccacatagtctagaattatttaaacgagagaatctaagtccttctactttgtgtcactctacctttatgaactgaattaacccctacgcagactttgatacatacaagtaaggtatataacttattagcatatttctctgttataaatcttcccttgggattaaataaatacgataccttggaatatttctgggtgaaatgctacaatagtatatccgtgcgcttgcgaattgcttctgtaaccataaatatatcagggctattccgtgctgggaatttatatttctagtaatgtctttaagaaataccaacaataagctagggcgccgatataagaggtccgaaatctaaagacaacttttggaccggaagtctggaaggaaatcagtagggggttgccaagacgacgtctctagggagaggagtgacgaaacactgcgccgctgtccgtcaagggctcaaagtacacagagactgggttttcactcgacagcaccactagaggagatggaacggcacaacaacaccctcaaaagggaaaacgactagggatggcaatttcccccgcggggccgggtcccctgcggggacccgcccctacgggggcgggggcggggccgattttcaacccgtgggtgcgtcggggacggggacccgcatttaggcggggaggggacggggaactgatttcacccgcgggtgacccgcgggtgacccgcggggccccgggggtacatatagacctcaaaatatagatcaaagaaagcccaaaaagcccagcccactaaaaaaatccttaaccctagcagcacatccctcaatctctctcctccccacatccattcccttcccctcccgtgcggctgtggcgtgacctaggcggcggcgcgcgctcgtgggcggctcgcctttggatctcgccctctcggcgtcgccggcgcctgccagccgccaggccaccatctcctctcccctcctctccagtctcccctccggcgtccggcggctctagctcctcctctccctccggagtccgcggcggcggcacacagggcggcgccgcggcgggccggcggcggcgcacaggcgcggcggggaggcaacaccggcagcaagggcacggccggcggcacacagggctagggcggcggcacacagggcggcggcggcggcacatagggcggcaagaacacataatgatggatatcattaatatgtgttcttgctgaatttttatgatgaaattgaagtattcatgctatttttgatggtgtgtttattatgtacaatatttctttttgctgaaatgatgattgtgttgtattttttgagctgattggatggagatgctacccaatgcggggccccggtcgggttgcggggccccgcaggggtcgggggcgggggatgttttcaacccgcatcactggtcggggccgggggcggggggtgaagtcgggggtcggggt

SEQ ID NO: 20768 - DNA, 6055 bp, Oryza sativa
gtcgttcccaccgtcgatgatgcgtcacctcgcctcgacgcccgcgccaccgcttcacagttgcaccctaccgcctccacgtccacgctgcctcctctgcatccgcgtcaccgcctctgagggcagcctcccgtgccagggaggccgaaaccgaatctgccggcgtcgccacgccatcgtacgccacttctgcctcaggatgccacggtctgcaggcctccgcgcggcgcgtgtagcaccacagcgccgcgtccgcccacagctcaccggaggctcgttgacgctgcccccgcgcgcagcaccatgatgcagttgtcgcccacagctccactcgccagaggctcgtcgtcgcggccgtcctctcgcattggggaggccggatctaggcgggaaggggccagatctggcaggggcgctagatccagcattgccgcctcgccatcgccaccccagtccaccgtgacgccgacaccattgctcctcttcaacatcggcggccaggccgtcgcgccgtcactcctccttgcatccgcctgtcgccgctgcggctgtcgccggctcggagctggccgaggtcgttggcgccgaccctgtgcccatggaggagagagagaggccttgccgccgccgtccttgcaaccgtgtggttgccggcggcccgctcgggtagcggcgaggcggagggagggggtgggggtggtggcgccgcggcggcggtcgcctcccgtatcgcccctgcccctagagcgacacgggggaaagaaaaaatagaaaaaatgatttggtaattatggatagaatcctagtggaactagagttgtacacttataataagtaagatttttagtataaatagggagggatactatgtttttgagggtaagctatatttaagagattatagagttgatagctctttgtattatggaatgggggtgtatgtttagtagacggtccactgcaacatatgatggtccgatgtttttcgacctctcggtcatccgatccgttgttgcgtccttttgagtgtgaaaaacaaaatatgtgatatttctttcgtatacttcatgtttctagttaggcatataagagcccttttgaatcaaaggatttacgtaggaattttataggatttaaattctataggaaattttcctatttggccctttgattcaaaggattgaagctttccaaatcctatgaaattcctatggaatggcatattgcatgtagattttggaggaaatttatcaagagctccaacctcttgaaaaatttcctttgagtctatctctctcatccgattcctgcgtttttcctgcgctctaatcaaacgatcattcctatgtttttcatgtgttttgtaatcctctgttttacacttcaattcctgtagaatcctgtgttttttctatttctttgttttttctaccctgcgatttcaaggaggcctaagaggtcagggcggagcattttcctcgaggagaaaagagaaagagattaagatggaccatccatccagggggaatctcatcattcgacggccccggccggccatgccatccatcacacaccgttggcaacgctgggcagtagcagcctcccaaattggccaccgcacaggtcaatgacaatgataaagcctatactactacacagccatctgcatcacacacagtacacatcgcccaagctacaaccttctcccggatggatgcatactggacaagctatgctactacaactattctagacgactgctctagaaaataaaataacaaaaatactccggcctttggcttggcaagttgaccaccacatacaggtggctctggcccttggctcctccgaaagcctaatcttaaaattagattctggaagctaagcaagtcgattaggttaatccaacccggacaccttgctcctgccacatgacgattatattaatgcgtctcttggaaggcgcgtggcgctggtgcgatcccggtattactccctccgtctaacagcataaggattctgagttttgattacaacgtttgaccactcatcttatttaattttttttaaatattaaaaaatgaaaagttatgtttaaagtactgtaaataataaagtaaatcacaaataaaataaataataattttaaaaaaaaattaataaaacgagtggtcaaatattgcaagcaaaaatttaaaatctcttatattatagaacggagggagtattaaacctatcatcactactactctactcctcactagagcacaagcttagaacaaatgcttcagacagttacgagaatagccgtccgtcggatcagagatcaacggcggagattgccgttcgggtgtgaggtcacgatgactagccggtgatgtcgcgacgctgtgcgtgtgcgtggggaggtgtatagtttggtctcgaaaaggagaggcgaggaggacgccacgctccgcgcgagcatttgctgcgggagaggagataggctggcggtcgtcgcgtgtggcgcgcgcgcgcgtacgcagacgtttgcgtcgtttccttgcggatggaggcatcgtctgttgacgtactggttgatactacgacgctgtcaaaattcgtaaagtgagcggtgagcgctccaggttggaatcgtaaaaatatcttttgtgttccaaccgggattgacatatggaggcgtgaaggcatcaaggcaccatttcaaataaaagagtttgttctaattctcatgccaattggacagcgtgcataagagggaaattatgtgaggaacgtctagagatcttcctgctagctttataaggtggtgggctagacggtttagattcaaaacatcgtcctttctatttatttgatattatatcattctctaatattcgtgtttaagagggaagttatatgaaaacatttgagttttcactcttaggagggcaaggtttgaatgggtcagaaatgttcttttggtttaatttaccgtcttcttaattgtttttaggtaggagtacaacaacacgacaaacatatacggtttattcacaagtcttacaaatcgactgatttgatcggatactaagcagaacaacgtaaaaaatgaacgtggtttttcctttataaaaacaacttcaagtaaaatccctgcaaccacttaacgcatacggtgttcatggaatacgtcatgtaagactatggaccacatcagctcaccactcaaaacgagagtaacatgtacaccgagacgcgcacaatctgcagtgtgacagaggttaaccaccacaaacccctcaaccacattacagcagctcgcaggattccctgtccccgaccccatctcctccacgatacacacaatctccggcgaagaaaaatttctagaacactagctacaaaaacgttctaaaaacacaagcagcccacgcggactcctgtgtggactccacccacccacgcacgctgcatgccacgggcaggcgattagccgatacaattaacaacagcaaagaacaaaacaagaaaaaaaaaccgcggaataaagccgcgcgcaccaccaagacaaccaaccgagagaggaacccaactcccgcgattaaaatagcgattccgtcggaaccatccgctccgtggcccgcggggcccccgtgccgtgctccgctaagctaaaagccgcgccctttcgcttgcacccagcgccactactgctactgcgccagtattttttctatctattcgccgcgcgcgcgagagccagccaagccaaagccaaagcgaagaaagagcgcgtccgcgtcgtcgtcgtcgtccgcctgcctgcctgcctacccacgtcgcgctcgcgtgcgcgctgccgcttagtcgcgccaaaaaggcggggggaggggaggcgcgtgcctgcccccgatcgcatatcgcattctccactcgcttgcgtttgccgttgcgtttgcgttttgcgtagcaagggaagggagagagctcgtgcttttggattggccgcgatgagctgcgggggcgccgggcagagcgggtggctgctcgagtacgggctggtggaggaggagatccagggctccgacttcatctacatggtcgacgaccccgcggccgtctccaggtgcggtttcccccctcctgcttcctcttcctctctaacctacctctgctggtgtttgattcggatggattgccgtggattgcagcgtgctactgggcttcgacgttcccaggaaggaggacggcagcggcggccaggacaactctgcctccaagaaaaggtaggtgaaccctgataatttcctcttgttcttgctccgtccgtttcatattataagactttatagcattgcctatatttatatagatgttaataactctaaacatacaatgttagaaagtcttataatatgaaacggaggaagtaaacgtccgaacacttactccttccgttcaaaaaaaaaaaagataaacccatcgtggattcaaactcaggtttgtcttttttttttttgggagcggagacataattctgccaaagtctgatagtattgtgctatttctgctttgagttcgccggcaagttgtccggtttaattgagaggaaaagattgcagtaggtgaaaatagcctgtatgcatgactcactaaagttcctgattacatgtcctgttccccccatgtcgttgaatttaaaatatgatagaaagcatcatagagaatatctacagagtacagactacgtgcaagttcggtcgatgatagagaacaagtacatttacagaccttatttttattttttggatgattgggttgagggttttgttttgggttttcgtgttagctcgttgttcccctgattcaattaacttaagcagtccaagctgaaactttcaacaaaagaaatagaggctggctgttttgacaagcgtagtcgcccctgttttccccttgtgctgattcagtggtttacagcatcaagtcaagggtcggaattagctaggaaagttctactaaatcacggatgttaaacgcctaatgcattcacaattcacaaattctaggaccgtttctgcttagttgaaacccatgaccctaacttaccttttgttcttctaccggcagatctcgtccagaatcgagcgcaccgccgggcaccaaggcttgccgcgaaaagctccggcgagacaggctcaatgaaaggcatgtttcacactttcagttacatcacgttcaaaacaaagaaacttcaaagcatttgccactccaaatctgacgagcggctgaattatcttcaggttcaacgagctcagcgcgatcttggagcccggcaagccgccgagggccgacaaggtctccatcctgagcgacgccgcccgtctcctgagccagctgcgcgccgaggcccagaagctcaagagctcgaacgagtcgctccaggactccatcaagagcctcaaggtaagcagctgacacacacgttgctctcccaactgactcgattcacctgaagaaatgagagctgaggagttcactgtcactgcaggccgagaagtcggagctgcgtgacgagaagacgaggctcaaggccgagagggagaggctggagcaaatgctcaagggcgtcggcgccgccacaccggcggctccagcgccgttcgtcccgcaccacgccgcggcggtggcggccgcaccggcgtaccatccggcggcgttcgcgcaggccggcggcaagtacgtgccgtacgccaccagctacgcgccgccggccgcgttctggcagtggataccgccgacgtccctcgacacgtccaaggaccccgtgatgtggccgccggttgcatgatcagctgctgctgtcaccgaaaatgccgtagaaattgaccaaagagcacctgatgaaagcctcgggtgcagttatgtgattgtgttgtggataaatgatcaaggatcaagggatcaccagaagaaatttcctggtgatcattgctcgccggagcagtctatgtaacaacccaattgctaaagtaattaaggcaattattattacatcaagatggtg

SEQ ID NO: 20769 - DNA, 3424 bp, Oryza sativa
tagaagaaaagctgaatctgctagtagtaccaaatatatacatccacggtgatatgtcctagcatgaatgagaatgtggtatacaaagttctcagaactggctgcgttcgggaggaggcacgcaaaacaaagcatattttattgtataattaattaagtattaactattttttaaaaaaatagattaatatgtttttttaaaacaacttttatatagaatttttttataagtttaacagtttgaaaacagtgcgcgcgaaaaatgagatttgtgagttaggaaaacttggggaagaacacagcctgattttactttattacaacattggagcagcggaacctccaaaatattgctcagaactgaatttatttgtagtgtcacgtttgaaagcggaaccttctcagaactgaaagcggaaccccacaattagtgatgtgtatcagaacaaaaggggaagctcaagtagagcctcagctgaggaatctatgctaccaaatatatgcatccacggcgatatgtcgtagcatgattgaaaaagtggagatagcaattagtatatgtgcaatcacagatgttagtatcgctcattacaagcaacatagcgcgttggtacacaagttctcagaactgaatttacttattacatggagaagctgaacctccaaaatcttgctctcagaactgatgaatttatttttggtgtcacatttgaaagtgggacccccaaaatcaataatccatcggaatgccgcaataagatgcttgtacaagatgacaaaataaagtagtcaatccattcttaaaaggatattcacctactcctgaacaggctaaaaggagcatttgacctgcaaagtagtttcaggatgagtttatttatctccacttctctaatatataacatataaaaataagaaagagtcatatagcatatcatatgactgaaactgtttttattaaccaaactgcaagtatagcatatcatttgagtaggtaaacatggtaaatacactttctgtgaagaaggaaatcttgagaagatcacacattcaaagcaataagtgtattacttgcctcattgcaaaggaagactcttatgggtgtacacgacatccttgtcaccattcaccacttgcccacgccctcgcaagatcctgcatatcaaaattaatcataaaaatcaccaaggaaaacacgtcactttttaaccttctatacgatccaaaagcaacatataaatgtatatctaacataaacggggtgaattgccatacaaaaggcaagatgagatactgcaacagagacgattgattccataccatcgtgtagttaagagaccttcaacacccactggtccacgggcatggatacgccctgtgcttatgccaacctattcaagatattccaataagttcagcaattaagaaagaaaggtaaatggcatgtaaaatttgaagtacctcagcacccaatccaaaacgagccccatcagagaatctcgtacttgcattatgaaatacagcagcactgttcaaattgagaagtagaacagaacattagttaaacatccgttcatcataagttgacaggaaaataattgtgcatcaatagggaacaaataatgtaaccattaagtaataagggaattaatgtttaaacatacctatcaactctgcgtagaaaagtctctgctaccttatcatctgtagtgacgatacaatctgtatgagcactgaaacagatagaatatggaaatttgggttacattgaatctcattttttgtttaagaaaacaactagtactatgggataagggggagacaggagtcacaactattaggtaccttccataacgatgaatatggtcaattgctgattgaacatcatcaacaaactcaacagtgcaggccatagaactatactcatgatgaaatgaaacagcttttggaaatcccagagctttgtgcgcaataggtccaccataaatattaactcctgaaatatacagcattatctaagaagcagggagaaaatcatggccctgtatatacaagtaaaaaacaatccagtatccagaaacatactacatctgtgattatgtcatgttactttggttgcttttagcatcgaagtagtttctatatacatgcttgttaaccaatcacaatgtaaccaatcaaacttggttggaaattgttgccataagagaagggtcgcgtttgtattcatatattttcaagattttttgttgtttgtaatggtatttatcaccattaaatcacagtggttggtaatttaaagttgcaactgtttgtgatggtattgagcaaaattgcttcagaggggagccgtttctatagtataagagagtagaaaaacaaaccttctgtttttagtgctactaatatgtcgtcaaggcctggactcttcataagatccttatgaactagtaaggtctcctgcagaacatacatgtaaaataggctgttatctgaatataaaaaatggctacatgatgttcagaaaaattataaggtggaattatcaacatgctgaaaacagtagaagactatcaagatatgtagctaaattttcttacaaaggaaagaggaagttactactttgtaagaataagcattatgcaatcacaatataagtagttataaatcaatttaaacaattcaaaagtgcagttataactatcatctatcaataaaaatagtttgcatgagatagaagtggaggggctgtaataatctcaacagtactaaatgcatttttcagatgccagagaagaattgcaaccagagcatcatggttagaagagaatttgaaattgtccaaaatattcagtgaaagatactccaaaaagtaactgaaactgtaaaagcaatctatttgaatactatacacggtagcaaactggatagataccattgcattgcaggctgctgggtaatcaatttttgcatccattacaatatgttttgccatatccatgtcagctgatttgtcaatatatacgtggcatataccatctgcagtggggaaatatggaatgtcagaaatagcaaaaagaaaaaaaaactcaacatccaataaagccataagagtggtaagaacttaagttcaaacagaatttaccagcatgcccaagaacaggaatcttagttgacgccttgatttgagagacaagcttattacttcctcttggaatgacaagatcaatgacatcatcaagctgcacagtgtattacgggtttagccaaattggtagtatcaacgctttgaaaatatagaattgcatacacacctttagcaaatctgcgatctcatctctagttgtaacaaggccaataagtttttcaccaacattacgaggaatagcatcagttataacctagaaaagaataaatcgatgtt

SEQ ID NO: 20770 - DNA, 17287 bp, Oryza sativa
gcaatctaacaacaatgacacaaaattagttacttagaagtatatgtattctggaaaagaatggaacacagtgcattgccagaacaaaatacctgaaccaaggcatcaggtcgggactcaaaaacaattaagagaacacctaatgggcaagatgttttctcaagaactaaatcatcagcaacctggcaaaggggaaatctttttgttaaaatcactatggatatatcatctagaatctagaatttctgtgaaatctcatagcagatttctattaaaaagagtttctattaaaaaggctggcattcacctctgtctttttaagtatctggtttatagggtcttccatatttgcaagggtacgaatagattttgcaaggcttgctatctgcaaaaacataaaatataatatgagttaaacaagacaacatacataagaaaagagaagtgtcagatatttaacaaatcagttaatttggcaaggaaaatgaggggtccacctttcctggttttatagtcaatctagcaaccaaaggcttctcatatccagcaacttgggccgcagctacatcagcttcattctcagaccttattaaatcctcatttgcctccaaagcatctgcaacatctagcaatatcttttttcgttcctctgatgacaaattctgtttcaaacgaacatatggtatcagactagtatcacgggtgagcaaaaatagtgagctaaaacttgaaatagtgtgtaactccactgggcataacagagggacaagaattacgtatgatttgacaaagatatatacctgtagatgccttgaacaatctcttgcggcaacagccatctcacgagtactaacatccttagatgattcccacaaattcgcattcttgtgaaagagagtaccaattttttccccatgaagaactttaagaatgctccgattttcaaacccacttcaaggatagaaaaaaataaactatttctccattcattaagaagataaaaatagcttgcaactcatgaacttggttatctcagtgataattagcttcaacacaacaagataatcatttgaatttgatgtgcagtacattacaagcattaaatgtctgaaccatcataagcaaagtttcaacgtaacatgcaaggtcatataggtctcaaaacaaatcatttttttagcgtaaactaggggtgtttaaagtcagaacagctcatccattaatgccacgaagctaacattcaagcactggactgcatctcattcaagatgttataattgaggccaagtggagttgttgggattggatgtcttgtaggacttaataatcttcacattagaaataaactcatgcaaaaaaatctggcaatgacataatccaaccagaacacctgcagatggtactgattgctagttgcacttgacaggaaatttgacaatacatatataatggagtgcatctgattgatgctagcagtcatatccattatactctagggaatagattgtttaccttgtaataaccacaggtgtgccgctatttgaagccaagacagcagccttcacttttgctgtcatgcctcctctacctacacgagatttgtctccaaaagtgatttcttgctgatgcttttctttaatataagtgtgtatgatttttgatgatggttcacttggtggaccactatacaacccatccacatcactgagcagaataaggagatcagctttcagttccagtgccaacagtcctgctaaactgtcattatcccagaatataccagatgaatcctgtaaaagaattataggtgagtgtggttagaaagtcatggctatttgcatatacactgacaaggccctagggctaggcatacaagcagtataacaataagtagcagctaaagagcagcaccacgcaaaaactgaagtttcatacttttccaggagatgtatggtatgaaacacacttacatacctcatatggagcctttctagtgctgatggcatcattttcattaaatattggtataactttaagatctaataatgactcaacagtttcagtgagttgctcccggaactttgggttctcaaaatcactgtcggtgacaagaagttgagatgacgagacatccagctgcaatgcaagaagttcaaggttacaaaaagatacaaaaagtaacctattcatttttgttgaagttgaatgccagactaataaacacacttggttaaacaacatatcgtaaagagccatcagtccactctgaccaacagcggcacaagcctttccatctaactccatctgtggcttttgcagatcagcaaagctgctattgacaagcttccggtacctaagtcgctgtcgccccactccaacagcacctgaggtgaccaaaatcacttcgtatcctaaagagttcagttccttaacctgcattgccacttttctttggttaggcacctgccaacatatccaacactacatagccattgcagaacagctcacaagatcaaaaaaatggatttcttttacctgctcgcacagagctccaaccctgcccaaagccaatcttccatcttgtctggagacaactgcagtgcccacctgtcatgcaaaaaaggaattagccgcacagagataaaaacattattattatattattattatgtactggtacagtggtacatcttgtgttgaaggtattgcgttgaggttccacaaaactgctaggcttttctaaagcctaaacgcttttccaaagcctaaactcaaaagcaacggtatttgattctacattattcgattctcatcacctttccaattcagacattatttcaccagttccgcatattttttataaaaaaattggaaaaagcatgggatttgaacaaataaaaagtgtcacagatgaaacaaacacgaatttgtgagagcgatcgcaagggacagaaatttgccgaacgctccaatataagatactatgtctcttttctatttctgtgccattccacccaccaattcccatctgacagaaatccgctgccccgcagcgaaatagccaacagttttcccatgatgatgcctaccagagtcgaaagattggcaacttcgacataggccgtcacatcaagtaaaccacagaaaagcccaagcaaagccccactcctgataatctaacaacgagaatcccaaatcaaacgtctctcgagtcttcaactctgaacaaaacactcgcccggtaaatttgatccagaaacaatctcacgaatacggagaagaggagcgcaaacaatgcaaacagcgcccaagcagacgcgcacgaatcctcggaaactagatctatcaaggtcaatccgtgacggcgactcctgcgacccagcggccaaacaaaaatcaccttgatgatgacgcgcttcacgtccctcacgaagctccgggacgggtcgacgctcgccatggcgaaaccgcttcctagcctcagcctctcctcctccaccctctccctctacctgtaaatccctctcccacgtctcgccgccttgccgccgcagccgcgagtagaggggggatagataggaggaggagaaaagaggaagggtttatgaaggcagaagtggctctggctcccgtgaccggaaaggcggaaacccagggcgcaaaatgcccaacgacccccgggatcctctgcgcccgcgcccgccacacggtatgcgtgttactgtgacttgttaagctgttaaagctgttaggtggcggcgcaccgagatacaggggggaatggggtcgttggcccagaccgatccatccgtcgttttggcacgagaaaacgtgagccgctcagccgcgcgagcgcggataagccggggaatagatatccatatcccggtgcggggggcgcctcgcgcgtgcgggtgcaggtgtatggcgcgcgtgacgtgcactgtcccgatcgcgcggcggcgacggggcggagcgttttgtaccgtgacaactgacaagcccggatcggacgggggggcgaatgggctcgtcgcacggggagcggcggcacgccacccagaccgatcgatcctgctagaatcgttgttttggcacgagagaacgtgaggcacgcatgcatcgagcaggggccgccgcgtcacggctttgggagaggatttccgcgcgcggatgagcagccgggatatatgcggtgacggtgagccggtgcgggtgcgcgcctctatcgcacgggcacggtgcgtgcaggtgtatggcgcgtttttgcttgggtgagtttcgtgcagcgatcgatcgggcggggaggggaggggggccgggcgctcgtggtggactctggactggacgtctggacacggcgctaccacctagtactcctacagtcctactagtactacgctacgcgctgcttcgctgtgcacgcgacaagagttttggtagagacgggagggaatctgccgcggtgtgcaagccgacgagagaggccgcgcagcggcgcaggtgaggtgaatggtgatatgcctgacaccggcgggcggcaacgagatccacttggagcggctgatttggcatttctcggtaaaccgcgacaaaaagtcgcaggactttgctcgcgtcgcgttgaaggacgtggcagcagcagcacgtacgtcgccgctcgacgactttacgagcggagagtcaggggctcacggtcacggtattggccgcggtggaggcgcagcctcgcataacacggtgccattcacgaaagcgtaccgtgggttcatgccctctccatttaggcccggtttcttttaacttgggattattataatctaaattattaggagtaagttgaaagaaacagacaacttattaaagtagtttattataatttaaagcctagcttattataatttgataagctcatttagatgagcttttttccagattatttggtgaaaaattacccaccataccaccccactccttctttagacttgcaaatccaataatctaggctctaataatctagaaacgaaacaactaaccgcttattctactacagattataacaatctagcttatagtaatctgacctaataatctagattataataatcttaagctggaagaaacagggactttaataagcttactagttaatatcccacgctttgctacagaacatattgatgaacacatgttacatattatagaaatggtacatgtatacgtttaaataatataaaaataatgtgaagataacgacttggcattgcttcgatattgaattatgaaaataaaacaaaattataaaataaaacgtatgtcatatttacatgatatttaaaataatttaaataataattactaatgggtgatgatgtgacgcacttgtatgtgatttaaaataccatagataataattgctaatggatgatatggtacacttgcatgttgagatttaaaagttagtgggcatcaactttatagcaaaacatgggtatgtttcattaatcagtaagtagccagaaatctaaaaaatattatcgataagcgctccaacgaatccaactttttaaaaataccatcgtataagcacatttatcccaaaaatataatcattgttaggttttcattagcaattattcgttaaagtgttataaaaagatcatttttacttctacgaattgttaaatgatgattaaaatttttgctctttttattagcttacattaatttggaattaaatttaaaatatactgttcatttgggtttttttaaaaaatattcgacagcgaacggtctcgctacttccttccttgtgcgacagcgaatgttttgcccagtgagctgttgtttaattagtaactaattacccgattaataattaattagtaattaggaataattattataattaacgattaattgataattattaatcattaatgaggataattaatcaatttgaatgttcggtctcgctcgccggtaatgcgagagcgctcaatttaatcatttccgtgcaacggttcagcgagatcgatggtatattttcgttaaacaatttgcataccgaatacttttttaaaaaagccaaataaacagtaaatttttaaatttaattccattaatttgtatgttgctatttatactaaattattgtaagttgacgtaaatagcaaaagtttttatcagcttttaccattttgtagggttgctaacggaaacataacgaaacccgccgtagtcacctccttgccaccactgcctcggtgccagctgtgtcctagcgacaacggcaccatggacgacaacaagctccaccatggcaaccttcctcgtgccgcccattgcgtggtcaccacccttgccaactccgcccgttggggggccatccttcggcctctgctctagaccgctaccgttgtcgggtcttatccataacagtatagtggggtggctttgtctgacatggcaatttgacccaagtcaacaacgctgagtcattgtggacaacatatgtcacaacctcttacctatctctctcttcctcccctattcccatctcagcggtgcctggtgaggaagacgacgtctggcggcgggtcgacgatgggcggaggtggcaatgaagggactacggcgggtacttgagggacctgttgtgtctgatatttcggttgaagatgaaaatcgaactaagctgtcaaattaagggtcctaaaatgaacttattcaaccacctaaaccagtccgatatcctatttgccaagctcacggcccagtacgcgaacccgtccgtcgtccgccacggggccaccacgccgcccgcaccgcacgcgcacggcaagcaagcgaaccaagcgaagaaaagcacacatattcctctcctccctgttcgattcccctcctctccacgcctccgcggtgtccaaactccagactcccccaaaaaatcccccaaaaccgaagggaaagaggaaaaaaattactcttcgctctcgcgtcgcgcacgacacgaccgagccagcaaagccgcccatccgccatcccgccgctcctgcaatctacagccgcgtcgccgcttgtccgcctgcgctcgttctcgctagggttcggaagggggagggtggggatcgcccggcgatggactggagcgcggtgacggcggaggacctggtggacgcgctgcgggaggtggactggtcgacgccgccgcgccccgtgccggagttcttctcccgcttcaccgtcccccgctcctactccaagtggaccagccgcctcaagtgcaacctctactagtacgatctcccttcctcacttcctaattgcccgtcccacgatttgttgggaacttgggggtttctatgtcgagattggcgttaaatccgagcggatttgagcgcggagcccgattgttggtgttttcagtgaattagtagtggatcgagcacttcttttcctctctagccagtagaatagtagaataagggtatatgcgtgcgcatcgagacctattttgtggtttgatagcccaaggaaatggtgttgtaacgttcaggtaatgtagccatatagtaggtgaatccaacatcgtattatgctcagcatgttcaatggggacaaaaggaatcacataaacggccagtatattaccttattaggctgtgagctagttgtttcgaaatttctgatgaattcatagcatgcgaagtaggttatgcttgtttgtggcatatgatatgttggagtagtatttgatgaaaacacaaaacaaggtttgtaggtttagcttccccaggctaccatcaactatcggttctaattatgttatccatgatatcatgatcttcagcatatttatcatcaactatcgattctgcttagtggcaattttagccaaggcgctaagcgctagttaggcagcagaccagcacctggcacctaattggtgatcatgtggacctaagcaggattggccagccacctagtcaggataactcaataggcaggctaggcgtccgtatatgcaaggaaattgtgcattttgatgtaagagcaaaatttttaattgttaggttaacctgaatcttatttcgttttgtacttgttccggagatgctgggtgttcttgctggagtgctgtactccatgaaatccgtgagatgaacagggtgcattagaatttttatttatttactacttacttaaaaatcagttgaacacagaatctcagattgaagatggtaagtggtgcaaccacagtttttgctgtacttaatgttgagacattaagtgtttctgataactaaagtgattggcaaagtagtgtttctgtcagaaaacatgccatgttgaacatacatctaagtcaaatgttcaaagctgtgagtacgaaaatgttttaaatgtttggggtttgggtttgatacataaaaattcatatctgtagatttatcttgaaagtactgtcagatatttccataaaaaaactttcagatactagagttttattgggttttgcacatattttacgttataattttttgctttttgtattctggagaacgtgcgaatgtccaaaaccacatgttctcattactggatgttgtattaactatcctcctaaaaggcaccaattcatgtgttcagactttttacaagttcctcacgacagatttaagggttgtatagttatcattttatcttgtactgaatttccctcatttatttggtctgcagctacaggacaaattacttcatcttgatcatgttcatccttggtaggcaaaaaaagcttgaatgctgtctcttattcctcattcggttgattttgacatgctgcctttgttatatgcagggataggcttcatttggaagccggttgctatacttgcagcctttatgactggaatcagcattgcatttcttaatgacaggtacaatttacttaactactctctccgttttagaatttaagatgttttggttttgtactaggtcaaacttagataagtttgatcaagttagtacgaaaatgtaataacatctacagcaccaaattaatttcattaaattcaacattgaatataatacaaagccaaaacatctaacattctggaacagagggaataataccatcctttttctctagaaaattcttccatttagatgagtaaagaacaatattttgttttcttaacaaaggtagtgtatctttgagataaaacataattacatcaaatatttgtctaactgtcctgaaatattgctaaggatgtgttgtcttagcactacttccaaaaggattagtgaataatacatctgcaggatgtttttccttgtatcagttgtgatacagttctcaaattccttagtcatctccgtacattattttgtgacaaactgacactgagtgatttacactttgatcataggatgattaatagactaattatcatgtttgatacttcagctttgcagtcactttcaatgagaaagtcacgaggactgtcagacaattttcaccacatttagctgcaaaaatgaggccaccaataacgtgaggattttaatttttcatattctattttctttattttgtcgtgattcaccagagtgtgttattaatactattctcaacatcatcgacagccctgttcttcgtggtagaccaagttcaaagaggtcgattcatatttgtgggcgacctcgctggctatttgtgctgttattttctgcaggtgtgcaccacagcaaattgtcttcgtattatcttatttcacataccatagttttgaaaacctgaagctaatgctttttctatttttatttgcagttagttgcatgctctggttgacttcctgcagtctcctcacagttctatgggcccttttaattgctatctttggtaggatgattgagattttgaattttcaaagatagatatacatcttgggactgcacttatagttcttttttttgtttttttgtttgcagcaactctgcttcatgctagcttcagaacacctaatctgaaagcacgtctgaatacattcagagaagaattccgagctgtttggaggaattatagtgagctttaaggtccgtgtgtatctaaccctacgtttgtgcaggacctcagtttgtctatacctaatgctttatgcgccatttcgtgttgtattgtcactatttggttaaagttggttaaaacttggagcttgtttggtttctctatgcaggttcatgtggtaagaagtgcttagtgctgaaacttcgtgctgtttgtgaattgtgtttgtgggagataccaagatatgaacaatggtgacaggcagctgcgttctattgtgattacttgctcgttttggaggtgggccttgactgtctaagtacatgatgatgttacacttggtacgccaccttccaaatcactataattgttcacatggaattctccctaaccaagcattggaaaaagaacagcatgtaaaggatgtaaacaagtattctaatcaacacagcatatattgtttgttgaaatgtttgtttcatgtttcccccagcagtttgaaccattctagataaattcgccaccaaatttttcggttgcctctcgggaagtattagatcgtgaatgttgagatgaagcaagatcgttagctaaaaacagcgcgtcagcttcttcaatcattaaccatgagctattcgacacaccaacagtactgccttgcacattgctttattactctgattggaaaaggcatcgtcaacattttttcccatggagtatcaagaaatctgtaagatataattgaaaacattaaacatgcatattcccaacaaattgtaaacgtggatggacgtgaactaatcctatattcaacatgacaacacaaaatggataattacaaaacgataagttccgaagggagaatctcgaacgaggcaatctacaggtgaacgtgaactcgactgttcctgactcccaagtcaaaagcgctcgaatcctcggaaatttcagcttacgccaatccctctcgtggaggtagaacagcagctgcgataattagcatagttaagtcgcgaagcttctatcgccggcatctcccaaccccggaactatgaacctgtgggaacaaataagacatggaagttattaaaatccactgaaatatggtcacgacctacaggcacgaagcatattttgcaggataagcagataaatagaaattcataagttaccctctctcatcaacttcagaatcaattgttcccgtgtacacatgaagcctagaacaaaaaaaatcgaaaaaaaggtaactctatttagtaaacaagaggaacttgtcatgcacacaaatatgtcttgtgttatctattcttacccagggaatttgttgctgagcttttgaagcgcaggaggcgctgcaacagcagaaacctgcatcaggaatacaaagaagtgtcaggttgatagaatggacaattaatacccgaaaacatgtactccctcctccgtttcacaatgtaaatcattctagcattttctacattcatattgatgttaatgaatcattaacatcaatatgaatgtgggaaatgctagaatgaattacattgtgaaacggaggaagtaagtttaatgaacttacgactttaatctgcttgcttgtaactccacgttcaaccaacaagtcaatagcagcaacaattgtcccacctagaggaataggaggaataggtcaaatgtatctcagggaaaaatgactcattatagttatgataggagaaacattctgcttacacaagaccaatttatatttgtactagctactaacaccaataattaggttatgaaaagttatatatgcaatggtacaatccacgaactttgcagtatggtctcaaaaatgctatagcactgcaataaacagagcaagagtgccacgagagcccaagatttagcacactggagcttagcatttgaccacaagaatcacaacaatcagctgtttaaaatgggttcatgagacactaaactaaaagagttgcaaaagcaaatcttagtgtataatctatagtctaaaagatcataaacacaattgtttgaagttgaaaagtttgtggtgataaaaacttgctggcagaataccatgtctcacgtgtagaccaatgaagggcgttttgttttgtgttagtgaagcaagccaagttaaggagtaggagtatatgggatgaggctagaacagaggcttcatgatttgagcattatatatttgtcaaacattgcatgaccaatccaattcgttttcaactcagttgtaaaggagagatgctgttctttcctaacagaaatggagaatattcaaattctcatgcctcaggcaacacattgactttatgccacatttggcattcctcagatgtattcagtacttgagatgacactctgtaatatgcatgtaacatagaacaagaaatacatttatcgcttggttttgaaattgcattgcttattcaagttatttattgctcttgtgcatacagagcttgtgaattgcaaagaagaaccttaggcagcacataaattgttcagaagagctaaaaattaccagtggccagcattggatcaacaactagcacacgagtcccctctggaatcttgtctggcaagctgcattaaattagagtggaaaaggggaaatgaaagttactggagaacaccaattggcctggatatttaaattctttctgaacaacaaggaaaaaacagcaaaacagctggtatgaaagggaaaggaaatttattatcacaatccatcattcttactgttacaagtcaccagtatatataatcaagatagcctaggtttctcctatagtaattttaccacagaactaaagaacgccaagaactttgcattttgtaatattctggaatgcaattgagactagagcctggccatcaagcatatacacttttgtgaactaaaatcaaggatggcgatttacaaaagcagtatgaaaactagatgtttgcaagaagagaaggaacttagcacatacttgttcagatatatcgaaggttgaagtgtttcttcatccctacgcaggccttcaagttcagtgagacagacagataagaataattgcacatagttttgaagatgtatgttaatttggataagtagttgacaaagaactatgcaatattggatttaagagacatgcaaataacttcgattagatttcttttcatactagttgctaaatgcaaaaaaaaagagcttatttttcaaaaaaacatcattagaaagcagaataataatgtggcttggttgaagtagaaaatatctagggtctattatgcatatttcaactttatgtttctggcctcatccatgcatgcatatccagcattggtacttagggaactaaaacaaatgagtgattttacggctcttgaagaggtaccacattttctactgtaaaatttaataccctctcgatacctccggtactaggaggtaccaaaatttacattaaaaatattggtacctctcggtacctctcaaggactgtaaaattactcaaaacaaattgggttagattgcatgagtgtcaaccgtgcaatctatgtaacagctatgtgagcacaaaagttgatatactttatacatttgattctaattcagtaaacttcacataaccaacttaccaaggtgataagtcttggtggctggtagaactgatgaagcattttcagccatagcaagaccagctcttagtatcggaacaacctgttaaacatgctaatgaaaagactaaatatatttgtagaaaaaacaaatgccattgacacatctaacactaaggattagatttaccatgacaggctctcttgggtcaataaattcaacacttgaaacagctacaggtgtttggatctctcctgtgattgttggctgcaaaagttttagaacaatttagcatggcatcattctctcaacaatgaaatgtctattgactggcaaataaaaatcatgactaatatttacacttttttttatagagcaatatgcatctgtcaaagttgaaatatgtgtatatgaaaaaaaaatgcaaaaaaggcgcaaaatggaagcattatgagttacaataacaacttaagatatttgtgcattcaccgttttacaaggtatcaattatccatgcaatttcaatacttaggcacatatatcccttatatagcctaatttcaacttccaaagcatcagaaatgtaagatggatcctagaaaattaacggataaacgatcagccaagcgagtttcccactcaccagccaatctctggaagcttcatatataagcaaccgaccaagctccgccatggcactctctaccacaaaaacagattgctcaatgttatcctatcaaaactttatcgcaacaattagccaattaaatcagctgtgtaaaacacatttttcgtatcgccatcacttcaccactatcaagtatcaacacgctaatccacggcttcgctttaacgaattgtttcagattccacgtttctcagtaatactatcaagtaccaactcatacgtcattcagaagcacactcactgaagatggcgcagggcgtctgctcgttgcgcaggacggagacccagtgctttatcagcgggtgcggcggcacgaacacctgcgagacaaaaacatcacgaggccacccactttgagcttagcgcgcacgtgcacaaacgaattgacaaggacaagcagaggcagcgtcatcgagagagagagagagagagagagagagagagagagccagatccgcaccagcatctggccgccggaggagggcgatcgcgcccccgtggcggcgtcggggctcgccgctcttgccgccgtcagaggcgctcttggccttcgttggacgagccgcaggatgggggcggtggcggcgaagcgcgtggacgtggcgagcgcgggggaggggagggaggaggaggaggaggaggaggcgtgcgcggattggcggcgtggtgcgcacgggccgcggcggagaggcgctcccgctcccgcggccgcggccgtggcgagcgacggcatggcgaattggcgaaggacgaggtgcggatgcgggggacgaaagcgagggcagtgaggtgagcgaggtgtgggatacggtggggtcgtcgctcttgtgttctgacgcaaatctcgaggtgctctcatcaccgttcagacttcagaggcttcagccacgtatgtgttgggagtttgcgataatttttggaaattggtgatacccgacgtataaagacaacactcgatatctaaataatactacctccgtcccaaaataaatgcagccgtagatatctgtgtccaacgtttgaccgtccgtcttatttgaaaaatttgtgaaaaaattgaaaatatttagtcacacataaaatactattcatgttttatcatctaatagcaataaaaatactaatcataaaaaaattttaaataagacgagtggtcaaacgttgaacgtgaataatacaaaactgcacttattttgggatggagggtgtacatcagtatattatattaaaaaataaaattatttgtttggtaccgagttcactataatactcaatataaactggtagaatatgtgttaatcaatgtacttcaatttacacttaaaatattgagacaattattatataggtcacgtttgagcgggataatgcctattaggtattaaaacttaagcttcgtgctggcccttaagatagtgatgatatcaaatcacatgcctccatagccatctcaaactccacatcgctatcttagtctcgtcgaatcccatgttatcgcaatcctctcttctcattgagcttagccagattaatgttgtcggtggtggctctgctactttcatcgtagtagggaggaggcggttgggtaggaggggcatcaataaccatactctatcaacaaatcaacgttgttggtggagagaggtcaagcttcggctccgttacatctgctgtgctcggttgaggaggcgacgacaaattctgaacttgattttggtggaggcggtggagcctacgtctcactcgccttctcgcctctccatacccactcaagaggatactgcatgaactggttccctagtattcctatgaaatgtttaatgttggtgtggacagtgataggagctctagaacacatacaaaatgaccattttatcttacatgtatttgtcaaagtagggtaaaaaagacaatggataaatattgatcacaacgtcaaactcgttgagagtttgagaggggaaaagaatgctatacgatgattcattatatcaacaaatatgcgatactctaccgaatataaaaaaaaaattccttagagatgatcttccacagagttcgcggcataatagcatataatattgttttgtataagctgaaattctggctcatctatatatacgtgagacaaaatttttagcgcaaaaatggaaaaatcaaaatccaacgcgtagatagataggctcggcccatccaaaggctttgattggctatccccaacggcgatagtgggccaacgtttttgtgcataggctaccaaatctaaccgcggcaccaacacaccaagcctcgtgacacctccttcctctcgaagcaaagccgaggacgtacgacgacgacttccccacggccagagttcccctctttccccttcccaatcctccgatctcatcccccggctccggcgacgcggcggggcgatgcgtagctgctgagcgcgcggcgccacgaccccccccacctcgagagcgcggccatggacgagggctacgccaacctccccaccagccacctcctcggctccgtccccgtaaccgatcccctccctcccccctcctcctatccgcttcgcgtgtctcgttttttgtgtgatgttatgtggtgtgatgattcgggtgtgatggtttctgtaggccgccttgacccccgaagagaggaagccctcacccgtcgccgaaggtagcaaccccccctcgattgcgtgttgggtttcaaggttagtgccattgcgattgtcacggattgctgattaggtttcggttggaaatgcagttggcacctcgcgtctgcagcagtttcctcctgctcttggtggtactggtggtgttggtggaggaggaggagggtaccagcctccagggacccctgcaagtaacaacaggtcgcagcgttaaaagcg

SEQ ID NO: 20771 - DNA, 8754 bp, Oryza sativa
aattcctgcagcccatggaaatgatgggttcaagagcacatcgcactccggaagaaataattttcgttgcttagcttagtgatggcgttatattctatttcatttcgaatgaactacgtcccatgattttcctcccgaatactattaatatggctgcaaagtattaccctggtactgctttgatgttttcttttaaggttcatgtgcaaaaaagtacttagggagttagggtagagcaaggctcacaaaacagcaatatgttgattggatagagtagctccatagaaataaatcttgcagtgtgatttttttatcttgtagatagccaagaacctcagagcatcatttgcttgaattatttgtttgaggtggctgttgtatggagtgctgcctagtgtgcactaaacaaaatgctcagatcctcagagaaaaatatgatagtggactagtggtattctaaccatttccaactgatgcaagaactacaccttctttttcgttatatattactttcaaatttgatccctgtcaattgttatgtttcagttagtgcaatgattgcactttactcaaagctggatcttagatggtatgatactgattatcttttcccatgtgttgctccttacttttgcagatggagatgtagaaactcaaacaaattggaaaggatacttcaatgttgcatcttatgctccatatttcaatgttgatactgatgttgtagttgacaggctcatcagctcggtttatccaatggatgggtttttcaggaagattgatgctaatcctgacatgtaagtatctcctattaggctattaccaatctgtggtcacccttcacgtttaaaaaattcgaccttaagtacctgctggtattgatgtcataatttctaatgaatggattcatgatgataggatacaattacagcgaaggatcatagaattgtttgtctacattatataatgtgttgttaatgtgcaagtgatgttttaagttgcatataacatgccataaatatgttttgaagcagtttcagcgtgacatagacatttggataggtgaagtactgtatattttacaaaactatgttgtaacagtgctaaggcatatgctgcaataatcgagattatttatctaggactagaagcatgattttaaggaggagaaggacatgcaggttttttcaagggacttttgacccattgttgtattggtgcatttctgtagtaactcatctatgcttttgcattgtaataattttgatacctggagccaacttattcatatgcgataaatcattctgctgtttgcaggtatgggcccttatggatcacaacaacactgatattcatgctagctgcatttggaaactttgccacttatctgatgcaaaggaaaacagacctgaacatatggagctttgatgttggctatttcaactgggcagcatcggtcatgtatggttatgctgccgcagtgcctgctatattctttttcctgtttcagtattttggatcacgcccaagccttgttcggttttggtgcatgtggggatactctctgtttatcttcatcccagcatctgtaagtattcacagtaatccatttctttgatggttcggagatgtagtctcagaaataactgtcagtgaaaataatccatgatgtaccagcatttaggcttgcacctcctgctcctgctcaagaaggctgctatgtctaatgcaggcactaattttctttgcttcaggtactgttacttattcctgtggaatttcttcgatgggtcatcataatccttgttggtggtgcttcatcttggttcatctccttaaacttaaaggaatgtactgagggagctgatatgatggttttgattgctagtgctgcagtgctccagtttactctggcactgttcatcaaagttttctttttcgcctgagattgtcttttggtgttgctcaggtctgcctctcttttttaccttctacgactagataccatagcatcataaccttcccaacagtacacagaccacgcctttatgaattttatttagtagtcttttattgtagcagttcattatcaaattgggttaaaatattctaatacattatattttgcttttgacaggtgagcttgatgttttgtctgctccaatcattctgttctggcgagcatccttttgaggaccaagcggagtagttttacttgacatacatattgacactagattgatagacctttgtgttttgtgttcatgagttttttttactcctttagttcacagaacttcactgtatgtttcaattcggaattgctgagtttgtcatctaaaattgcatagtgaaccttcgaccattttgatctacaataaccatttgactatattttgacaaatagcgtgttcctgctcttggttgagtgattgacaccttttttttagtttgaacaatcagcgtctctgtagcatcatttttcaattttcatgttatcgtaacctgctatagtcattgaggtatagtttatatcagtgtatgggtacataacatgcggttcccaacgactacctcgtttttgtgcatcacaatatcacatcactcttcatgtacaaaaactgaatgccatcagtgtggcataaacggagttcttctgaccattgtaaagtttgtctccagcctgcccgcgaaaatcacgagtctggactgaattatgctcaattctaaacattcctgtagatccttgagtgattaactcttttgctaggattggagaagaacgataaaagcttttacacatatcatggaagaaacctttgtagtgaatgaattgcataatcgtcgtagtagatcccatcaaacgtaacgtgtgtgagaacgtaaaactacagctcaaatagagctacgtttgttaggagactagcagcaacgcctccttggtcacagttgttagcagaaggctgcaaaactggtcactggtgctaatcaaaaccgcatggctagcctggatgggccgagacaagccaatgctgtcttagatgggcctagccgggcctaactcctcaaatacatactggtcttaatgtaagcccaagacagttcggtccactaaaaaatactatctcgctgagtagactgaggcacgcgtagaaaggtaatacgcaagctccttttcaaggcgtaatttcggcgagctctgcaagtcttgaagacgtaaagaatgtctcatcatcatcggtcccttgtccgttgtgctcgatgggctcctccgccgccgccggccgccgcatttgccgtaacctcgccgcgccgtcctggtgtacaaatttttcctgcacacgcagggccgcagtgtagagtccaatccaatccaatccaatctccgctgacatctccccactccaagcccacacgggccacggccacacatcgacgctctccgtccgtagcatgacaccaagaaccgcggcggcgctgtcaggtctactccgcggcaagaatgcagtgaacctcgcaccagagcaggtcccgaagctgcttgctacgcgcgcgtcacctgcccgggtggaggatggcgtctgtctccgtgaccctcccggtgcccgctacccgctcgacgaaattcctcgccgggatgccgcggtgggcgccaaccgcgtactcttcgactatgcgcggcgcgggatggtcctggaggtcctggatcagttctctgtcgcgcgccgcggcggcgtgctggttgacagcgccacgctgtcctgtgttctcaaggcttgcagatcagtgccagacagagttcttggggagcagctgcattgcctgtgcgtcaagtgtgggcatgatcgaggtgaggtcagtgccggtacgtcgcttgtcgatatgtacatgaagtgtggtagcgtctgtgaggggatagaggtgtttgaaggaatgcctaagaagaatgtcgtcacgtggacatcgttgctaactggttgtgctcacgcacagatgcattcggaggtcatggccttattcttcaggatgcgtgctgagggtatatggcccaatccattcacattcgcgagcgttctctctgcagtagcgagccagggtgcacttgatcttgggcagcgtgtgcatgctcaatcagttaagtttggatgccgctcgtccgtgtttgtctgcaattctctgatgaacatgtatgcaaagtgtggattggttgaagatgccaagtctgtgtttaattggatggagaccagagacatggtgtcatggaacacgttaatggcaggtcttcaattgaatgagtgcgaactggaagcgctacaactgttccatgaatcacgagccaccatgggaaagatgacacagtcaacatatgctacagtgattaagttatgtgcaaacctcaaacaactggccctggcacgtcaactccacagctgtgtgttgaaacatgggtttcatttgactggaaatgtaatgacagccctcgcggatgcttacagcaaatgtggtgaattggctgacgctttaaacatattttctatgactacgggatctcggaatgttgtttcatggacagctattatcagtggatgcattcagaatggtgacattcctcttgctgttgttctttttagcagaatgagagaagacagggtcatgccaaatgagttcacctactctgcaatgctgaaagcatcactatccatcttacctccccagatacatgcccaggtcatcaagaccaactaccagcatatcccatttgttggaactgcacttcttgcttcatactcaaaatttggcagcactgaagatgccctctctatattcaaaatgattgagcagaaggatgtcgttgcatggtccgcaatgttgtcttgccatgcccaagctggtgactgtgaaggtgccacatatttattcaacaagatggccatccaaggaatcaagccaaatgagttcacaatatcaagtgtaattgatgcctgtgcttgcccatcagctggtgttgaccagggtaggcagttccatgctatttcgatcaaatacagataccatgatgcaatttgtgtgagcagtgcacttgtgagcatgtactcaaggaaagggaacattgacagtgctcaaattgtctttgagaggcaaacagatagagatttggtttcatggaactcgatgatatcagggtatgcgcagcacggttacagcatgaaggccatcgaaacatttcgacagatggaagcttcgggtatccagatggatggcgtcacattccttgctgttatcatgggatgcactcataatggtcttgttgtagaaggccagcaatactttgactcgatggtcagggaccacaagatcaatcccaccatggagcattatgcatgtatggtggatctatatagccgtgcaggcaagctggatgagacaatgagccttataagagacatgccattccctgcaggtgcaatggtatggcgcacattgctaggtgcttgcagagttcacaaaaatgttgagcttgggaagttttccgcagataagctgctatcgcttgagccacatgattcatctacatatgtgcttctctcgaacatttacgcggctgcaggaaagtggaaagagagggatgaagtgaggaagctcatggactatagaaaggtgaagaaagaagctggatgcagctggattcagatcaagaataaagttcactcctttatagcctttgacaagtcacatcctatgtcagatcagatatataaaaagctcaaggtaatcataaccaggttgaagcaagatggttattcaccgaacacaagctttgtgcttcatgacatagcagaagaccagaaggaagccatgctggttgcacacagcgagcgactagctcttgcctttggcctgatagctacaccacctggaacaccccttcagattgtcaaaaacctaagggtgtgtggggactgccatatggttatgaagatggtttcgatgattgaggacagggagatcatcatgcgagactgcagcaggttccatcacttcaatggcggggcctgctcctgtggtgatttctggtgaatgaagggcagaacaaactgactggataaggtgtacgccctggcagtgccaatttgaacaatattactgtgagttgacattagagtattgggttgtctatagttgatatcagtacaagcccacaaatagtgttgtagttgcttgtagaagcagagatcagtgttaatactagagcattggtttgttagcattgccagagaaagccagttgccacaagtggtataattgctttatgcagaaacaggaataaacttgctctcattttttttggctttatgtttgatgaagtgaaaccgttcatcaaagcagcatgtttattaccttctcaagttttggcatgctgaattacaggaatctacagctacactggaccgcaaagatatagaagttcttttcaccagttcagttatgcattcataatccacaacaagcagttttacttgtgttttaatattggagtggctctacaatgcctgtgcaaagaacaaaattgtcctatgtttgaatgaatgtattggtaatctgatggcctcaataacactaactatattcaacaaggacagttttcagaaataatgccatacagtagtctaagcaacattttgtttaacaggagatgaacaaactcatgagaaagcacctccagaagctcaacttcactgcaccagtcagatccaggtaatccacattttttatttgactcaaccattgcaatggcagtttctcctgtaggaggctttacttgtgcttttctatagctgcttgttgcctccaaagtacagttgtgagttgtctagaatagtataatgcgtgtgaaacattggtagttaatgccctcttggatagaataggcgtatttagtccttcaaattaaggagttgtttgcagtagtatgctctattctatccccttcacttcagaggatctttttaataatttttatggatacaagcattcatgcatatatgcaagtgttgtaatgaaaatgggcacttccttcattcatattagtcatgtaatcgtgctttgcacgtctttagggtcccgtttaagaaccctgtattgtgccatttcaacctgtccatggctaattgttactgttatggctctgtgtaaatctaaccaaatattacactctgaactaaacaataaagtattcaagcttctagattctagagaagcctactgtattcattgtatcattcttcagtaagtaactcacaattagatccagcaggaagtatgaaatgcaggcagacaggtttggagtaataatgacaaacacatgcataaatcgcatattcagagttcagactatatgaatatcatgaaaatgtaggcacctcgttcgtatgaagcaaactgttaatggtggaggggaaaaaaagcatgattcagtttaggtgtgaccgtgtgagcgagattaaatctcgagcaaagaaggagaagaaagttcctgcctcaaaattgccttcatcctccctgcgtctcggcctctgcttctcttgctgctgctatggatgggccagcaatggcctggagatggccctgcttgttgtcaggatctggaagttcagagtagccaaatttctgaatttttgctgaagatcaggtctctaatctggctggggctgacatatcatcttggcttgacacaggataaaatgtgtcagctaggcatccttacactctgcctcctgctcgcccacctgctcatgttcctcctctgcaacttctcctacttccgttcatccttttcctgttcctcctcccctagcctacagaaaatacaaggaaaaacatgtttgagatgtgtatcctaggaaaacattttgttttactaagaagtgaaaagaccaggtaattgtgtaggaattgtgatgtatattctacatagggtatttttgttgggtgttggggcttgaaagagacatgatgataccagattgagataagattgtcactgatttttctttttgggtggtcatgcagccatggaaggattaaaaatcaaaggaatggaaatcattgttgtgctagtggctctgggtacgtagaagattcttcaactgcatgcagttcatctagctccaattgactatgcagttcatgaagtgcagtaagctagagctgatcaggtatgtttacgaagatggaatagtgaccttgcagagggaacatcatttttataagtcagccacaagaattagagatgttatatttatttgatgttgggaatacagaatgacatttgaaggttttgacgatacagatttgaataccagcatataatggtgagttgaatattggcctgaatatttttaattggctgtgccaggtccataacaatgatatcagtataaccaggagttgttgatgttcagaagaacaggacatcatgtatacttggaaagtacctggggaaaatgtttagaagagatgagcaggaactgaaatctcttggtgagatttaggcttgcacttcctgctcctgctcaagaaggctgctatgtctaatgtaggccctaattttctttgcttcaggtagtggtacttatccccgtggaatttcttcggtgggtcatcataatccttcttggtggtgcttcatcttgggtcatctccttaaacttgaaggaatgcactgaaggagcggatatgatggttttgattgct

SEQ ID NO: 20772 - DNA, 14279 bp, Oryza sativa
cgaattgcatgatcgtcatagatcccatcaaatgtgacgtgttgtgagtgagtagcaggctagcagcaaccagcaatgcctcctggtcacagttattagcggaaggctgcaatactggtcattgctgctaatcaaaactggtcaagataaacttgttcttgaattttttttggttctctttgggcacatctaaacccggtgaaaacagaatttcaaggaaaagaaacatggccaaactacgaaaagtacaagatggcgctcccattcctcacttttattcaacttttaatcagacccttcacttttctcagccaagacaagtattcatggcactctttgtttatcatgtacgcatgtaagaagtcggtaatatcagtcgaaatgcacctactcttcaagtaggaatacactgccttctgaaattcctcaggaagattactgcaaaagagtttacatccatgatcagtaaaactacaaaatgcaccatagaattaaaaaaaggggggggggggggtgatgctcacctcaacttagcttcaagactggccgaatcaccagattcatcattcggttcaaacgacaagctctcaatgatgagttcgttagggtaagagctacagctgattttcaaatatgaagctgcttctttgcgaaccctcactatcaaagggatacagtactgggccgggacaccattgccaatgtgagttctatgtttgccatcttcacactgatcctctggctcgccattttcctcagcttcattgacagcgcttggcaagaacacttccacttcaatttgttctttatggtcactcctcttaagcgtcatcatgttggtaccatcctaatctgggatttcaaaaggaaagccttcacctaattcctttgactggcagaacataaacacacattacaattccatattaaaaaggatggcatctttcagcatctcagaaatctagggcttgttcagattgatgccatttcaaactataccattttttagcaaagttgctaaatatgtgcatccatttagtttcttaccaaactctagtaaataaataagaaatcctgccaaaacttggaaatattgccaaattgccaaaattttgacattaggtttattttgactacaatctaaacagcccctagtaagcttcttgtctgatatagtttgccatgtactataatggtacacttttcctttcaaagtctaaacagacgtgcccataaattgcaacaaacaaagtttatagcccctatcgttttgcttatgcttataagccaaaatttaaattttaaaacttaattttcaagttgattttacggttttttcattgcagtttattttacaacatttactttcgaatcattaaggacatatataaaagttttacccccaaatcaatttttggttgctaaaggtcgcatggataagcataagtataagcggaacgatgagcctcatagccaggaacacgattcaagcggcgtctaaactctaaagaggcgaacttaatcgcagatgttgttttctctctgagtcttttgtccacaaaaacggaaatcatcagtgagggatgagatgagtagtaaatacccagttgcgattcttgcaatctttctgggcgtaggagatctccatgtttatgacccggaggagctgtgcgtcggcggcgctcgtctgagaactggacaacgatgagaacaacgacgcggacgcggcgccatgccgcggatgacgaacgcggccgccggatccggcgccccaggtggcgaggaggccgcgcgcggcggccgcccaggaggggtgagatcgagctcgccgtagggtagaggagacggccatggacgccgcaaaggtttttgcgagggttttctcaggtctttccccattaccgtcgagctgaaggtgccgacgcttctggaccgttggattccacgttaggcccatccatgttgggccggaacggtataaggcgcggcccatagttgttgggctagaactggatcgcggctgacatgtgggccattcttttttgggccacacgcccacgcacgatccaatccgcgggcagaggataccggcgcggcggcgcggcgggccggcggcggcgggggaaggatctcggccggcaaaccgcgcggccgttctactcctccgggaatatggagccgaagcgcacaggtcagcttcgtcacctcctccccacccccgctgccgcggcggtggcccccgctcgcggatgccgcgttgcggcgtcatcacggcatcacgccggactccggcctctcctgccgtacgccgaccacctcccatctcccttggtgaggaaggtgtactaatactaccctcgctgcgcgctgcgccgccgcggccggcgccaaatttctcttgcacggcctgcttgatggctgcttctcacggttcttctttttcttgattttccaggaaaaagactcaggcagtcagactgaacaatgagcttatgagaatgctagaaatcgacgaactcaagacagtttttgggatccatcacaaagtgttcatccctatcctggatacatttgattcgaagcatctaaacacggtgaactgttatgcaacgccacgagcagctgaactggggaactgaatttggctgctggctttagatctccccgtcccagaaatcctccagcgacttgtaaaagctcgtcggatgggtcaagaattcgtacttgaaaagcctaacctgcatgttgcaaacagaacgtacagctcaggaaaaatctttagagtatcaggctttcagcaagtaatttgtcaaaatatggagccatgcctgttgaatctcgtagaactttgccatcagttcttcagggatgcaccagtcaaatatgtcaatgttctcccttgtccacacctcattgtcgctctttgggagcacgctctgtcccatctgaataccccagcgaagagcaacctgagcaggacttttctgcagcttcttggcaatggaaatcacagtaggatggctcagaacgtttggtccatcgttccctggtgatccgggtgaacctaatggtgcatatgcctgcaagaatagcatgaaaacaaatcagagtgaagtaaatgattaatatgctgagttgctgaccaaagttggaaagaaatggaaagtaaacagtgagaggatcataggaacgtcttaatacagttcgaacttacagaaagatgaacgcccttggattggcagagcttccggagcttgccttgctgccaaaccggatggcactccacctggttgaccgctggaggcacgcgagcaacattgagcaagtcctccagcttcttgcatgaaaaattgctcacgccaatggcacgagctttgcctgaatcatacaacttctccattgcttgccatgtagctgggatatcaggcttgaggtaattttccacactcaatttagtacctttcttggcacgaactggaccgtggacctgtgacgtgataaattgtaggagagattaaagattgtcacaatggattaggaattcctgttacaaagagtaagaagaacccatggcacaaatgcaaatactatttataactgaatagttttctttttacaagaagtataggcttaggatattttactaggtacaaatctaagtagtaaagctgcagatcctttaatgtggtattaatcgcctctggcacatcttctggagcatggtgtgtgcacctgaaaattttggaacattttcttacagtgaattgacttcattaatcgttttatataagaaaaaatatgcaatacgaaaggtagtatagttttacaacctaccacagtttagatgtgatgaataaatcttcacgcttaaccgcaccttcgtcaaataatttcttcagtgccaaaccaacctccaaaagcggacgcaacttttgcctacttttaactctagagggatgagtatttgacagtgaagaaatgtagttgaatcactcttaaaaccttaaactgcaaggctctgacaccaactgcgtgatattactttgtcattcttagtgcaacatttgtcaaactattattggaatcaaccgcaaacggtgtataagaaatataaagttactacgtatttcagatatccttgcatttcagtttaagcttatataaaatagaagcatgaaggtttcaggagcaacttacctctttctgattaccatactgtggagaacagtcaatatgacgatatccaacctgcaccagtacaagaagataacatttacatccaaacagaggtaaggaccagatgagaactgttcatattttcttcaaaagaagttgaaaaatgtcatcatttcaggtattaattaaccttttttgggttaactgagcaaatgaatgaacagaaaaatccagtcgatcgacatgattgttatacgcaggtgggtgcagcatgagtaacaacgaaatagaagataataagactatcgcctatattgattgttaatcatcaagaagaaatgaaaagacctggacagcagcgcggatggcatcttgaacagcacctggtgaaatttgccaggtgccaagaccgactgatgggatcgccgcgttggtgtttaggacaaaggattcagccatattcactccaaagatcaaactgtccttggtttccaagcttcctcttcttgtgtcgatggaatccaacagagagcgaacttgagcttacctggtgtctgagcaagaagatctgagcactaatggtaggtagccaaggtatgcagcggttgaaatgagcccggtgatcaccagtagtatactctaaaataagagcttccagaatccatttaataatacataattgaccactctagatgagacttagagaaacctgcaactgacgaagctaatgcaatttgaaatagagaaatcgcatcttggcaattgatctgccaaagagaaggcaataggcaagcatcacagctcaagtaatttattttaagggtgagtcaagtcaatttatatttcagaaagactttcgaaacaagtttaactagaaatattagctgctgaagtcatacaacaaaatcaagatgctgactaactacttactggcagcatttaaaaatcattgtacacttgagagaaaacatcttatgtcactgaaattttacttgtcccaaatatgctactcatatcgcaaactcatgcccatttatgccatcagagatgcagcggccaagttatctattatctagtaaacacttatgccatcaggtgacaattctaacactgccaatgcttcttccccaatgaactcgccttcacttgttcaatggcagtggcgggcaggttgtgctgctggtgcggggtccgtgagctgctggacactgcccggtgatgtcctgtccccggcaggtgaggggcctggctagctggtaccgcagaagatggtgagaggctgagacctcagatcagagtggcgaactggagtgctgacctgatgccatcgcctggcggggactcgttgaggtgaaacattttgtatatgttttaaaatactttattgaattggcatgctttagttagccacacaaaagttacatttacacctaggaaaaacgtatcgcaggttactaaggaactgagcgagtgagcagaagaaagcagacgtcaaactacatccaaaatctgtgataaagccttcttttaaacaaatgtccaaattactgataattttgccggtaaagattctggattccggttcttgtaaaaatacacgccagtaccagcaaaatggtagctgtagacttaaactccttttattcattcattgattaacatttccccactttatttgcagcaatggcagtttccagtttttcacccacacgaagaaagcaaacttcagtccagccaagtcgatcattagatttcgccatcccaaagctcttcgattgatttgtagacgccttccgggtgagtccagaattctccacggatcagcttcatctgcaaatcaaaatcgccattcatgagaaccatcaccaattcaccatcttgcccaaaaaaaaaagacccaacaagaacagagtttcagagcgtctgctgctgaagctgactccggccttgcctgctcgatttcagagagcttgatgaacaggtcctccgggatggaccagtcatagacgtcaatgttctccttgatcctctcctcgtgggtgctcttcgggagcacgctgtgccccatctgaatcccccaccgtagagccacctgcgccggcgtcttccccagcttctccgccgtggagacgaccaccgggtgcgcgagcacattgcccaccgctttcaccgacgctgtccccggcgagcccaacggcgagtacgcctgcagtgacgcatgacaaagaagaagatttgaagcacatcactaggataatgcactgaaggagaagttcagagttgggtgatatcctgttcagaatagcttcagctgttcagcatcaggcaggttaattactctctttctatgtgttctacaattgattctactggtagtagaatcaatttagaccgttcatcttatctaagctaatggatgatatctaatttatactaccaccttaactactggtacttctggtagtagaaatcataaaactacagctagaatcacttctaccgattgtaatactagtagtactactaccactgtaaatgggggaactattttgatcccttaaggggatgtcccttcatttgcttaaaaaccattcaaacggttataaaaattctggaaaaaattgataacactcatacaatatactctctttgttttttaatatatgacgctgttgttttttactatgtgacaccgtcgactttttaagatacgtttgaccattcgttttattaaaaaaaatatgtaattattatttattttattatgacttgatttatcgtcaaatgttctttaagcatgacttattttttatattcgcattaaaaaattcgaataagacaaatgatcaaatgcttataaaaaagttaactgtgtcattttattaaaaaatggatgtactcctatctatacaactccataaaatcttaggtccaaactcacatcgagatataaaaagataaattcagcatatgaatagtagtgtactgttcacatctgaatttgtcttttttatttctcgatgtgtaagtcgaatttaattttttttgacagatagatatcacaatactcaacatagttattttttttcatattttttacgactatttgtatcgaatttgaaaaaaaaatatacgaggggacatcccatcgaggaattagaatccactcccctataaatgtactcattcatgaataactgacacagtaaactgaggttatctcacattgaccacatattgctttcaaatgattatattgtgatgaaattgtatggttatatttataacttatatacttcaataatatagtgtattttcatatgtttataaaactttctgtaaaaaaaggttcaaagtttatgcttaaataatgccaatgttaattacttcctccatcgcaaaatataagagatttttgtttgataatacacgtatataggatatcctattcaaccaaaatcccggagggagtatctgagaataaagggagcggtagtttgcagtgctgagcaacatactgagaggtggattcctttggaggtgcaaaacttgcggagcttggtctgctgccacaccgggtggcactccacctggtcgacggccggcggcacgcgtgcgacggcgagcaggtcctccagcttcttgctcgagaagttgctgacgccgatggcgcgagccttgccggagtcgtggagcttctccatcgccgcccacgtcgccgggatatcggtcgggaggacgttttgcccgccaaagccggcgcccttcttcatcctcactggccagtggatctgacgaacagcgtgagcatcctcaactcggatacttttaagataatgaaagctttatttaaactcagttaattacatcatacaatagtcaccctcggtctttgtataaaatacacacggctaaaaaaaaagaagaaaggaacaaccagaaccagaacatctccagaaatggactgaaacttatcacgaaatggaacatgaatctcacacgcattgcatactcacaaggtaaagatccacatagtcggtctgcaaatcctgaagcgtgctgtccagtgcaaccgggacatcctccggagcatggttagtgcacctgcaagaagttgcgagttcttcagtcatgttccaagattactgtaattgctggtgctcgcctaagccaagaatgtttggaggttttggaatgaggatgaaattaagaaggtaattaaccagagtttggaggtgatgaatatatcttcgcgcttgactatgccctcgtcgaacactttcttgagagcgaccccaatctacagagccacagtggttactggttaggctgctctgaaaactcagagatcgttcacttaactaggcaaattggagacaaatttagtaatttacctccttttcgttgaagtaggcttgagcacaatcgatgtgccgataaccagcctgtagaagcatacaattcagacagcacaaaagaacatgaaaaattaacctgcgtgaaaattcagacagcacaaaagacacatgaaaaattaacttgtcacgaaattcagacaacgcaacatcaccttgacggcggcgtagacggcattgccgacgacgcccggctcggcctgccatgtgccgagcccgaccgacgggatcttggcgccggtgttgaggacgaagcagcgggccatggtattctgctgcaagcactgtacacaagccggaaaatgcatgcaaaatggctacctggacacttcacacttgcaagagcggctaataatggaaagcgcggcgagctcgtgccggtgggcgagatgtacacatcaccgtaccagtagtagtgacacttagggatggggatttcgtcgcggctatgaatccgacaccatgggccacgcatttagagatggctggaggtttttatagcagacgaccggcagctgtttcttgtactatctgattattatatctacatctatctatatctctctcctttataacactatatctatgtatacgtgtgtgtgtatatatatgtatatgtatatgtatatgtatatgtatatgtatctgtatctatatctttattattttgatctttgatagactcacgagtaaataaaaaaggttaattgaatatatgttgttataaatttgacagttttaaaatatgtcattaccccggaaaaaaatatgtcattaccatttatctaattggaacaatagcattgtaaatatatgttgaaatcagatacataccaccacatatccctttgctgcattttttatttttcttggatcatactgcccttgttcatcccctcctctcatgcatgctcatctcttcttcctcctacggtctagagcgagtgagcaagggagcaggagagggaacggtctgagcgcaatgacgctttcgacgacaacgtgtccggcggcggaggacgagtgcggcagcacggacggtagcggtgctcgagcccgcaagcatagtaggcggttgaactcgacatagtggcgttgctagcgcggtgctcgtggcggtagttgttgacgttcctcaagtaccaaatccgaccgtcaattttagcataaaagtaattgatatagttttaccttaacttaaattaagttaattaactcatagaaatcctctctatcccaatcctatcatttaattgttgctcttggaagaatcatgttcttaaattgtgcacatacgttctctgtggatacgctaccctaggatactcttggtaaaagctacaacggtatatgtgcgcttgcagattattctgtgctcataataaataccagcaacacttctagtggcagagctccagcgtagtggcgtcgccggtgcagtgctcgtggcagcacttctggtggcggagcttgagcgcagtggcatcgccggcgcagtgctcgcggtggcacttctggtggcagagctcgagcttgagcggcacgacgtgaccgtctaggcctccgggggagcttgagcgaggtgacgtggccggcggcaaagttttaaaattaatcaaataaatattaattgttttaaaattaaaaataaactaaaaaaatgctcatgcgttgcaataggtgaaggttatcttaatcttattattgttatacggtttagctaaagtgaaattcactgtaagaatttgcttggatattatttttacaagatcatgagctacaattagatcgtcttaagttagcatgcgagtttttttaaagagatttcgtatacgactccttctctatatattttcaaaagcaaacaaatttaaaaacctactcaaatctaaatttgtaattccaaaagcgaatgaactcaataactgactcaaatacggatgacgtatcaaagtaccgacaaaaacatcttcaacttttataattgtagagaagaggtatggatttatttgattcttttaaaaacttttatatataacactgtttaaccgttcaaaaaatatgcttacgaagaacgacaaagttattatagctaattgctatttacaaattagaactcacgctatagctactaccggcaatggatttaattacaaacgtaagggttagcaaccaatgctaaggacatgtttaataggttccaaacttctaaattcaactctaagagttaagtatggagacatggagtaaagttatagagtatccgaattctagctccacatttctagtttatttgtgaaaacacttcagccaactttcgtcatgttttgaatagagctgaaactgtacgactaaacctaaactgaaactttaccgaacagacctaataatggtgataagattgtgtcgggggcagacgcctagcagagcgctgcccgaacgaaacgctcgacgacgacgacgacgacgacagctacggccggtcggcgctccaccactctccgatggcgatccgccgccgcacaagacgtttgtcggtgctgccgtgctgtgtgctggagtggagcgctaatctgttggcatcttgcccacaggcccgcagcacgctacatgggcctagatatgccatgggcctcatcattttttccagcccatgtattacccgatgtcgccgctcgaattttttttatttataattttttttattaaaagttttacaaaaataattttccattttgaaaattgacggaaatagtcgcctaccgccctctgggaggacgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatcttcaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcg

SEQ ID NO: 20773 - DNA, 3018 bp, Oryza sativa
ccgtgcgtagtgaaccagccggaagtccccagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggtgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacggaggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcatgttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatgtcttgtaagtatggccgcgcagatcacacttgctgcagcgtaaagtcctcccacctgcttctgactcatccatatcatttctgatgcgtctagtttggcgtcaaccctttttcaccctaaacttagatggatctggaatataaaaaacttgggcactcagcgttgtgtaagatcctgagatcccgaacccatatatctcctcactccagtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggggggtcatcatgtaatgcaccaagaggtatgggaggctcgtcaccttcaacttgtggtctgcgagattgctcatctggttgattcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatgg

SEQ ID NO: 20774 - DNA, 894 bp, Oryza sativa
cgccccgaccacctgcatgatggccaggatcttggcgcgctctggatcacagcagagggggagggccccttgggggatgagggatgcctccacggagctgagattcagcacccgttggaccaccatcctgaagtcctcagggtcccagtcccatttgcgcccctggtgggtcctcatgtagtccttgggcccggtgtactcccaggcgccccgggcgcgccgctggagcggcgcgatccggcgatgaaggtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccagtcgctcttccagtcgtcccactttttgcggaggacgtagggagcgtagtggttcagcagctgcccccgcggctggaagtagcagccaccgactaccgtcggcggcgacaccggctgtacggtaaagaaccaccggaacagccggagagatgggcgcaccccgataaacatctcgcacaggtgtgcgaagatggccaacgtcattatcgcattgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcccggcctgcctctcgctcatgatgcgggaaggcggcagcacgctaccatcgagcgg

SEQ ID NO: 20775 - DNA, 355 bp, Oryza sativa
agtggatctgatcgccggtgtcgtgatacttcctgggaacatggggggccaggagcacgctgcaatctatggcgatccatacgaatcacacaccatgagaggtaggttacaaggaagagagagcagaagggtgaaaccccacctggagaccgcctgtggggtcatccaccatgtagataaatggcgaaccctggatcaggctcctcccccatcccgctctccaacagccgcccactctgaccggcgaccgggacgctcattgtggccgatccaaaagcacgagctgtgtggcttcccttgctacgcagaacgcatacgctacggcaaacgctagcgagtggagaatgcgatatgc

SEQ ID NO: 20776 - DNA, 1039 bp, Oryza sativa
aaggcagaacatgttcacattccagggttacttaatcctctagaaatacctgatatggcatgggctcatatttccatggactttattgagggactaccaaaatctcaggggaaggatgttatcttggtggtggttgacaggttaacaaaatatacacatttcttagcattgtctcatccttatactgtggagcaggtggtacagatatttatggataacatacataaactgcatggaatgcctatcgccatagttactgatagagatcgggtatttaccagtacatttttccaggagatttttaaaatacataaggttaagctcagatttagcactgcacatcaccctcagacagatgggcaaacagagagggtaaatcaatgccttgaatcttatttgcgcagcatgacctttcaggaaccacagaaatggttttcttggcttgcattggcagaatggtggtataacactacatatcatacatccatccaaatgactccatttcaagctctgtatgggtatccccctccacaaattagtgagttttctattccctgcaatatttctgaagaagccagagtaactttagaagataaagcaatgatcctgcagaagttgaagggcagtatgggagaggcccagagaaggatgaagttttatgctgacaaggggagaactgaaagaaccttagaagtgggggatatggtgtatttgaaactacaaccatacagacaagtggctatgggaatcaggggctcattgaagctcaggtccaaattttatggaccattcaaggtcattgagaagatgggttcagtagcttacaagttgcagttgccggagggagctgggattcatcctgtttttcatgtaagccagctgaagaaacatttggggcctagagctataccaatgcccaatttacctgcagtaggacctgatggccaaatcaagactgaaccagctgctatcttacaaagaagaatggttcccaggcataatgaacctgtgatacagtggctgattctttgggagaatt

SEQ ID NO: 20777 - DNA, 6331 bp, Oryza sativa
atttttagcaggaatcacgcttcagatgttgttttgatgctacttttcttgtctttatgtttttacagctagatgtaatgcctgaattgtaagctactaatggaggcctttggcctggagaagaagaacagaagcaaactacaatttactttgtcttaggattagctaaagtagcttagaaccctaaaatcgctgcactgttttcccctgtttcttccatttcgcactcagggtcttgacacccccgcggcgagctggttcatgccgtcgttgcaggcgcccgtcgtgctcgccgcacgcacccgcacaaagatcggtcacgatacggctgcgtggcaacaagggggtccggtgtttaaaactccgaccccatttggctcgaaaagaaaagaaaattcctatctttcttttcagaagtgccaacgcgccatcatgccatattgccatgtgcccctttgaatcaaaggatttatgtaggaatttcataggatttaaatcctatagaaaattttcctatttggccatttgattcaaaggattgaagctttccaaatcctatgaaattcctatggaatggcatattgcatgtagattttggaggaaatttagcaagagctccaacctcttggaaaatttcctttgagtctatctctcttatccgattcctgcgttttcctacgctccaatcaaactatcattcctgtgtttttcctgtgttttgcaatcctctgttttacacttcaattcctgtcagaatcctgtgttttttctattcctccgttttttctaccctacgattcaaaggggcccctaaaccggcaatattcaggttcaagctctgttgccacggaatgacttggcgtgcagatgaattattcctcccaaattttcacagcaataccaacttttccaatcttccgtgcactgagaagagaagatacatcagaaatgttgtgcgttgtgctgtgcctatatatgtattgacttgctgccagcaggctaataaattcatatgtgatttgctccaggttcccatggactcgatatatgagagttaacaccaaacaagaacggacgcaacagaaagcttgtgcatctgtgtgtatgtgattatacccaaagctactcgacaaagttttcaagatttgtcctctcagtgttgcactccaatactccatttcacattttcatttccatggttaggacaattaaagcacagtagaaaaaattacacctttgctactcgccgggcaattaaaagaacccaaacaattactgtcgaatttactcaccgtcgatcgtcgtcctccttggcaatggcggcatgccaatttagggttcgggggtgagtggtgtgtcagtggtcgtgtggcgttgccttggtcacacgagagcgattggctagtattggcgacggggaaatcttggcagtgtggttaggaggcgatgattgaagagatgcaaagtgtgcgtaaagtagagaaaacgataaatatgtcactccattagtagggtttcgataaaatggcacctactagtatgcaaaggataaaatgtcactcaataggttaccttcataatattttaccttgggaagtttaaagaccacaatatccctacccgttggagagaggaagggagaggggcccagggaaaaggccaagccagtgcttgcctgccgtaggcggtgagagtgtatggacgggtggcgtcttggaaaggagaatggggcgacaaggtagcggtagggacaatagagcggagggaggatgaagcaacaatgcagtccaatgccgcccacctggacgcttgcaactcgtcgctttggcgcagacaagggaagaggacggtagcattcgcagctccccgccccactccatccattttctttgatgccgattggggagaaagatggagtggccagcgccccatctacctcgccgccccatcctcgcccgcctcccgctcattctggcgggtagcatttcattgaaagcccacgaatggagtggcgtattatccgctttctcgcgtaaagtatatgcaaaatgcaacattagttgctctgaaaaagttgtggctttcctttcctcgtatatgttaatgatgctaaaactacaagcctgttcaatatgatatcttttccaattaacccaaaagaattgccttacttatttcttttgtggacagcacgcagcgagccaacgatgcagccaccatggccttaacatgttgaaaaagatccagatcagttacagtaggattcgcggcacagatttacatagcacctctgagattattttcagggcagccgattgatttgagtgtatatatcagaaaaaaaaatttcaagcgtgcacgggctcaccaaattatcaagggacgtacgcaatcacaattaattgaaacagaaatgttattatcaagcagaggtgacctgccacctatacctgcctgcttggtcacagctggctattacccacaccaattaccaatgtaattgcaagaatgcaatataccgtcattcttgaactacggagtagcaaaggaaaatgctaagacaataacagaatgctgcatcaccaagtccgtacataaggcagcagcgcacgcaacgttaggtatctctcaaaaaaggtctttctttactatgaacaactaaccaaaacataagggaaagaagatgtgttgtgaagcagaagttgcaacatgaaagagctgaacatttcgatcaaatcttccattcagtagtttctagaaaatgttcactctaaaggacttatgaacttccccagcatttccacttttcggtcgtgtggttcactacatattcttgaaaatgatcctatacaaaatcaaagctaacaagataaaacagaaaaaaggcagcactataaacagaacttacacaggattatatgcaagactagaatgcagcaaggagacagaacatgataatggctgatgtagcactaagtgcccaagacaaaaatgcaagcgctacagcaagttcgaatctcccacaaggcagttgtggataccttctgcagaaaagcacgtcccttttaaacagaaccataacacctccagctgagcaagatgcagcaaaggacagaagtgcagttacctgcatcaaatagatggagtcaatttatgctgctgaagtctgtgaattataaacgtggttgcatgaatgacaccccaattgctcaaaaaatgtcgcaatttgattgaaaactcaatccaaaccaggttgcataccatgcaaacaacatagatttccatgtcaaacaatagtatttttatatagaaaataaagagaactacaacaaaccaagctccctcttgccatataatagtagaatgcactatattgcagcaatcagttatcttcagaaaataaaaggcacagcaatcaacagaagttgcctaacctattctattgtaccctctaaatggcacttctgtggtgtttgctccagtaggaagtgtaacaccatataggatgtgcctaactatcacaaacaatctagtggagctgatctaaaaaattttggatcaaacaaaaaaaaaatccaaggcaacaagttaagtgataagtgatagagttacagagtttaatcattacccagtctccaatgacaaacaaactcacgagaagagcattgttgagatcccttttgactgtcaaggcatacacgtcaaggcatgcaagtcccaagctccacaatgattgtaatcccattgatgcaatcaagtagctgaaatttgaaagccacaacaaactcattacatgattcaaaggaagattgcgccaaagagggtgcgaatacaggaaggaccgttgtaccggtgcctactaaaaccgactaaatacaaagttaccaagaaaaaggtcatcactgcactagaattgtaatacgaatgattaaggtacaccaaatccacatgcatcatatgaaaaataggaaacagagcataaaccaaaggggattatcaattatctttgccgaatgccgatataaccagcattaacaacaaaagccaatgttataagttatgacatgtacacatacctcgtgaacataaacaactggatagtatagtgatagcttcataattttttttcagatcttattagaggttgtaacttgtaaaccacattcccagctaacgcacagctgccatttgatagtgaaaggccctcatttctacgattctactcgcaattagctaagctccttgtgaatcatccactcctcactacccaattttggaaggccgcaagccaattactcactaattgttccaaaaccatcgagcgcaaaattcatgctcttcactgcgccccaaccgaaattacccaccaaatctgccatcatcaactcgcattgctccaggcgaagagaggggacgagacgacacactacacggatcaacaccaccaaaatacgaaactccgccccccaaaatcaaacgggaacgcgtgagggcaccgtaccagaaggccgtgtagttggcgaagccggccccggacgccatgacgccgatggaggctccggcgaaggcgacctgccccacccgcatcgccagcccgccccacgtcccgggcctccaccacgccacctcccacatcccacgaccccccaaacccctcctcctccgccgccgccgccctccccctcacctacctccaccaccggccatggaccaaccggatcaccgccggcgcactccaatcgaggtggttggaaaccaaatcgcgcccaaaaccgccgcagtttctaggctcacactcgcggaggaggaggaggagaaaaagggggaggaattctggctggcgccacggcggtggtggtgttagtagagttgttggtgcgacgctgacgctgacgagcgcgcgcgagagagagagcggcgcgggacccagctgcagcgtgagcgcgtggatgacggaggcgaggaggaagacgacgacgacggcgacgagtcgacgaagcggtttgtttgggctctccgatctggagatccgacggctgtggggttagccgagggggtggaggatgagcggtcgcgatcgtttgttaacgtcagggtccgtacgctgacaagatggcgagcgagtgagggtgtgtttagttcacgccaaaaaaaattaaaaatttgatttaaattggaacgacgtgacggaaaagttgaaagtttgtgtgtgtaggaaagttttgatgtgatagaaaaattaaaagtttaaagaaaaagttgaaccagatgtgaaacattgaaactgcaccgctgttgcacggatgggtagatagattttggcattttggtacggaaaggtggcgttgttgcttggattatgcatttatgctgcatagaccgcatggttagagtaaaaagtaagcatgagtagtaataattagtaaagcgacccattgacaaaatatttttcttcgacgtgagatttgtaactttttattttggtgggttttaagttttgtgcattgtacatgaaagaaaagatgaagggagtgtagcttaactggttaagtttattgtgcttaaaccaatccatccggatttaagccttagatttgctaaaagtgttatcattttcgactaattattttcagtgatgtacgacatactttcttcgtccaaaaaaaactcaacctagtattggattgaacgctttctagtatgtccagattcgttgtactaaaaacatcacattcaatactatattaggttttttttgggacggagagagtgccaattaacaatgagacaaatgcttcgatattttggagatatttgtagggataaggggcttgtttgatagagcttcgacacctaaatttagtttcaggagttgagtctatagtgaagttttagagctgcataaacccatctccatctctctagttcattttgtgagaaaactccacccagttctgctcctattttttatgaaactgaaattatttggctgaactctagcttgagctggagatgtgacaaacagatccaaggtgtgagtgtgtgggggtgaatgtgtgttatgagtaagtcttggccctactcagcaattgaaaaataatgctggcgaaaaagaggtttatatagtttagtaatcgaaagggtaaagctatggtcgaagtggaggtgaaagtaatactactgctacgtcagcgtggcggcgaaaagtggtatgcgaatattcggtgcgatttcttttcttttacggtaacagaaaacgcgacacaaacaaacgggaccacctatacgtttatcgataaattttcttctaaaaatttgacagatgtaatta

SEQ ID NO: 20778 - DNA, 657 bp, Oryza sativa
ctgctataaatgcggttaggtaagcccgctgtgctcacctaacccacacacgtggcgccaaaaccacagggggtcggggcgccccagccctcggggccgaaacgggagcggcccgacccctcggggagacagagggaggggtggccacgtcaccctcgggcccgacccccccccccaagggggtcaggccacgtgggtgaccgcggctacccaagcctctagttacgatacccccggccccatgtcaccgacagtagcccccggcgttatgccagggcgatcgcccccctcgagggaagcgctcgggcgtgacgccactccttaggcccggtgacaggtggggccggtccctacaggcgggcagaaacccagcggtcgcaaatcgcgcgcatcggcaagggaaaaccgaccgacaataatgagcggcctctttaagaccgctacattactcgagcagcgcgcgaatcgggacgagccggttcgtttcgcctggagacatgatgatggcgcatttcacggttggcgggcgtagttaatgcgcgcacgatctgccccatctcaaccgccatggccgcacatctgccgcatgcgccgcaaacaggcgagtggggttagtggaggcgtgggcgcgagaaacgagggggcgaggtagtgggc

SEQ ID NO: 20779 - DNA, 8424 bp, Oryza sativa
ggcatccctcatcccccaaggggccctccccctgtgctgtgatccagagcgcgccaagatcctggccatcatgcaggtggtcggggcgtcgggggagcgggccccccgaggccacgatggcgcgggcgggagcagcaggggggaacactctaccccgggagggggtcgtgcttctgggccccgcgacgggggcccggggggcagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggctccgcaagatgggggggatcgtgccatgccgggggaacctcatctcgcccccgaggtggtcgtttagccgacctccccgcaggttcatccccgcgcccaccgcggccgtattcattctcccatctcccaaggcgagttttcactcacccgtttctttttgtcttctggtttttcttctgcctcagcgagatcccgtcgcctcccccccccccccccgccattccaagtccggccggtctgaggccgaggagacggcgaccgcagaggcccggaggcgggaagctgaccggcgagaagccgcggaccgcctccgggaagccgaggaggctgcccaggaggccgtccgggctcgccaggctgaggaggccgctcgggaggaggccagactccgtcgggctggggagtccatccgggaggcagaggcggcgcgcgcacgcgaggcggcctgccaaacccccgacccgactccgcccgaggcgacgatgacttccgaggccacccacgacgaggccgcgggcgcgccgctcgggcccgacccctcgggcgacgcttgggtcgagccagcttcgggggacgcccccgagtccggcacgtcgatcggagggccgagccgcgcggcacccacaccgagggggctctcccctctgccttccgctgccccactgagcgcggagcccctcctgcaggccttggccgccgcgaacatcacggtgctggactggttaagtgcctagatggaggccctgcaggcggagcgggcggagctcgacgcggcgtgggcgcgcgtcgaggaggggcggcgctcggtggaggccatggtggaggtgggccgcatggcacaccgtcggcacgcctcacaactcgaggcccgtcgtagggacctggtggagatcgccagggaggtggaggaggagcgggagactgccctcatcgccaccgccgtgctcgacgaggcgcgggacgacctccgcctccaatacgggagccgggcggcggagctagaggagaagctcgacgccgcccggggagcccttgacgccgccgctgcccaggaacggcaggcggcggagaacgaggcggcgtcccggcagcgcgaagaggcccttgaggctcgcgccacggtgctggaggagcgcgcccgcgccttggacgcgaaggagagagacctggcggaccgcgaggccgccgtcgccacccgggaggcaacactggcggcgcacgaggccgcctgcgccgaagaggagtctgcactccgcctccgcgaggacgcgctcaccgagcgggggcgagctctcgaggaggccgaggccacggcgcagcggctggcggacagtctgttcctccgcgaggcagcgcgggaggagcaggcgcgccgcaatctggaaggcgcccgcgccgagagggccgcactggatcagcgggccgctgagctcgaggcgcgggcgaaggagctggacgcgagagcgcacagcggcggggcggccgtgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccgtctagaccgcgccgggcggcaggcgggcctctggggcgggcggtacgcgaagtacgccgtcaaccaggggggcctcgcccagcgcctctcagagatggctggggccctcgagcggttccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggacggcgcgcgcgcgcaggtctgggacgccgccgaccacatcgttcacagcttcgagggtacggcccctcggctcgcgttcgcgctcgactccgacgaggagggcggtgacgacggtgcggacgacagcgacgacgaggccgacgacccgggcgcgtcggagtgagcccccaggcccccgccaatcttaataacttttccttcttcttccgaggccttcggacccccttcttgtatagactgatttaatctgcaatcaagtaaagaggaaatttctgcgtcagctctgtttgttgtgtgtatgagatgaggatggtctgtgccgcggtccttctgtgtcttggcttgaacaagggctcgtgcccaggtcccagcctcaaacggcgcgggtcggggctagtgcctggggagatcctcgtgtcgagactggccaggccgggagcgcggtgaccgagggttaaggatgacccgattgtgggcctttgccgattcctacccggagttcaccacgccccggggcacggctcggttctgggccccgtttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaaggtaagtatatgcatgtggtagcccccgaccaaccctgcacgcccgggggggtgcggggttggcccgagcccgagacatgacacccgaccccactaggggtagaagcgacgaaggtgttcgatgttccacgggttaggcagctctgtgccgtcgctcgtggccagccgaacggagcccggcagggggacgccgatcactcgatacggaccctcccacattggtgagagcttgctcagtccagaacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatattgaaggtcttggttttgaggcccttgaggatttccgcgttggtgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatattgagcccctagacagcaaacggccacgaaagaggtatggtctgcagggcctgggccgactgatgggtttgcctggcgtggaactggcacaccctgcaccgtcggaccaggtcgaccgcatcgttgagagccgtcggccaatagaaaccctggcgaaaggccttgccaaccaaggtgcgtgaggcggagtgggctccgcactcgccttcatggacatcggtgagaagctcgacgccttgttctcgaggaatgcacttcaggaggactccgttagccgcgcgccgatagagggtcccttccaccagcacgtagcgcttggagatgcgccggacgcgttcactcccttcgtggtcctcgggtagagtcttatctgcgaggtacgcctggatctcagtgatccaagcaatcaatctaggggagctgggagcactcccctcgggtcccgaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctctatacgccgcacctggcgcacgtaagcgtccatctgcgggtcagagcaccggtactccttacagagttggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgtaagatttggccgagggggtaagatgtaaccaccgtgacccgatgcacctggaaataatggcgcaacttcctcgaagccatcagaatagcgtaaagcatcttctgggcctgagggtatcgggtcttggcgtcccggagggcctcgctaacgaagtagacgggccgttgcacctttcggcgggccgatcctcttcgccaggggccgcatctccagggcgctcttcgtccgagaggctacgcggggcgcactcggcttctgtgccgacgacctcggggtcggagggcgacaggcgcggccttcccgcagtggccccggggccatcctgggggtcgggggcgcctggcaccgtcggacaagcaggcggagggccagctccggccgtcgggggccttgggccgccgttcggctcgggggcctctcctccctgctctctcccgggtcgagtcgacgcagggtggggatgcgcagagtgagggttgtcctcgtcgcgctccacgaccaacgccgcgctgaccacctgcggggttgccgccaggtagagtagcaacagctcatctggctacggggcgaccaggactgggggagaactgaggtacgccttcaactgagtgaaggcccgctcagcctcctccgtccaggtaaatgttccggagcgtttgaggagcttaaataggggtagtgccttctctcccagcctcgatatgaaccgacttagggcagccatgcagccggtgacgcactgcacatccctaagcttgctgggggggcgcatccgctctatagctcgtatcttctcggggttggcctcgatgcctcgggcagagaccaagaacccgagaagcttgcctgcaggcacgccgaacacgcacttatcggggttcagctttatgcgggcggagcggagactttcgaaagtttccgctagatccgagagtaaggtctcttggttgcgcgtcttcataaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacggccaggttcgccagcctctccggatggattgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccaccggtctccaggcgaagacgtcggcgtttgcccgcaggaaggagacgagcgcgtcttcctatttgtcgtccagaagaccaccgattcgtgtggtcttggacgggccgtggcccagggcaacctccttgaccgagacctcgtcgcacgtgaccatccgctgccttggggcggccgggacggaggtggcgagcctcttgtcaccacccgcgggcttggacgccgcggcgaggtggtccgcgcgctgctccatacaagcaagcgcgactttgaggtcgccatggacggtaatggggccagcggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaacctccgaaggtgaccgggaggtcgatatgacccagcggccaggtgtgccccggcgtcacaccgatgatcggctgggacggccggagcaccatccccgtggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcagtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcaccggttgccggcgggagccgccggggtcttgccctcacggcgctcctgcctcttctcctcctcccacttcctcgtccgttcagccaaacttttgaccgcgcggcagtccgcgaggtcgtggagggaggtgttgtgcacggtacaccacttgccggttgggcgctccctgctgggagcgccggcctccttctttttgtcgctcgcaggcctcccctttcggggggcccgcgaagcgccctcgacggcgagaacatgaccctcatcgtcggaacgggccgaccccttcttcctcctcctgtcctgccgccctgaccgagcggcggacccgggggcggccggagctgccactccagaaccggaggagttccaggtccaggcctcctccttgcgagccacacggtccgcgagctcaaaaagttgcgcggtggtctggggctccttggaggcgatcttctcgaccatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggttcgacagccggtaccgccaaccggggacacggggggccggcccccgtgcccggaccgaagtggcgctccggacgaggaagcgccctccgttgcgtgggcgg

SEQ ID NO: 20780 - DNA, 1092 bp, Oryza sativa
aatggcggacgaacggcgggtaacggccgccgctcgccgcgccctccgcctcgacgacatggagccggcggcggctgcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgtgccctggggcgtgccgccatcgccgtagacgaggcggcgacgcgccccatctcgccgtcctcccccgtcgcccgcggacggcgaagtcgcggatctttcgacctccccgagcgcctccccccgcccaagatttcggcgagaggggaacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttagaaaaacacgcgcgccccctacctggcgcgccagattacggagcgtggggctcctcaccgggagaccgcgcaggcccccctttgccggttcggccgggggcgctaagtgaggttcttcgccctcgatctgaggaacgtcagcgagagaggaaatgcgcaagacacgggcgacgtagacaggttcgggccgctaagaagcgtaataccctactcctgtgttctggtggatctgtgcgtgaaggaatacagagaggccgagagcgaaagagagttcaggctgtagaaacccttcgccagagtccccactccccttctttcctctctctcctttttttctaggcctgggcctcctttttatctggtcaggggtcaccacatgggcctctagctgcctaagaagggaaacatgctttttacaatcagggctagttacagccggaagtgacctctgacaagcagagcacacgcctcctgccctgctcacctgctttcccggtggacgcccatttcaaccttcatttaatggccagcgacttccttgccatacttgcgctgaagcctagaat

SEQ ID NO: 20781 - DNA, 473 bp, Oryza sativa
gcaagcatgagctcattttgtacgcacctatgcataccacctattttttagatgaaaatgtgacatcaatattgaatttgaactttaaagcatgcacagaacaggttcgcactgcacatgttatgaatacgtatcagtatagtgctaaatcataaactgaagtgtacccaaatcttgatccaagtattggtactaaacttcctgttgtatctgtccttttgaggttttgcgaattttatcctgattttttttttgccttgacagccctgcacgcattatgcacgtggttcttgtttgaaaggagatgattgcccttatgatcatgagttgtcaaagtacccttgccacaattttatggaaaatggaatgtgcatcagaggtgataaatgcaaattttctcatgtggtacgtaatttaacaaatcattcactcttatttaattattggtgttatagcctggttaaattttaata

SEQ ID NO: 20782 - DNA, 438 bp, Oryza sativa
ccacgcgggcgcgcgcgcgaacgacgcgcggggagcggcagcgagggagcaaagaggagggcgcggctcggcggctcacgcgcacgcgcgcgcggcgcgcgggcggagcggagggggagggggagagagagagagagccacagcgagagacatagccggcaccaacggggtagatgggccgagagaaattcggcccatcgaccctgggggagacaaaatagacttttgcggaggaatttgatttggaaggatttggattcggaattgaactcgacgatagatcggggatttgagatcttgagatggcacggacactagacaacaagcaaagaaacaaatttcgcaactagggtttttaagagataattttcccgctaggcgccacgacggaacgggcgttacagaccaacccccctaacaagaatctcgaccccgaga

SEQ ID NO: 20783 - DNA, 26300 bp, Oryza sativa
  unsure (1)..(26300): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatcaaactcaaaaaagagttttactggaaaaaaattaaaagtgtcttttaatatgaaacggatatgcagtagaaagttccttttcaattggtcgacacccatgagcgtttgcttactgggcccaaatcagatgggtcgggccggatactccaaacgggcctactaatcctttcgtcttctcttctctctctcgccgtcgtctcgtctcgtctcctccgccgccgcgattcatccgacaccaccggcggcatctccggcgagcggcagcgccgaacacccccaaccccaccgagttctttacggctggtgtctcccctcccatcctcgctaccgcgtcgccggcgcacggggagggtgggggcgtggcggcgaagagattcctgggatctcaggggatagtggactatggggtcggtggatctgatcgccgcctgcctcgactccatccgccaggtcggatctcttcgcgacttctctctcttaccttgcctgctcggattcctcattgtttgttcgatttctttttattatcatgtaagagattaattttgtccgggttaaactgaatgtgtaagaagattcccagaattttcagtttctaattatctgaattttgcactttggagatgaatatgagactactgcgtttaattggactattggagcgatgaaattgttctttaaaaaaaaacccatctttacagcttcctgaccgtatttctttctcgttccaaaacgataaattacaggagctgcttaacttggtaaagatttatccttttagcttctgagctgacaagtcgctgttattcgttcgtgattaacttaagctgtggataactttgagaaaacaaattcctatttgatgatttgcatgtaaaactaatggactttatcttcgtggctttcactatagaaatttatgttctttttttggtctgttgctgctttgcagattggagatgagattgcagatgcactagtgtaccttgatgcaggcactctggaggcgtttcagtttattggagctttccccttgcttcttgagcttggtgctcgtgcaatttgcagcttggagaatgcatctccgcttgatgctgtgagattacttaaatcccttgccataaaagtcaattaattatactagtaataaagaatagatatggtaataatgcatactacctcccaaggtagttagccagtaagctaatagcaatgcctcccaaaagttgcaatgttgtctgctcagtagtaatttatgtgtcaaactgaatgcagcatgttgagtgcaccaaagctcaagcatttttagtgtgtgtctggcacatgagtggcaaagtttaggaagaaaccatagttgcaagtggcatttgtttcttgatttgtgtcaacttagagctaaggactactccctctatcccaaaatataaggcatggtcaaactcgtcacggtctccaaaactaatctttgactcataatttctcatatactataaagtttgtaggaacaaaattatagccatttgaaagtgtattcaaatgtcaatccaatgatactattagcaaataaaattcaatttatattatggtatggagggactacctttttggtcctatgacatcttgaatttctgtacttcatatttctttttcattctgaacttcttatagatgagaagcagtgcacctaacagccttcatgttaaccttagtgtcaaactcatattttcttatataaaaccataattttctttgttcatgtacaaaaagtaagaaaaaattatgcttttttttaatgacaaatgtgccatcctgttctttacatgatcaaaatgccgtaacttgtgtttggcaggctgctgaatggcactcaagttttgcacatccagcaaggaagatagtagtgattacatcacgcctgcttagtgatgcacatcggtatattttgcgctgcctgggaaaccatggaactatttcacattgtactgtgttgacagctatttccgaggtacttcattcctgcaagaatttgttactttgatgcctgtattgcttctgaaatgcttgaacatccagccattattttcctacaattatcttctgttcacatcaaaatggctttagattttattttattttattttttgcctggggcttaagttcctatttaatttcctttgaaaaaggtacatagtccatgttagtttccatattatcatgaaggtatcatatactatatctggattgtttgatttatcctttctccaggggatggtctcaacactcatgtatgtagtttgtattgttgcatgttgtccatttggaagcttatctaaaccattatttattgtatgaataatcttaatgtcctcttgaattatttgttgtacatagtatagctgaacacatatgagtgtattagtatgagctaatttgtggactttgttttgtttgcaacctgtggtaacttctgtggtgctcaaccaaatgttgataaacagcaatcttgcttcaacccatattataagatttttttttctttttgcaaaacttaagagtttttttattgaaagcaaaatcatcttaagttctgcaagcaggatttgaatcatttgtgatatattgcaggttggtcactcagcatatgttgattccccatttggaccagatgccttccgggagtatgagacattacttactcaggaccatgaggaacttctgaagaagtatgaaaagtcagatgagcacaaagataccactttttacacaggaaaagatttcacatcggatggtggtagatactccaattgggaatctggggtgcattatggctctaattctgaatctagcccaacaaaaaaggatttgtttgctgatgagtcaagccagctagaaactaaaggaaaaagattatctgtaactgtgactcactttccgatgattttctctcctatttcctctaggacttttgttttgccatctgaaggcacaatggctgaatcatgtttatcaaaccatcatgaagattcccttagtccagggctacctcccatatctactggtagatcttttgatggtgatgagattccccccggagtgacattgactgcccagttcctttaccatctggccagtaaggtaaagatttatcataagaacatatttcttactagtggcttcttatttttcattcatataaccacttagtgatccgtattacaaaacatgtgtagatggacctaaagctcgatatattttcacttggagatacatcaaaggtcatcgggaagctgatgatggatatgtcaagtctatatgatgttggtcgtaataagagatctgctggcctgctgatcgtagatcgtacacttgatctccttactccttgtttccacggtgactcatttcttgataggatgctgtcctccttgacacgcaaggaagggacttcatcctattttgtgtccaaaaatccacaaactccaagcaagcattctgaagctactgttaaacgtatcccactagatataaaggtcccttttgaaaaggtcttcagcaaggaagaacctaagagtaggaccagtatgttacccgaaagtatcatgtcatttgtgtctggatggaactctgctgaagttgaatctgaagtaacctggctacctgattacgcggataaagctcatgatgacaaactcagcagtcaacatggtagtttaaatggttcattcctatccaattatgctggagtgtgctacttggaatcattactcgacagaggagcaaaagatgggttaatgttgattaagaaatggcttatggaagctttacaacatgagaagttatccttcccatccaaaggtcggcaaggagctgcctctgtttcagagcttcattctatggttcaaatgctctctcgagaccagttatccttagtaagaaacagaggggttatccaattggcactggctgctgaaatggctctccaggagcctcaaagttctcgctgggatgcctttacaagtgcagagagaatattaagtgtaacatctgcagagacaactcaaagtcttgccagtgagcttcgtgattttatcaacactagcacttcagttgaatctcacaagcaagctaataaaactgagtcctctcagggccttctaagtttccaggatgttttgcttctaacaattatcgggtatatcttggctggtgaaaattttcctacatcgattgctggtggtccattctcttgggaagacgagcggtctttgaaagatattgtggtggactctatccttgacaggccatcatctgtgaagctcagatttcttgttggcttggagaatgagcttgaagctaaagctagacctaaagatggtgacaaaagtaatgactccatcgaagcttctaagagtactgatgattttgatgaccaatgggatagctggggtgatgatgatgataatactgatgatcagaaggatgaagcttatggggacatgcaacttaagttggaagtacgagacagagttgaccagctttttaagttctttcacaatttgtccagtatgaggttaaggaaccaaactcttggagaaggcctagcagcactgagcagatttgagactgacatatactcaagaaaaggcttgctctataagttgctattagctgtcttggcaaggtatgacattcctggccttgaatatcactcatcagctgttggacgtttatttaaaagtggactggggaggtttgggctaggacaggtgagttattagtttgtacttccttggttcctttgccaccactctgtagctatcctttctcacactcaatactatctgcagtctaaaccaagctttggcgaccaaagcattctcatcgtttttgttgtgggaggcatcaatgcccttgaggtatggtccatattctttggtttcaagtattcaatcataccagtatggcattattgaagctgtgtttctattatactgtttggtgtttaaatataaatatttgtttattttgtttaaaactacagtaagaatcctcaaatttgacctatattttctatgttttgctagtgtactggtagtgtggcactttcagaaccatcagttggtacacgattcctatcttcaaaatatcaggttacattcccatgtagaaaacatgaggttttagttagtgcactttgaaaagcgcataaaattgcactcatccaaataagagattacaaaccacaatagaactaaaaggaacttgcaaaaagttctctttgtaaagaaggtacatataatgtctgatccaatctgccgccaaaacatttgttagaatggtaaggaacctttctatattggaggagatatggaaagggatatggatggttgtattggtatatcaatatccgttgggtgtggattatccaatattttttaactgattatccagtgcttgttactccctccccaaattgatcatcatataatagaaactaaaatttctcaaattgatcatcttataaccgcatggacacggatttcatcggagtgcaattaatacaacatgggagaatgtgtatatttgtgcattatgttttaatcaatgcatgcactgtgggagaatatgtgcatattgtgcatggcgtcttaatcaatgcggtttaaattatcctaggtcttggtacacaaacattatacgatcaatttgggatggagagagtatttggactatctgcaacttttcccatctatgattgttccttttctctgtgcaatttgtgcttatgtgttggcaaagtatatatcgcagtgtgaaaaagtaaatctttaacaaattaaatgatcttttctatgcaaggtccgggaagtcatgaaggcaatatcagacagcagcagacctgatgtggagcttattcttgggggaacaacccttcttaccccagatgacatgtttgagttgatgttgggctcatccagctttagttagtctcaagcttaattgttgagaagctcagtccagttaacaccaatgcatctgccttggacatcttaagaatgatccagatcatttctccggaagttctttctccaaacgtggcagttcagatactgaaactctaaagattgtatcttggtgatgataccaacagcaagcataggcaattcaattcataagctcttcagatttttaatcgcaactgaatgcagcgatacagttcgtcttttgtaggacagccattgaaaacaatgacttttgagaatcatcttctggacattcattcatgctttgctcaaaagctggagtctactgctttggatcagtcactgtatttgcaagtgaagtcaaatatgaagtgaccctgctgactacacagtaaacactcaaaacaaggtgtaattctgtcttaagttctcttgctcctagaagtagctgctcttccgttcagaagccatatgtaaatttaatctatgtaaattgtttgctgttgattcgaaaatctttggtgttcactggtcaggagaactgtcaaattaggtacagcattgtaactgaaagaacatcattactcagttcagtgaactgaagtgtacatgcactatgttgtgacttgtgagtaatatcacaacccccaaaaaaaggcaaataaaattaggaatagtttgttatgttccagaaaaaaaataaacatatcataatgtgtgtaattggcctttctttttagtaggctacattttctggtaaaacattaatggcagctttcataatccaagatacataaatgtcttttggaattgtttgtagaggagtggaggcaacaatagaagttgccatatcagaattggtcagtggttttgatttgtctgtcagatgtgatcttccaatgctcgagggacatggagaagttcagcttttcagtggcattattggtgagccatgcagcttaaggaggtttgtgatggctttcagcttggatatagtgatgcatttgaagttcattcatggtagatcaaaagggctccaattttgttgaacattcttgttcctttgaacctaagaaacatggatatgcaagccatcaaataaaacttgagctctacttagtcaacattggggtggcgcgatgccaattctttctagatgaaatgcggatgtaggatgatggatgatcgatttgtttataggaaatgaatcaaataattatattttataaacctaacaagtatatcttagaataagtagcctaagtaatacttttgaaagtgtggcgcgaataatccataaatagttctggcccagtattccaagaataacgggacaaaacaaattcctttgtgttacattttgttatcctgagctgtatcagtaatattgtttaatatatgctttacagtggtattgttcaatatgtgtgtctttggatgttagtggcatggttggaaatgacaagtctgtatgcatgttggtttgaactttgaaccacttctaccattaagctttcctatttgccatttacctgaggaatcttggggttcacatattgcagattggacccttctcaattattgtcacagaaaagaaaaaagatgatcacacacacactgacacgtacttgagaaaaaagggagcttctcctagatctgaattctgacattagacttgtagagacactgggagtgttgcttaatcaccctgcagtctctggcctgaaaatgctagtgcttgtagcattgcttggcatgtactgtacctgccaggcttaagctcaacagctgtggttagttagtgctgggctaatcaaaatatttaacctgttctttgtgtgtccatggaacggcagacatgtcaggatctgaataatccgtgctcgtggatggatgcactgaagatgcatgcagggatgtctgcttgttcctgctgcagtgttcagttcttgcaatttataaagcatcttgctcttgctgcctcctgttgtcgttctctgcaactgggctatgtatcctgtgatttcgttgatgcattctgttcttttccattcttttgtttcttgcaatgtctccttctgtcagctaacatgatgttctttctcaaacagaaagagagagaaaaaggttatttagcagattaccaagttatttggtctaacaagctttctgattgtcattttgattgagataagaatcaactgatgataattcttctactaatttcttagtcttgcagcagtagcattctctctggcaaggttaattagtggagaaattttaccttacttgaaaaagtctttgttaattagtagagaaattttacactaaaaatttttatacctcaagatacctagtatctataggtaccaagtttttcattagaaaaatataatatcttccgatactttttttttaaaggatggtaaagactaaagatttccctaattattactaggatcatatagcagcctatactaatctgaaacggttaacacataacttcagagttttcagagctaaaccccacatcttatccatggctactgcaactcaatcatcctgcactgcacaagcaacagaacactgatcaccatcaccagaaaggaattttcctgttgacagtgtgttcaggcatcaggacaaggaggtgaagtctgaaaattgtaggctcttgctgcatctctgaacttttgctgttttgcactgcactggcattgcatgcatccagcttgctgaatatgatcactgtccccggacggcccaccggagacggagaagaaggcgggcgacgacggccgctacagacgccgaggagacggcgcggctaccgaggccggaacgtaccgccacggcacatgatccaaggcatctggagtctagctgaacaaacagttgagctcaaggtagagacgagctaagctaggggtgattaatttggcagcaactccttgttcgtttttcttcagaaatgttcagagttcagaacccatccgatcgaaacagttgtggtgatggaaggcagctcatgccgtggagtgttttcctgtttggtgttcgtcttcctcccacaatccgttgtcatctagctgttagcgtttctgcagagagagagagaggtgtttgtctgacaagtgcccatggaagctgtccatgctctgaccgaagaacaattcagacacttgaagctacttaactcaataatgcctcttgctttgtttcattgtggatattttttttcttctattagaacagtagagtttgagatattataccgtttctatgcaatgcaatgtgtttcatgtcatctcatgttccccacctgcaaatttcctgaaatcttgggagcagttaacataaacctgaaattttcaatgcaatgtgttaaaaatgttaaaaaaaatttaacacattgctgatggtgcatgatccaatacattgcattgcattgcagatttcagatgttgcaacatttttttttggaataattgttgcaacatttttaactgcaacatttttaacacgtctgaaaaactggaaatttctgaccttgcaacatctttaactgcccagttagctggctcaatgcattaggattcttattaacttatcctaaaatcttaccacagatccaaactacagagccctcatgatgcaaccatatgagaagctgagaattactactttgtttattcagtcctggacctcctttgtcctgtggctgcatccatgcatgcatatatcatatatcatatatgactttatgggactagatgcacacatatggtctccaagctagtcctttcttcacatcacagtaaggacatggaccacagctttgtagcatcagcttcagttgatgtatacttatcttcctttacccttttgtaattagaattcagtatcaccttttctgggacaaaaggtggaccattgcatgcatggatgcaaatgcaggcctgcatgcaggttcttcctctgatctgcaaagcttgcagactgcatgcagattaagctttttgccctctctgtcagtcatgtgattcttcaagtgtgattgtccttgagggatgtgggtatgatcatcagttaacagcatcatcagcaccattggatgtctctgcattgtaaaggatcaaaggaggccattagcattggtgtattggtaggaccatttgatttgatacacccaaacatatgtgcacttctaaattgagtactgccacggcatgaaaagttgaaaacttgcttgcaataatacttgttcacttactagtaggaatctgaatctccaatacttgtttaaaagacagaggcatgcacaacattgcatcacagaagctatatccatttctatcaaattaattaggaaagaaatgaaacgccaacaaaaaaaaacctaactgaacatgcatcacacctatgattcagagagatacatatagttcaattcgatccatcatatatcatcatcaatcatacacacatacacacatacatacatacatacatacaggaattaatctctctcctcacagacactaatcataatcaacaatgccatgagctcgatcgccatggaagattaagatagatgatgaagctcgcatgcaatctctcaactttttttttcttctctctctgtgcatcaatgcaattatgcaacagtaggtagcaggattaattaactcctcatcaagaaattaaccatggtaaaaaaaattaaaattctagtgtcttggagggcactggtagcacttggtgaagaggccaaaggtgtcaacttggcgaacgaagttgaccgtgctcgcccatccgccgaagccgaagccgacgacgagcacccacgcgacgacgaagcagttggcggcgaacgtccccggccagccgccgagcgcgcgcggcggcggctcgacggcgttctccctggcggccgccggcgcgaacgtcgccatgtgcgccatcgccgggatgatgtagacggtgaagctgacgaggaaggatccgacggtggagttgatggggccgaagaaggggaagatgacggcgaggaaccagatggggagcacgacggggagcctcgccgccgcgcggcggagcacgccggcgccgccgtggacgccgatggccttctcccacacgaagtagagcggcgtgcaggcgaagccgaaggtgatgaactggtggatgagcatgagcaccaccgcggcgtcgcgccacggcgtccgcggcagcagcgcgaaggcgttggagtggtccagcagcgcgtccccgaacgcccagtacatcgccgccgccgacggcagcgtcagcgtcagcacgtacgccgtcgcggcgaggtagatcatcttgaaccgccgcggcctccacatggcgtgcatgatctccaccgtcacggcgtggccgccgaacgtgtagaggatgttggtggcgccggtgaagtagagcaccatcgtcttgctcggcccggcgcgcggcgccgccccatccaccttgccgtgcacgacggcggcgacggtgaggtaccacgcggtgtaggacgtcatgaggaggccgaggaaggaccagacgcggtagttgtggaaggacgggacgaacaccgtggtggcgcagcaagccccgaagatgtaggtccatgtccgcttgtcgaggcggtcgttgatgtagtagatgttgctggcgcaggcgatgagctggatgacggagccgaagaggaggaaggtgcagttgaagaggaggccggcgttgcgccaatggcggccgaggaggccgtcgagcacctcgaaccactggatgacatggttgcggaagtccaccttgtcgcgctcccgccgcgtccggtactcgacgtagagcacgctgatgaggtaggccgtccacgaccccatcagcccgtagaacacctggaacgccaccccggacgccatgcccagctgcgagaaggagtagggcagcgtcagcagcacctgcgccacctgcacagaatcacgccattgatgacgtcaagatcgatcgtagtgatcgccatgagagtgtcatgtcatgtcatatgacgacggattgaacctggttggaggcgcagctgaaccaggcgtcgtagacggagccgccgtgccagaagaggctggagacggcgagcttgccgcgccgcctgcccgacgccgccgcggctccgccgacgccttcgccggcggtggcggcgccttcacgctccatctcgacgtagttgcccgccacgatcgtctccaccttctccgacgccatgtcgatcgatcgatcgatgcttgattgatttgcttctgaattgtgatctctcgatctagctagctctgatcgatcgatccactggatgaactggggtcttgtagttaattggatgggcacaggctgtggtgcaggctggctattgatttataaagaagacgctcgtcgatttgtactgtcttgtcgtgtgtattttagaatttagagtgatgagagtagctagcatgtgtgtatgtatgcaatatatggatggggcatgcagctagcagcacacgagcggccatgccactgatataaacaagtgataacaactacacatatatctgagcttatttgttattcccgatctcttctttcttgtatttcatagtcgtaaaaccgtgtgtcgcacagctattgttattgacatttgaaatattttttttttaattttttgaggtcacatatacatttgtcgacaacttttcttctagaaatttgacagatgtaattatggtacaatcgagttgtaattacattgtaactacaatgtcacttgtatgtaacttttaaaaatctcttcgtagcatgctattttcgtgaaatggaggtcaaccgaatcctctcacatgtacgcacaatttgattttttttccttccttgccggtaagaatcttgaaacaaatctaacaattcaaattttttgtgaaagttgcgtacaagttatattatagttatatgtaaattacaatgtaattatatcatgatagtactataattatatatgttaaatttctagaagaaaatttatcgacaattatatagcaaaactgaatggtttcataattctgaattaataaatattgagttgtactcagtttgtaatcttagttgtagcttaccgacattttgcttagtctagaatttggaatcaataaaaaccccgttgtatccagtttgaagccgggttttataaattcccattataaaaaaaaacattcatcatgaagtataaactcccacaatatgtagatgtagaatagataagtttttaacatgacctgaaaagttaaatgcatatagatcatgttaatatgatccatctaaaatggtcagatattttttaacgtacgtacgaccagtttttagcaagtaccaattaggtttagatacgtaggagagatctattgtatatataaatattctgattgttcattgtgctccaaaataaataaacataatatggaatattacatgttcttagtactacgagctatgattttctactaatatattcatgtatgaaaagatcggagtttagtgtatatattatctctgcatgcatggctccaggggatgatctaatataaggacggcaagggctcgagtctccactactggtaccagaattatgagagctcttataaagatctcactaaaactttttgtcatacatatatataaaaagggttagagttttgtctagtttatttagatctttgctatatctctctgaatctactactgcatggcttggctaggcagtgagacagagagtcgtcaaagacatggaagtacagattatgtatgtatatcttctgaataatcatttctgataatatatattgctgtgatctccagggccggccctgactttttggtggcccggtgcggaaaaaaaataaaggcccccattcaccataaaaaaacaagataatatttaaaaactcattgtcattaacgaatttcaagcctaataccatagtatacatattttggaggcccctaatttttagaggcccattacggtcgcaccgttcgtactgccccagggccggccttggtgatctctatagcagatagctagccagatcgatcgatgcggttggagcttagtactaggagacgtggcccatgcatgcaaagttggccaatgatcaacgatccatgcatgtccggattgttgagttgtgatccaaattcatttacacttaataaaggccagcttctgccgtacggatcatcatcccttttagggttccactatatatatacctcttgtaagccgccgtgcggcgatgtaacctcacctcagatatagtgaaatattttgctggctagcgcccgtggttttttttctcctgttttgagagggttttccacgttaaatctcatgtcttttgtaattgatctattgttttttatcgtttgttcgtctatcgtttcctaacacggatgtccccttatcattggccgacgatatatagaagatctcaacacgacagctagttacactgatcggccatcatctcgattgattgcaaaagatatgcatgcgcacagaggccacttctatccttaattagttaattaacacgaaaaatacgcacttaattagtttttcgatactccctcttttatgaatattgtaagacgttttagattgtgtaagaaaaagaagttttcgatttatcctaaattaagtttcattaatttttaacaagtttatatagaaaaatatagcagcattctcaacacaagacaaatatacaacggaaatattggatttaatgaaacttattcgatgttataaatgttactgcgttttctatgatcttcgtcaaacttgaaccttaaacgactaattataatacggaacggctaatactccatttctctgtttcactatacctatcaatataattttgattgtcactgttttacttttaattagtttgacgaactttcaaatcgtttgttatgatgaacggatatatttattgtctaacatacttcaataatatggtaggttttgaatactcttgaatttatttataagtcagcggtggacaaaataaaacaaagccaatcaaaattagtaaagtattatgaaataagggagtattgtaatatctacagtaatttggtcattactcagacaggaattaatactccctatacgtctaaaaagacttgatttctctaagcaatctaagaaaatttactagtgaagaaaaacaccaaagtgtctcttatttagtattccctccgtttcataatgtaagactttctagcattgtccatatacatatagatgttaatgaatttaaacacatacatatgtctagattcattaacatctaaatgaatatggataatgctagaaagtcttacattgtgaaacggaggaagtattatttgtaggaaagtagtattgccaaatgggtagctaaaggatatatgttgaatggataaaactccacgatttatatggacaagggtaggggataaaaattaattctttttttaacaaatattgaacgcagtaaattaagtcattttgggacagatggagtaataactattttagaagacaatattaatattatttagcagcgtgattaataacgatgtgttcagtggtcttgtgcgcaattagtaaatatttattttagttttcgaaagtgtttatagggataaaatgtacgtgtatatatgttcataggaataagtatgtactccatccgtttcagaatgtaagactttttaacattatccacatacatatagatgttaatgaatataaagacatacatatgtctagattcattaatatctaaatgaatatggacaatgctagaaagttttacattgtgaaacggatgaagtacgtgtgtatatgagcggttttcatctagaaagagtcatgcaatgctagctagctgtttatataatcaacaaaatattgcatacatatagttgtgcgtagtgtaatttgctagtatggaagcacatattatatatacacacacgtactgtcgaaaataattttaatttcctcaatactatactcgatcaattaattgctttactgcggctttagacaagatcagatttcatacaaatatttttttccatatttttattgttagtgacatagtgtaatacatggagggggttctatctctccatctctctcagctgctgtatacatatggtcggcaagcagatcagagagagcagtggcataactaattagttgtcacacgtgtagcacaataatgtggagcaccattgcccactcgtggagaaatcatgttcaagatgaatcaaacacagaagggaccataaaaataaaaaaaaatgaaattaattagaacggggcataatactaattaatgacatagtagtatatataaaaggaaattaacataaggtaaatatataaccatataaagaaatatcatgatcaaattaagcaattaaagtcatatatagtgtattaccacacatttgccaggtcatgaaaccgttctatatacatgaagtatatgtaggtctattatgataattgtagttagtcgtcttggtatgtctatttttcaatagacattatatatttttgagtcgttatcatggtactattcccatcaaaatagtctcttctgactcataaatgcatcaatgcatttttttttaatccatcatatatcaatgcatccggctcagaataatcatcagtgttctttgcttgatacaggagaacttctttgtgaatcacataaaagtgtcaggaaagtggggaaaaaatgtgatgtgtggggactcaaaaatatcaaaattaaattaaagtgtgcgttcacaagttatgattgacaaggttctacaaggaatcaaggaggtaggcctagccaactttttttaatagtgctcctcttttttttcctcctttaatttctatatgattcaataaacaaggggaaatatagtgtactactccagtagtactagtgattaatttggaatcggaatttcactttgcatatactcatattaagtaacaatagaagatcaatgaagtactagtcttggggcaaattcaaatcaaatatcacttcccagaacgtgcagtcatgcaccaagaagttggtaggtcttgattatgatgatgagctctcacttgttgaaacatgcttctcggaaaacaataattagggaaaaagcaaatcctgttgatgtaatactagttgcaaagtagtaatgttatgcgtgtcatcagatcacataagccaatgtacgtagatgatttattatatgaattaacaaaatatatatagtattccctcagttccaaaaataaatatatgtacttctaggattcaaattttataccacaatataaaatttccatttattctcatcatttcaatgtttctaaagccaatcaaatgcttggaaaggaaatctaagcaatttgaaattcaaaaattgataactaaagtgattaaaaaggattttttttacctaacttagtatttgtaaacaacctagaaatctttatattttataatggagggagtaattgctacgtatatatttctacattgaatgatatttaataataataaagatctaaaaatagctctacgattctactattcttaggagactgattaaccaagtgaattacaaatcgagtatatcaaaaactataaaaaggccagcccaacacacagtagaatgaaaatgaagttgcaatgtgttgagagtgccaacctaactaatgtctggaatatttctagcctattcatgaagatcagccaacttttttgacttgcaccaaactgccaagctaacttaattattggaatatatattataatcagcaatcagaaaaaagggggaaacaacaatgtctaccgaatagctagctaggccggtgtgtaattggcttcatatatgtgcatacatatatattgcacaaacgacctatgcttcatacatgaacgttactccatccgtttaaaaatatataacgacctaatataaaatgagacatattctagtaatataaatctgaatagggatttcttagtatcgagatgtatcccatcctgtattacgttgctatattttggaacggagtgaagaataatcaatcaactgagcttacttgcttggtagcttccaactctgtgtgatctcatgattacctttggagctgcagttagctgttggttactaaagaaactaaaggtgcaatataatataatggtacccttaagcttaatctctctcatcatggccgccctcgatctcatggtggcctagctacctttatttctgagactttttcatctctgaatctgccgggaccatgcatatgcatagaggtgccccaatttctctatctttcggaccatctcatcaaaaggacgttcacagatgatagatcaactgttgtgtaataggtatatttgcaagtttcctttaatttcaattttggcatgatcattacacatgttgagatcgatctagagagagagatggcaggagtctttcagctggcttgagtacgtgaaggcagagctggctggctagctagcttatgttgaattcatcacttttgggctaaccagcattatgcattatgcatatggccatatgggcctgattgatgaaagggccattgcaccttgactgaccgtgagatcgccttttaaatgattatgtgtatatcgatcggccttatattaatatggctatactatagtaatatggtgctactacctctgtaaaaaaaaacttcattattttcctatctcacacataccaatataaagtcaaaagactaaaatgctctccatttttttcgaactccaatacatttgttcctcgcttttttaaatctctaatgtatttgtgtttcacttttccaaactttgatgtattaactgtcttaaaaatgaaggcattatgggacaaatgaaaaaggtaacaataaagtctttgtgtgatggagggactactacatatgttttaaaatacaaattgttgacttttgactattcatcttattaaaaagttaatataaatatgaataagtcatatttgaagtatatttaatgataaaataagtgatatttacatactcccttcatcttaaaatatagcaattctagctatatatacggacatacttttatgcaaatacatatagctaagttatattatatatttcaggatggatatagtagtatttttaataagatgaataatcaaattaatttattatcatcaggagtcaaacacatcatatatttaagagtcctgctccggtgctttctacttggagtagaaagcaatctgagccgttcattatatttaattgtagggttgtgatctatttctactcccaccagagttagtggtagtagaaatgtacaaaggtatattcgttcagggataataattcgtgcaggggtattatcataatttatcaatatctaactcatcttcggcgacgccaccgccgtcttccagcactgcgacatcgtcgcacgcttccccctccgcggccagcagaacaccatcaccgcccagtcccgcgccacaggcttctcgttccaggactgcagcatctacgctgacaccgacctcctccgcggtgcccccgccggcagcagtgtggagacctacctcggccggccgtggcatccgatcccgagcagctcgccattctccgacacagtggaaaactaatggctgattccttcgacactatggcaagaacttgccatggagctcaagaacgccctctcaacctcttcagaggcatctctgctaatcaagcacatgacgtactctatcactgatgcatcgcacgtcaacgtgatcctgccatcatcgccggcgaagccaaattcctcttgagacatggcgaggagctcgccgaaaaccaccgtgcaaaggtacaccaatggcaccctcgaaccgtgccccgtcggtggtgtacaccgcgctgtggcccttgccggcgagagacgacgacaccatgctgcagcaatcgcctgtggtgcctgccgtgcccatccaccgaacctgatgtgatgcgaaccgaacaaaacatcccatgccaaaattacccctaaactatattaggagattacttacctgcccttttaaataaacggtcgagattaattctacttgtagtagaatactgcaagtagagtgcaccggagcatcaccctttatttaaaagcagaggtagtcgtagtttttatctagatattaattatattacaacacatttattctgagacacttttgttagacacgtggaggaggataagtctacggttttcatgacaccacaggagtcatcagagcttcactagatggtggctgacactaccaacaaacgacttgaacgtggttcttataccctagaactactatgcttttgaacttcctagtcctagtattgccaaataacctcccaatattctttttttttgaacgatctacctcccaatcttctgaataccttgttcatgtgtatgagccattgatccatagatggtaagtacccacgaaccattattaatttagctagggcatttgtaaataaaatgatttaaatgatgatctgaacattgatgtaaatttacattaggcttttaaaacattcagaattgacaatcgtcttgaaatgatgatatatgtgtgtcgagcaataatgctgattaaattctcatgtctctgtcaccataagatcggtcgacacatccgcatgtgcttctgctttgttcttgtcatgtgtggctctcttccattaattactttgcattgcgtgcatgtatcatatgcttaatcatggctcctagctacagtcgctagtggctggatatctaaatgcaattaacccattcgatatcgatgtgcggctcatttctggagcgtgctcgttgaccaaggtggctagctgaatgcctgaatctgatggcatctcttttgctcaatactccgaataccatcgcaaaaaacagagtctaaaataccattgtataatgtgtcatcgacatatgattcgtattgtgtaactcatgtagtatctctattatatgtgatggtatttttcatatttctttctcttttggtaattagctcaattattcagacttgaataaaaagaactactactttcatcaagcaacatacgatgattacaatatatacacgccattgaaaacattactgctttcatcaagaaacatatatacgatgtttacaagatatacacaacattggagatggcatccatgttgacaaactccctacaaaatcattcgtgaatggaaggagactaccagcaaaaaattaggaagcccacaaagttggccaatgttcaaaataactaaccagcccatgtacatataactgggccggatttggagaaggcccataaacttgtacataaaaaacagtttttgtcactttgggttggtttggttcgtggcctaaataggccttatcaaattttgtcagtgccaaattttagcaagttttagcatgactaattttggtaaggcaaagttgtgtttgtattgaagccaaaatagtttgagttcactattgaaatggcctattttcttaggcatgtcaaattttggcttcaaaccaaatagacactaaacactattgaaattgccaaatattggtaagtctaatttaggcctcaaaccaaaccagccctttggcaatttacagtacaaatataaatttttaatgcgttaataaaattggacaatgttgtctataattttaaatgaactcaatgttctttcatcctatttgaaatacagtaatttcactaaaatagtatagttttcgtaaaaaaaaatagtaagagagatttctcgcgctccaaacattcaaatacagcatgattgtatctcgtcgtggaattgccagtatatgcattattgcatacacgttcaaatacaacatgatttgtattgtcagagcccaggtatatgcatgattaaccactacggagtactatactagtagtgaatagtatctggtccaaattaatagttcctctctgatctgggtctcagatgtgatgaactatactaacatgcaattagcgtatactaatcgctggaacctggaagcgcgcgctcatgcatgttcaaatgttctttgttgcgtacatgcgagcgagtggcttttctttataggaggacgaataacatatgccaaaaactttagtttttctttgaaactttgtccctcttctcaaattaaagttggcatgaaggggaaaaatgtcaattgtcaaaggcatttatacattaaattacaatatactccctccccgttccttttacttacaccagacacagttcatgtagagtaccaactttaatagcttatacttttttagaaagaaaagttacaatatgtcgaagatgtcatattatcagaatacttttattataaatataactatttagttcgtcaaaacatcacaacttaaaagtcttcaatgttctaaaataatacttccttcattctaaaatataatatttttaagctactcctattaatctagataagtgtaatgtccaaattcatagataaaaaataaatatataataacggatacaattcacgggtgcatgtggcagctagggatgcaaatggaccgacacgcgaacccatttataggtcagataagtgagtgacccaccggttcccatatatcgtggcagcttgccgtacctgaggatgcaagtggttcgacccgtgaacccacttatagattaattaattctaagtaaacaacatgtcaattcgtggcccgtgggttacccactgattttcggcctcgtattttcgtttatgcttatgcttatcagctaaattttgaattttcaaacttaaatttgaatctgattttgaggttcactcatcgaagtttattatttaggcattgcttttagatcactaataacacgtatataaaagttttattcataaattagttttcgcttgtaaatatgttattcggcatatttcaccaataagccaaacaataggatcctttacctgtaagtaggttcgtgggtctagcaacatcaaatcatcaaaaaccgtcgagttcagctgtgcgtcaacacgacacgtgtcacaagaagggccgtggcgtctgacgctgacaggtggggccagaaaggggtgcatgacgcagaacctgctggaagtatgcggaccgtctgtttcttgtgatgaacggccgagattgattgacgctgcctcgcatcgcggatcatgtctgctggtctccgtccgttcctgatctgtggacggccgggatctctccccacaaaatctgcacacgacgatcgtatcacagtggaattatttcttccaaatttttttccaaatcactttccaatcatcatcgcgtgcgccaatccgaaccaaatcacgcagagactgacaagactagctatgaatgacaaagctatgctacagattagccgtttctgaatctgcgatgctaatgatcttccaaagaagaaatctacgtacagaagtgctaatgattgtgagcagtgcagcagcagggctttttaggcgaaactgaagatcttatctacactgcattattacttgactctctctaatatacatctttaatttgcactcttttgactgcacagtaaccgctaagaacggatgctgggattaatccaaactaatccacatcaacctgcaccaatcatgccatcgagatcacaacagcatcttgcattgcaagcattcttcctgctgaatttcggaactgtcacattcagaatgatgttcagaagtttgatcgttaaaccatagaacagcgtataagcaaccacaaaatagtttgtgggcaaaacttcaatatctgtgctattcgtggtttaaaagaaaatgctagaaagaaactacaatgagaaagccacaaagtcaatttcaaaattcaaattctgacaatggcttataagctgaaaagcaaacaatgacattgcagaaattcagtcaaacaaaacttaagagagagagggagagaaatattcagaaatagtattttagtgcattcttgccacaaatgtagaagtattcaattaacaggtgatctttctactctcctctaatccatggctaataaaatgcagagaaggaaagaaacaggtgatcacatcacatggtctcatcagaaggtcaggattgggagcatgatggcatagcttctgcatgcccaatcgcccatgctgcaaccgcacataaagatccccttttttctccttggcatttgtgttgcatttgtgtgtcttttcattcattcccacaccacccaacaccaccacaccacatttacattacattacaaccaaaagcttcattaaggtcattagtgttaaactaatcatggggtaatggagcctaaagcttaagctgtcttgctcaaaaacaacaagtttttagcttagctaggcatagtgacaacacactcactcccctcatttcatcaaacaccttcttcttcttcttcttctccaatggaagctagtgcagccaaggagaaagacaaggatggcaagaagatgagcagggttggaagctggggatccatggcgttctactcctcgtcttcttcctccagaagccaaccagtgtctgcagcagaaggcaagaatggtggcaagaaggagaagaggaggagcagcatcagcaggagcatcacgtgtgccggatcgatctgcagcaccaaggagagttcggtgtcgagcagggggagaggccggcgccgccgagcggcggcggcggcggcggcgatggcggcggcggagggagcacgtcgagcaggtcgctgatgggtcccgggtaccacggcgactccgcggcggctgtctccgcgtcgtcgtcgttcaactctgtgatgacggcggcgacatccgccaccgcgaccaccaccaccaccaccaccagctcgtcggcaacctcgccgccgtcggcgctgtcctcgccgctgtcatccatcggcggctcgttcagggcgatgcagatcaggaagctctccggctgctacctccactgccactcggtgctcgacccgcgcaccctcgccgccgtcgtcttctcctgccccgactgcgacgaggtgttcgtcaagcccgactccctcgagctccatagatcaaccagacacgcaggtatcatcgcatcaccatctcaaaaccatcaaaatttcccacagtatattcgctcgtttcgtacatgccacctaaatagtcataaaaaaatttaaaaaaaatttggcaacattgattaatatgaaatatatcactccactaatatacaattttaaatttaacttctacaagttataataaaaataacaaatatagctaatatagctgcgagtgtatagtaactatttttagtttaatttatttttttcaacttgtagaaaatgaatttggttttacatgtttgtggatgatatatttcgtattaatctattaaactttttaaaaaatttaataactatttagaataacatggaaataacgagaggatgtctctcgagagatagaaaatccacatcccactgaatcttctcatctaaaaactaacaatccatccattgattcgattgggattgcagtttcagagctcggggcggacgacacgagcaggaacatcgtggagatcatcttccagtcgagctggctgaagaagaacgcgccggtgtgcaggatcgagaggatactcaaggtgcagagctcggacaagaccatcaagaggttcgagcagcacaaggaggcggtgaaggagaaggcgaggagcgccggcgacgaggccgggaggaaccccaggtgcgtcgccgacggcaacgagctcctcaggttccactgcaccaccttcgcctgctccctcggcctcgccggcggcaccgccctctgctgcgcctcctcgtcgccgccgccgctgcactgcaagctctgcagcatcatcaaagacggattcaggtaactcgaccaagatgttcagagcccataattctttttttcacaaattcatactactgggctgcaggaat

SEQ ID NO: 20784 - DNA, 2151 bp, Oryza sativa
aaattcatcagggtggatggcaatgggaggatcacgacgatggcgacgagcgggcgggcgcacgacacggcggaggtttcgccggacggcgagaagagggcgatgctggtgtgcagggtggtcgccggcagagtgaagaagctccacagcagcaattcttcagaggatcatgactgtgactctgtcagcccctgctcagaaggggtttactcagatttggatgaactgttcgtgttcagtcccagagctatacttccttgctttgttgtcatatacagtggctactagatcaaagaaaaccagtagaatagcttgattttgccactgttcttaatctagtttctttctctgttgtaggttgtagtatgtttacttacttcatgttcatcaagtcagatcataatgcaaaaatggaaaaaaaaaaactgcctgcaaagtgcaaatctttctcttgtgtcacagttgctctcaagtgtcattcaaatttgacatgtttgaaaagcaggtacaagatgggaacaaggccatgagatagacaccaaaaacagtgattttgcttgcttccaagatctaacagaagtacaaaaccattgtcaatgcagagtttttgtccatgtgtgctgagcaaacattagatgcttacacccatgaacactttgggttcttggaagaagcatctacttagacaaaaggctaagaacaaacagctactttggaagaagcaatgaactgctaaatgttatactattcctaccctgcatccagctacatccaactcaatatattactaaatgcaagtatagtacagatccctagcaaatgctgcttcttaattgtgcagctctacaaatataaattcctctaaccaatataggttaagagctaagcagtagaggcgatggtgattatacctgtattttagtcaatcatattctgaggttgtctgcttgtggacgacaagttgcacaaactgattccaaacaaagagagcacacattcaccagattcaagattgttcatcaacaatttgttaatctagcattatcgtggcctctgatctgttcactgcaaaactggacaaacgtcaacagacaattttacagcaagaatgtcatttgtcacgaaagcttaaagaagatcagtgtcctcaagttgcctgtttttgttcgtttggattcagcaaacaacgtgcttcgaacgctatgtcaggatgtgccatgatttgtttaaagaagtcaagtctgcagtagatctaaaattgattgtcttacctagttatctgcaatttcacatcaattggttcaggaacttgcatcagctagtgcttaactagttgtcttttgccgtacaattgtttgtcacaactcacaaaattaccatatgccatggattattgagctaagatgcctggtattgcaggctacattggataccagtgggtatcaaaattcctagtggtgaaaaaaaaatcgacatccttgtgagttgggaaatttggtcagatgaggagtacagcatattagcccaactcttaatctaagaaaaaacagattttgaggctataaatgtaccattaaaagtctaaaattgccaggtcaaccacattctagagtgacgtggcatgacacgtgtcgaatcaaaaggagtctcagatccacgggaaaatttgcaataatttgtatatatatataggctgtgttataaattttttttatcacacaaatatagataattagataaaatagataggttgagtgactgtcttgctcatgtatactgggttacagaataaaaactgagggccagaaagatcgcaacacaaaaatgtcagcaacgctcaatgatgatgaggccagcaagatcctcctctcaccagagcctgactaaacacaatcaccatccatggagcacgccggccgattgctgaaaaatcaaactctgcttcagaaacaaacggtagcataaattgtaaccatataactgaaatgtgtttcttcagtatttcttatagcaatgtaacagcattttgtccttataagctgttacttccttcgtttcataatacaagtctttttaacattgcgcacattcatatagatattaatgaatctagatatatgtgtgtctaaattcattaacaacatattcata

SEQ ID NO: 20785 - DNA, 6884 bp, Oryza sativa
agaactactgaagaaatgctacatataagagcaggtacaatagcagcctattagccagctataaacatattttaatgagataaaagatgagagagagcagcggactacagatctgtaaccagctacagcatggactccaagacgcagtgtgtgtatgactggtgggactatatattaatagtatagcaagcaactattgtataaattggctattagattggctataaataaattggagctaacagtggactatctaaaatgtcaacaccccccctccccccccccaagcaagtacagttctaaattattgaaagctccaaaatccaaatgatatattatcaagaaggcgtggtggttttacaatgcgccagtgatttgtcatttcaacagcagtacaagaacctcaagcacaactgatgcaggtaatcaacctgagcagacggtatcagggttaacattcggaagaaacctccaaaatttcggtgggtcatggtgaatgttctaccggctgaaaaaaacattagtagcaaaatatgcccaaaattcgttacggaatttcggtgacccacggtattgttaagtatcggatatcataaattaactgtatgtcccctcagatttgcttgaactacctagattgtgtttttgcaacacatttccaacttcactccctcgtttttcaagcgtacgtttttcaaacagttaaacagtactacctccgtcctaaaatacttgttgctttaagttcttgtttgtaacgtttaatcatttgtcttattcaaaaaattatgaaattattatttattttatttatgacttgctttattatcaaaagtacttttaagtatgatttaagttttttcctaacgttgaacattagtcttattcaaaagatgatttaagtttttttctaacgttgaacattagtattattcaaaagattatgaaattattatttattttgtttgtgacttactttattatcaaaagtacttttaagtatgacttatcttttttatatttgcactaatttttttaaataagacgaatggtcaacgttagaagaaaaaagttaaatggcatctaatttgggacgggagtagtattttttaaaaaaaaagtttctatagaaaagttgttttaaaaaaatcatattaatctatttttcaagtttttaattaatttaattaatcatgcgctaatgaatactaaggaacctcaactaaggaacactacccatttcaaaacatatgatttatgtaagtttttcaaaaaagtatttgaaaaacgtgtacattttagaatggaaggagtggcaatttactagtagtaaagatacaataaatatttcttcgtaaacacaacctttcccaatcataacaaaatcgaggtgcaacccgtaagatttttcttttttaaaaaaaatttgcacctctcctgtcgcggaactgcttacggcaacatcatatctctcggtgtgccgacatcaccggagcagtaaccacctccgccggcggcgccgacaccgacggcttcgacggggagacaccggcctccacccgtccatcctccgcttccttgtgcgttgccggcgatggagaagacggcggctgcccctgcatctgctgctgctgccgcaggaggcgccggaggtgaggcggggcgtaaaacctatcattggagctgaacacgaagcagcagcaggaggaggaggaggaggagggtgggtcggccatggcggtagggctacgaggctgcggatgatggggttagggtttccgagggttgtggggttgaagcgacgtggtggcgatcggttttttttttcagagagagagagatggcgatcgagttgggtccaggtttccaaaccgccgggccagggttaccacgccccgacggtaaacacggttatcgcgcggtaaccgcggtaaccgtgaaaaaccgtacaaaaccatgcaaatttcatcaaaaatttaaattattttttaaatttatttgaatttaaggaggttaccgcggtatttacgttaccgtatccccgcggtaagctcggtaaccacggtaaccacgcggttacgggcggtatgatgaaccctgacttgggtcgctacaatttctagcggtcaagattaaatgggctgggctagttgtccgcataatgggccagacacggcggtcaaggcccaatctgtcagaaactgatgggctgggcccaatctagtacacgatgttgcatggcctttttctgacgaaaatcgtcaaggttattggagagtaatgtaaagcagtgatcaggaaacataaagaaactgatgatgatagcacatttgcactgttgaacatattgatattcaggaagctggaagatcacatccaaatgatcattgcatgtgttagggacgcgcacgcgtgtgtatgcgtgtgttgtggtgtgagtgtggtgtgtgttagtgtgcatcctgagttatacccttttaaaaaaatgatcatggcatgaacatgttgaaaaattgcacgaagaaattggatgagctctgcaggaaaatttggctggatgaggctatcattcgccaatcttcgctaattttaatcattagtaattaattagtgataattaatatatggtgcaaacaagacgtcatgatcatacgtacaacatccgtccaaaaaagacaacttctagaaatgaatctggacatatgtttattcagattcatccccagaagttagtattttataggacagaaggagtaggtggttttcctctaaaacaatatttttacgcagctcttttaagggtgtgtttagatcccaaaaaattttggtcaaaaatgtcatatcaaatgtttagacacatctatgaagcattaaatgtagacggaaaaaaccaattacacagtttacatgcaaattacgagacgaatcttttgagactaattgcgccatgatctgacaatatgatactatagtaaacatttgctaatgacgaattatttagacttaataaatgtctcgcagtttacaggtaaaatctgtaatttgctttgttattagtgtacgtttaatagaaagaactaaacacggcctaagtaagcatagaaagtttgtgtttttgtccagcaaaagaaaaggtaggagtctgtatgtgaattggtgataaacaaattcttgaaagtaagaatgcaaaagatgaaaaattatcgaaagtagaatacagaaagaaagacaaaaaaaaaaattgggggtctgtcagaccacctctgcgccaccctgcactggtaccaccagtcaggaacgatcctctacagccgtcagatggttccttccagagatccatccaagccgttaatcacgctctggcccagaggtcatggacccatcaaccagactagagtgcttgcctccttattggtaaaggatgcaacggtacgagcctatagaacagatcctgttcaagtaaggtcgtgccccaagcctccaagctccagtttataagtagctcccgctccaccaaaactggcgaggtggtactaatcgacagcgcttgacctgcatacatttcgctggtagcataatgggcccagcccatctaaatcatctgcgagttattgaagtccacaatcacattcccaccgaaccacgtgtgctgtctgcactgtttattctgagattaagcttgaaagcaaacgttgtatggttccaattaaacaactccaagcaatatagagttttttttagataaaaacaataaagagatttgagctgcttacttatgggaaaataatactatttcaggttcaacaatgcatattttcgagtagaaactagtagcagataacttccatgtctgctgttatactaaggtcctctttgtttaggcttataagccaacttataaatcaaaaagtctaagccaaaacaaacaagcagctttttcatttggcttttttgaagccataaaccactctaacactattaagccaaaagctaggttggaaaagcttttttggcttatatgagatagatgtatgactccaccactaaacttaggacattaaatccactggcttataaatcatataagccaataagctgacttaaaagtctagtccaataagcctaagtctaaacaaagagggcctaaatcaaaggttacgagagaagcataatgctttgccagtttgtttcctggccggtgtgtactgcaaaacattcatgaactatcccatgcttttgctctcaagaaacatgcaggattgcaggttacctagaacatgagaatattcagttgcctttgccaattttttttaattgtggatgacatgatactgtgggagtagtagaacgacctgctgtatgtaaaggatgcaactttggaaacttatgtaacagatcaacaacaccagaagttcagttgtgagcagaaattcagatccatggttatgcaaaaaaaaaaaagttacatatgacaactgtcaaagatgcagaataattctatccaaactgtcacagctcacaagctgccttgggggagcactattaacctgctccaagcctccaactgcatatttgaattcagtgtgaactatgaaatggcaatcatgcagataactatatttcatcagtgttgttacccataccctgagactaggagaggaaaaaagagcacaccttcatacaaaagatataatcaacggtggaaaatgaggccaaatgaattgttcaaatactttgttgttggaatcaaaccaaacaacagtcataccatatagtattattagttagtgaactatatgcaacaagtaactctaccgaacatgttcaggtttctgcatattgagcaccagagacgcaaattggcatgcctgcatccaagcccaacaatccaaatgctcatgacacaacaaacataaaagagtacatgcttagtcagcgccagcaatcataatgttaatattataccatattccatttcctaagctcaaatacagatgtcaagaatatttcggtgaactgaacatcgcatcctaacgcatttcacttgtattacttgagcttaagtctaagaatcagtaacatcgtttgcacatctcaaattactaactgggaactcctcttaaaaacagagagatattgaagggggtaaaccctttctacaactctacagcaatatcacctagtgagagagaacagatcaacagcaatgccctgcgcctggaatgcattagcagtttagcactagcccgactactaatgaactccatacatacagcaaaaaccaaataaatagccgctgttattatagtaaagaaataaacttattgcagttcatatgatcaaaggctcaaagcaaacaggcaattagtaggtctttgatgctttccattgtcaatattgcttctttctattcatttcctttctttcccctttttcggtagaacattaagacaaacaatgacagggacgatcacaagtgactctttaatcgcttttcattctaaccatatttggttaaataaacatcaacttaggtatgtgactatatgaaatatcaattaatggactctttcaaaaccaagggacacatcaagacacaaatcattgcaatttatgctgctgagaattccataagatagtagttgtagtaaggaacatcaaattaatatatgttcggtaagaaatgcataaaacaagtcaatacataatcgcctgctaaaatccattactagtagtagatagcacactacaccatgttcttttcatcaaccgcacacataaatgtgaaatatattaattcatcagctatatgcaaaaacaataacataagacaagataacttacaatacagaactggctacatactaaaccaatgcttttccaagccacaagagtcgacctttacgcattgcaaggtttagtagacttcaatgaaattccagtgacaaactcatgagaaaaatgaactcttttatcaccactgcagaaaatcttacaagatgtaatgcaatcagaatcattttgacaggagcagtacatcaggcttccgctgcttgcctggtgtgtttggcttggagctgggtctagagctcgacgcggtgctaccagctgtgcctactgacacgattgccccagaagctgctgcagctgcctccttggcagccttgcgtgcgcttttgtcgagctcgatcaagctacgggacgccaagatagcctgtggcacaagctcatgacacgcgcgggcatagacaacccgcacagcttctgcggcggtatcccgcacctccgtcggattcagcggagctaacaggcagtgaccaagaactctcatcactggctgtagaagctcccatggaagtggcaccctcccctctctctcgccacaattccgaccattggtgtctccgttgacgcgcatctttgccatttcctcctccaaggccttcccgttctcggcctccgatgacaatggcgaaacggaccccaatgaatcagcctcctcctcttccaactccttctcatcaagctcaaatcggcacttgcagtactgccccgcccacgccgccacggcgttgcaagcatccaccttcgatgcaggcggcatctgcgaaatcttggcatagtacgcctcgaaggcaactccgataatccccgcgcgcttggtcgacttcaccgccgcctgtggctcaagcggcggcgatagcaccccgaccacaacattccccgcgggtggggggatcggcggcggctgtggccggcgaggggacttcgagctggggctggacagcggcgtgtggtagagggaagggacggagaggtcgggtacctggacaaggacgggcttgccctggcgattcttggcctcggaggagtagacggcgagg

SEQ ID NO: 20786 - DNA, 3510 bp, Oryza sativa
gggaggatggacgacagcgccaggatgcgggacctcgcctgcgagaccgactcccaccaggacggggtggggtcggatgcggacgccgccgaagagttagacggcgaggccgccccggcggcggacggggacggaggcatcgccggcggcgagagagagaggaaagcgagatgagatttgggcgatctctctccacagctctcgaatcgagggacctttctgcgtctcgcctacttctccatgggctcttttgtaaataaaccacaagcccgaggtgttattactagtactactagtaggtggtagttgaccatttctttttcttttcattttttttgagagagaaaaatagtgagacgtggcagttgactggttcacacgtcgacgtcgtcgtcgtcatcacgtcgctgcaccgagcggccgcatgcgcacccatgccgcggtgctgggcacgccggcgtggagcacgaaccagaggtagtaccccggcggcgccaccgacggcgacggcggcgcggccacctgcgcctcgtacagcccggcggccagctgcgcgacggtgcccacggccagggacaccaccctctggttcatcccgaaggagtgcgtcgcgaacgccggcgccacggccgccacgcgcacctcctcggggccaccggagaccgcgccgccgggcacctcgaacctcaccgccgccgcctccccgtacccgacctccgacggcgccgccaccagccgcggccgcacgccgtcgagccgtgcgtcgaagtatggtggtaggaacgcctccaggctgagctctgtcgggtacgtcacgttgtcgaacacgtagccgacgtgcgggttgctgccgccgacgagcacgcggccgagcgtgtccagcgtcgccgacgagtggtacatcctcgggatggttgacgcggcgagcacctcgaaccgcgcgccgagctgcatgtccggcttgtacagcaccgggtaggtgaccggctcgcgcccgagctcccaccccgccgtgccggccgccgcgccgttgacgatgagcacgtcgccggtggggagcagcaccatgtcgcccatggcgcgcggcagcggcatctcctccatcgcccacaccgggttcgcgtcggtcggcgcgatccggccgcaggtccggtcggccggggcgaacgtgccgttgcggagggcgaggcggtacgcgccgcgcggcgcgccgccgcagacgagcacctcggcgtgcgacggcgagtccggccggagcgggaggaggacggaggatcccgacgacgggtagttcctcggcacgccgccggggatggcggggaggcggcggagcggggcgcggttgtaggggtcgaacacgacggcgcggtcgttggcgaagacgaagacggtggcgtcggggaggaggtggaggaacgggtagaggttgtcctcggcgtccatgtcggtcgtctcctccaagaacgggaacaaggtcggctgcggcgccggcgcgtcgtcgtgggggaagaactcgaagttgaactgccgccggccgccgaggatgagcacgcggccgtcggcgaggaggatgtcggtggcgtaccaccgccggacggccaagaacgacgggagatcgacccaccccgtcgacggcgagaagaggcgcgcgatgcggtcgccattggagaacccaccggtctgcagcagcgtgccattggggagcagcgccgcggacgaacaccatgggttggtggcgagcgggtacggccgcagggcgttcgaccggaggtcgagcagcaccgagtgcgcggtgcagtcaacggcgccgccgccgccggcggcgagggcggtggtcgccgcggcggcgcacggcgagagcgcgtcgagggagatgttggaggggccggagtcggtgcggtcgaacatgaggacgtagtcgccggggagcagctgcatgtgcatcgccgagacgccggtgttctggtgcaggagctgccactcgccggcgaggacgacggctggctgctgggccacctcgggctcctgccatgggtcgccgccgatggcgtcaccggcggcgccatgggcaatgtagatggtgatcaggaggaggaggaggaggagggagaggaaaggtgatgcctttggcatggttgctctgcatgcatgtagattgatctttaagctgtctgatgcacggcattgctgtgatgtgatgcacaagggtttgtacaaaagtgtggtgagttttttggtacaagtttggtttgaggaggttgaagggaattcacatttgatggttaaaccttcaaactttaaaattcagtttaggttatcaaatagttttgtggctccgctctgtttaattgctacgcctatgttaatctgatcgaaaactatatttgtgttttcacatcatggtctaagtactaaaacaggaagatgagcaaataattgttgtgtttagttccacgctaaaattaaaagtttaaagaaattggaacgatgtgacagaaaagttagaatctaaacaaggccaatgacacaattcgatgatatttaattgttgtcgtttacgttagtttatttttctcatgggataattttcttagaggcagtggcatttccagcaggatttcctttggttggtttggagttagcattggaaaagagagagccaatctcttgacatcacgccctattgatgaaagggatttgtggtttctagtaggtagaaattacatttaggagaccggtgataagaacaataagataaagggatttgatgtttgctcttatttagttccaaactttttctttaaacttttaactttttcatcacacaaaatttttctacacacacaaacttccaactttttcgtcacatcatttcaatttcaaccaaacttttaattttggcgtgaactaaacacaccctttgtcactctattagtcgagtttcttgccattatgtttgttttattgggcccgcttcaataatcgggtcgaatacatttgctactaaacttgtaactaaaaaagcaccttgtgtctcaattgttttatcgatacacgtctaatccagtttgaactataaattctcatatcgatggtttcctctccacatggtttcttaaggacacgtttaaatcttaagtaagaaaaattctactcctactttgctaaggcacgagaggcatttggtacaaatggaaaaaaacagagcttttaaggcaagccgcacataaccgcctcaaaatccttgcccaccaaggatgatcgactctcctccgttgataagcaatggacgcgggcggttttctttaaacaaccgtaaaaccaaatgaacgctcctgccataggttatagccaaacgtggctgccttagcaatagcgatccatatgatttgtgtgttggtgatatatgttcatgtttacagagctgctcattatgtagtatgttgtgataaaggatataaaaaaacaatgttataggcaatttgcaccatttatagtttttttcttgag

SEQ ID NO: 20787 - DNA, 17529 bp, Oryza sativa
cccccccccccccccccctcgttggattctccgcccgcgccgccgtcctcttcctccgcctcccccccgtatttctctccgccccccacccgccacctacctgccattgcactctcctcctcctctgcctctcccggaggccgcctcctccgccggtgagtgacacaggtagctactgctactactactagttccctgcattaccttctagaagcttccacagcagcatccagtaggcgggggtggggtctgatccgtccgctggtttgatttggtggtgtctctgcaaggcaactagtaggatcttgtagagcaatgccgcagtgggtttttctcgactagaggatcttgtaggatggagtggactactacgttagatttgaatagctccgctcgctgcgaacgagttgctccagaggagaggagtccgactagtaacattttctgcatctggggaggaattcaaaactcgtttgtttggggggaggattctaattctaattgattgtagaccactggatagcaatgccttccccttttatgtatctgtgtctgttaatacgcgataaatatctgataatgtagctacattatcatttcaggtttatcacttgaaaagtcaattgcagatcagtgccgacactccgcggactagtagctttgtgtaaggctgggaaatatgaatccttatttcatcggcttcgctatcccttttctggcatctctgctgttcaccaagaggaagggtgaaaagaaaaggggagtgccggttgatgtgggcggagagcccggctatgtgatccgtaaccacaagttcgagcggcccgttgaaacgcactgggaaggggtttccacgcttgcggagctgtttgagcagtcctgcgagcagtatgtctacatgccactccttggcaccagaaagctcatttcgagggaaatggaggcagcccgcgatgggaggtcctttgagaagcttcatttggggcagtatgagtggaaaagctatgctgatgcattcaagactgtctgcaacttctcatctggtttagtgcgaattgggcaccagagggatgagcgtgttgctattttcgccgatacacgggccgagtggcagattgcattgcaggtagctttctctacccacgcgctcctataacttccatagtttttttgtgtgtacataaaaggtttgaatttacatgatgcggactgttcttgaagtgtctcaacctgtccttttcacaatgttccatcaccatccttgcatatataaagtgaaatgcgctcatgagaacaaaaggaactatgtgctatctagatagatatgacaagacaaaaatgatcaaattaatgacacagctgagtatataagaagtcatttacattctctcatgaaaaactgattttgttgaacattgaactgcttcagcttaaccatattgatattctcacttagttgagaaatcaattatactgttgtatttcgcttatgttcttcatgttatgctagcagttagctccgtgaatcatttgcaaattgtctaaccattcttttctatttgaaaggcatgcttcagacaaagtattacggttgtcaccatttattcctccttgggcgagggagcgttatgtcactcactaaacgaggtcagttgactttctttttttgacaaaagtcacttgaattttttctcaccctgtccatcattatggtaacaaaacctcaaccaaagtgaattttgttggttatcttgaacagtttggacataacaatttattcctactgtatctgcgtcgtgatatgatctctaactttgcttctgttttgactctttagactgaggtaactactgtgatatgtggaaggaaagaactgaaaaaacttcttgacataagtgggcaacttgatactgtgaaacatgtcatctacgtaaacgaggaaggcgtctctagtgaagtatccttagctcaaaaatgcaccagctggagggttgagtcatttgaggaggtagagaggttaggattggaaacacctgtagaagcaaagctgcctcttccgtcagatactgcggtgataatgtatacaagtggcagcactggaatgcccaaggtttgttcaaagattagttgatttttttgtagtgcccatgttggattacttcacgatatggatattactaatggatgtcttttctcagatcatctgcttacaactcctctcatttgtacttttttttccacagggagtcatgatgagccatcgcaatgtcctggctgttgtatcagctgttatgaccattgtgcctgcacttggcaagaaggatgtctacttggcatacctcccattagcacacattcttgaattagcagctgaggtaggtgtcagatgacatattgaaatctcagtctattccacatgttggttttgttgatgctgatgcactttatgcaaatgtgatttgtagacagttatgtctgctgttggggcttctatagggtatggatcaccactgaccctgactgatacatcaaataaaataaagaaggggactcagggcgatgcttcagctctgaagccaacacttatgactgcagtacctgctatacttgatcgtgttcgtgatggtgttagaaaaaatgtattgttctttacaatgatattatccattgtttctttctggccttcttgccatcttgaccatttgtttttttcatgatgagatgaattaggttgatgcaaagggtggtgcagcaaagaaactatttgatattgcctatagccgtcggttagctgctatcaatggaagttggtttggtgcatggggattagagaagcatttgtgggatatgcttgtctttcagaaggtgcgtgcgatcttgggaggaaggattcgatttatactttcaggtggagcacctctgtctggagatactcagagatttatcaatatatgccttgggtgagatagtactcttcattattttataagccattctcaagtctcttttgttaatatcaagttattgtttttggtccacttgtgtttactgtgattgaacttcacaatattcaaatctaacttgcatactgcattttaaaccaaaacaattgacaggttttgggttgtgctgttgcagggctccaatagggcaaggatatggtcttactgaaacatgtgctggcgggacattttccgagtatgatgacaattctgttggccgtgttggtgctccattgccttgctcatacattaaggtacattaaaaaatatgttttattattttggtagggtgtattgtatcctcatttccatagtaaagttattgttgccatgcatgttatcactgtgatataaattgtatcctcatttccatatattcatatgtacgaaagatttccgctaagtgcaaaaagatattgtttttcttcgtattagagatcacagataaacttttgtgttcaaatttttgacatgaggcgtggaattgcggatagctttacttgaccactagccttacagccagtccagtgacattgtggatagctagtttacacaaagctatgcatgtaatcttttgcacgcttcactcaaaaaagaacatctattttgaaatttagtgtattatgcccatccagtttattttggttttctccttcatgttgagattcagaagattaatatcttatccctcagatcttattctttcctaacgtaatatgaattgtatatgatagttgatagattgggctgaaggtggatatttaactaatgattcaccaatgcctcggggtgaaatagttattggaggtccaaacgtgacaaaaggctactttaagaatgaggcaaaaacaaatgaagtctacaaggtatgttacgataatatgccaaagcaatctgtgctgtgaagcccatgataacttttctttaacaacaccaatttattgaaggatgatgaaagaggcatgcggtggttctattctggtgacattggacgtttgcatccagatggttgccttgaaattattgaccgtaagaaggacatagtcaagcttcaacatggtgaatatgtatctttaggaaaggtaagctaagcttccttttccagccaaattagcggcagtcagctattgtaatctaactattataaaaccacaggtggaggctgctttgagtgtgtgcccatatgttgacaacatcatgatccatgctgaccccttccacaactactgcgttgcacttgttgtagttgcacacagtgaactgaaaagctgggcctcacaacaaggcatcacgtattcggatgtttcagatttgtgtgagaagcaagagactgtcaaagaagtccttcaatgtttagcaaaggtgtgtattctccctgcgttttaattaattagatatatctgattaatctagcaatccattaaccctcaatatttccatcaaaattaactagtactactttactaatgattgcattccctggatgattcagcaaaacatgatctcttctatttttctctcttttgagagtggcaatgtggtattgccgtaccaatatgagaacaacggaggatatgttggacctcataggttatcagtagaatcaggaaaagaacacattataatcttccagtaaacagagaatataacccatacactaatatgcaatttgatatgatcataatctgcgacgatatctccatattttgcgtgcaaaaaggatgtacattcatgagctcaaccagatatcatgtgtacggtccgaatggtcgatgccaaataccaatttttcactctcagtatgcaatgcaaccccacattgcacgcaccgtaacaatctcaaaacaaattgaatctagcaagcttattaagtaatatcaatgcaagacatgcaagtcttatgacaattggatcgtactgacgtgtgtttgttcttcaggctgccaagcaagcgcggctggagaagtttgagatcccagccaaagtcaagctggtgccggagccatggaccccagagtcaggactcgtcacggctgccctcaagctcaagagggaggccatcaagaaggcgtacgaggatgaccttgcggcgttatacagctaaagttgccgctgcattctgtttttctgatactgaagaaaaatcaacagcacgagttctgtctcgtggcaataacaaaattttctttcctagtttcgaaacatccaaaaaccactgtttttgcaatggcatcagtgggtagcgatgaaacagatgtaggtcaatgcatttggaagaagcattcctgaaatggggaacaggtagatttggaattctgtggtattggccttgtttcttgtaaattacctgagattttcttagctctttgagaggttatctgagattttcggtacaagagatgctgcaatagggtaatgaattgagtcaacaatagttacagattggttgagcactagcagcgtacgaaatttggtgcgattgtacagaacggccattcaagaggaaaagatcacctttcttagagcaacatctgagagtaattagcctactcatctcaatgaacacatgagcttatcacacaagtcggatgatataatgatgacttgaactcataacaaaaaggagcattgatgatttttgcaatccaatacattagagtgaagggatgaacataatatattgtaatgattttattttgctacaatgccgtgttttttattcaccacgaatgagattaaatccgtttgctcaggagcagcaaatccagcctaacccaaaaaactttgcatgaaccaccacaaaagaaacaaaaaggactggaagtgccaccttccttaagctacaaatcgatcttttaatacattaaactagagctcccaagtaagtttcaggttttctcaagaatatagccagtggaataacagcggtatggtaccgcaaagtgcctaatctgcacgagattggccggcacgggatgagaggatgatgcccacaatgagaccatacagggcaagcgcttctgcgaaaatgaggatgaggatcatgcccacgaaaagctttggttgctgtgcatttgccctgccaacaccaacaagagatatcagaattgtaatccaaagtaggcagcttaggagtagcctcaagctctcaacacaaagggtagtcatgaacaccgaggtgaacaccaaaaaagcagtgaagcacatttcgatcatatgatatcatagtaacatcacaatctaataaatcatcccaaaattaaccttctaacgtcaaaatttctaagaaacaatatgtacgattatacaataacacacttgccatcatgaatggaatcatattccagttaagtgctaaaattgtgaaagtagattatttacattcaaatcacaactactcagcattacatcgttgaaaaaatttaaggcataacaccttgaccacttgtttgctcttcacaccacagcacattttttcagttgttaaaagttaaaacttcagcaaaaaataccagagagcagtaccaagaacaacatcattattcagtatatgctacgtattgaagtgcccacgaggaaagaaccccccataaataaatactaacaatttataaagccttggcacttataacttattaccagaccacaaggatttacaaacaggaggatccagaaataccatataaggattatatgagctttgttcttcatttccacagccttgaagccattgaaacgcacaaccttgtaggtaacagctactcactaccagttcaagattaactactaggctaatacaagaacacaatgaatacaagttatcaaacagacagcgctacaaaaactacatacagatcccttaatcatatttggtagcaaaacaacctatagaaagtcttctagaattgttaatcaacctgtagcttccatcataaaaccatacttaatcaccaatgcacagcagtaacagcatatacacactaactacatcacagatcaacaaagcaggcagcatctttacctgacaccagcatcaccgacgatgccgatggccattccggcagcgagaccggcgaggccacaggcgagcccggacgacagatgcgcgtagccgtcaaagaggtagtacggcttagccttggggttgatccctgtactgatgatgacggcgatgatgaggccgtagataccgagcacaccagccatgaccacgggcacgatggacttcatcacgagctccgggcgcatcacgcccatggacgccacgccgacgccgctcttcgccgtcccgtacgccgcacccatgcctgcaacagatcgaatgaaagcaaataagcaaatccccccatcaagaacagaatccaaagctcccaactttttttccccacaaatccgatctccaatcgggtcaaatctagccacgcgaagaagaaaattcacactcagggcgtcacagatcgcgcgaatcggaggggcgtggacctccatcaccatcgaaccaaatcgcaggatcaaccagatgggggaaagaaaaagatggcgactttgattggaaaaactggagctttctacacctaatcgcttgatcgggggaagaggaagagggatggcggagattacatgagaagatgagggcggaggcggcgccgaggaagccgaagaagggcgccgtctcatcgccgctgaacaccgacgacatctttgctcctcttccttctccggcgagatcggttgatcgatcgatcgatctcttcttctctcgcgccgggtcgcctcgtcgaagatgggaaagggaggaggaagaagagaagatctgtcgggtttggttttgttgtgttttttttttttggggatttctgatctgatctgaagatctctggaagcgagcgacgtcacggttttctttctttttcgtttaggtccctgcagtttgtccgtactaaaaaaattatctgaaatcgacagtttgccagcccattgcggttttgattatttccattcaggcctcgtttagattcaaatatttttcttcgaacttccaacttttctgtcacatcaaatgtttggacacatacatagagtattaaatgtggacgaaaaaaaaatcaattgcacagtttgcatgtaaatcacgtgacgaatcttttgagcctaattacgccatgatttgataatatactaataatgtatattaaattgcacagtttgcatgtaaatcgcgtgaccaattttttttgttattagtatacatttaatagcttaaatgtgtgtccgtatacttaaaaaaaattgacacatgaactaaacacagccttggtatgggaaattttggatccggtttagtgttatctgcagataaaaattttctccatgttaatctagggcattcagattggaagggaagaaatttatgtgttaacatcaattgtggtttcatcaagtgacattttgtagtgctagtattattatcttcatgcttatgagtaacatattatagcaatattattttatatcttgtgtatgaatgtaaagttatccaaatttgatcaaataccattgttgtattcaaaatttcatgttcatgatcaacatgtgtacttgtatataatcctaagtagaccattttatgggacatacacgacggtggtttcagttaattcgtgggtggtctagatgaaggatacggtagcaacagctagtggcggtcggctagtacaaagcagttagcagggtgagcgacggtgtgtgcttctgctaccggtattgatgcttcttgtttgttcggttgtctcatggataatgtcttggggccatgggggagccgaaaaaaacaatacagtgcaaagccacttgtaggtcatctcctcctcaatctcccctattgtcttccgcctaactataataagacaatagtttgttagtcatcatttaagccatttcaagattaaggcaacgtggggttttgcgaagttttttataattcaccctggcattaaccatgttgataactccattcaggttgagtgtgaactatctatctgactcttctcgacatgaatgcagattgtactcctaagatttgacggtggtggagatattttgtcatccaatctttgtattgaggaagccataaatttctaatatagcatattatggatttagagtgctaccaaacatctcaaaatcaacatatcaagtatatcaatctttgtgctgaaaaagccatgaattcaactagatcatgaaaactacaagtacaatcaaggtgcttaacggatgattgagatatttcttcatccaaccggagcccatataccccacaacaaacatgtacagattgtgaagccactgttgtaaaccaacacgtctattagcagatcaccggatccattctctgtccctcccgccgcagtagagacgtaagaaaatgtagaatacctgtgccttttcctctgccctcaacaacattgtagaagtagacaacgatatagggtgaagttctcttttaattatagatatgatattgagtataagcaaatctcaaatgtctcaccttgcccctttatatacagttgtcttaggagaagataaatcttatctttactctggtttggattagtccataagaaagaaaatttatctccccaggacatactagtccataaaagctacgatatcaacgagctaactgtaaattctaaagttgacaggggtgcaatagtaaatgacatgtggaccaggctcgtccgggaaccagaagtgctgtctaattttcctccaagaaggatgatgggccatggcccataggccacatgggcccttcaccatttccactcgactttgtgtttcacagaattttaccaagctaagcttggtgtccaccgatattcttaggagagttgagtgagaaaaacaattgtactagtagtaagtagtagtagtttagagtaaaagaaatgaaatatcatatttagtaaatcagtaggcacattcaataatagtaaacatatacagcgacatgcatatgacttacatgcatgcttatgtcaagcagcagcaacaacaacaaacataacaacaattacaataataatgtccatcacattctgtatttgggatggtaagaatgatcgatgataaatttctccccagtccaaatctctcagaatcaaactgtcactcaactctcacaacatatatagctactatttgttcttttgaaactgaaactagtatttgttcttgttgaggagatcgtagtacaccatgggcttcctgtagttcttgccgcacgcctcctgcaaaaaaatatataaaaaattaaaaataatcacttctgtgtagataattaaacacatttcactccccacatgcaatgcaggatttggaaagaacaattaacatcagttcgtttccagcatcagatcggtgacctgcatggcgtaggcgaggtgcagcagcgtggcctccgaccacggcctcccgatgaactgcagcccgacggggagcccttccctgtcgtacccaaccttcacggtgatcgccggcaaccccaggaagttcccggcgatcgagtacctcaccagcgcagctgcatcgatccaatgcaatgcaacactgacgagttagtgagatgccagcttaattattctgaaactgaactcttttttcttcagttaattgctcgtgattggttgagttataatcacctccgtttatgtagtccagctctccggtgtgccccgcgttgtcctgcaattcgtgcgctgtcactctgtacaagaagtacacagttaggccctgaaactgtcactgctacactcagtagtagtggtgagtgattttttccatgcaagattgcataggtaccctgtcattggtgtgacgatcacgtcgaatgtctcaaagatcttgtcgtggaagtacatctgacggttcctgcaaaaaaagaagagttcattcatttcgagttcagagtggatagtgttctaagtttgatggtggaatgaatgtctgaagaatggtagatatgatagctcaccggattcgttgcgagttcaggtaagctctgctgctgaacgacccgtaggcgctcagcgcgatcctcacatcccaaccaatctcagacttgctcctgcatcagcatggtttgagtgtacaatgaattgatcatcattttgaattcatacgcatgtcagcctgaaaaatgatttcatatgacaaaatttatgatacgcttacagcttcttcagatacttatcgaaggaggcggtgcattctgaacccattgtcacgtaatgcgcgagccgcatctcctcaatttcaggaattgtcacatcagcagtcttgcagatagtagcacaaacaattgcaaaaataaataaataaaatgtcagattgcatgaactgtagtgtatttcctcaaaatcatgtcactgagtgcattgtttaacttcaggattagatgaagcgtagagttgttcttactacctcccaaccgtatcgagtccgcagcgtatggacagctttgtagcagcaacttctgatgtcttcagaacagtcattgaaccactgtttttgtggcgaatatcagtacaatgttcagtttcagatgacacgattttattacagtgttgaagcactcacctttgcatatcttgctagtctgatggtaggcatcgagcttgcagctttcagcaggggaagattcagttcaggctgcaaacaaacaaaaaatatcaaatcttctgcaaattcagtctcactgaacatccaaacgtgtaagagaaaatacaaagttcgagcatttgcctgcaagtggcttggttgggactgatcagcaatagctgcatagctgaatgataaacagcaacacaaaacttttagtacattacaacatatatacacaatcaagtgtaacaagatcactgagagctaaattagtttctgaaacaagagagattactaacgcgataagcgcatcctccactgtcgcggctaagatccctggcatcccgacggtccagttaagaggaagaagcctgagatcagaaatagcccaggtcaggtgtgtctgaacaatgcacatccattgcagctatggctactttggctagtgattgatcttgtagaatgaaaagtacatatatgtggagcatgacgaacccatccttggagaaacgccctgccgtcggcttcaagcccaccacaccgcagagcgcggctggcatgcgaacagatcctgattaaaatgcacaaagaaaacaataactcaatactgcatgcagatattcttgtcgtacatttggcagaattcaatccaaacatcattcattatgttcggatatagattttcatcttccgtcgttgtttgcatgacatctaaatagttataaaaaaatttaaaaaaattgacaacatagattaatatgaaatatatcactccacaaacatacaagaccaaattcgactcctataagttgcaacaaaaagaacaaattaaactgaaaatagttatcatacattcgtatttatatttattatttttgttacaatctatagaagttgaattttatcttgcatgtttgtagagtgatactcctatatttcatattaatctatcttgacaatttttttttaaaaaaaattataactatttaggtgacataaacgaaacgaggagatatcccctcgacggatgaaatcactttcccattatgttctgaatgttttgtatcacacaagctagttcagcaatgttttgtttgtcagagcaagacattttcagtttcattgttcagattaaaaaaaaaaacccattttgcgtgtactgatgatccgatcagataacagaagccagagcaacacaatgttttgtattgtcagagcaggatgtttttagggttcagaaaaattcccaatttgcatgtacgagttgagtaggtttaccgcctccgtcggctccaagtgcgacggggcagaggccggcgcagacgacggcggcggacccgcccgacgagccgccggccaccttgccggtgttgtacggattcctcgtcgatctgaaaccatcaaaccaggtaagaaacccattggtaaaagggtaaaaaaattgtgatttggagaccgcgcggatgatgaacaggacgacgacaagtgatgcgtacccatggtgcgggttgatgccgctggtgccggcgccgagctcgtgcatgttggtcttgccggcgagcaccgcgccgcacgcccgcagctgcgccaccaccgccgcgtcctgcacgcacggccgcatcctctgcagccatctcgttcctcctgttcatatgcgtctttgatcagtttcagggtacagtacaaccaatcagacataacatttccacccctaaatataaaactagtatatatgatttagggcctaccctagtatcgtattggtctcactttaaaccataccattttggggtaaaattgacagacatgtggatgaatttagtctgttatcaaatattggtaatgtgtaaaaaattgacagcacatttagcctatcataccaaaactcggcaatgttgccaacctatcaaattttggtattgccaaattttggaaatattcattttgacagtaatctgaactggtctttatttatcatgtttgctatgtcgacatagatttggtcctgacattagttagaatcttcagattcatacactctctttcttcagaaaaaatgtttttaatttgcaaacagtatttcatagcatggccaatgcaataatttattttgtcccctacaaaaaaacgagttagtacagcctactgtagctaatttaaaaaataaaagcaccgatttctctctttttgcaacaaatcggatcacgtcttctgttgatgaacagtatcaatccaaaacacacatgccaattgtcagcactcattttgcaagaagcaaacgatcgacggacagtgtgtacggcgatgaacagtgtcatcagaatcatccgaccgtaccggggcctcctctccatggcggcagcagctctacctaccgtcctgcagctgattaaatcctgattccgattgctttttacctcctgttcttatatatgattcgacaaccttagcaccgttgatgatacctgatcttgtgatgttcttacctgttgttgggtatggcaggcagtcgatctcgtctttgacggccaccaggacgccatccatggcagagagaggagctcctgcagttaattagcatcaagaacagtcaaacacttgacataatccaagaacaattaacagttaacagaagccaagaaatgaaatggtgcatgcaatcgatcaggtaaaagctgcatgaatgcaaagagtaaacgatgagatactgcaacaacagatgcatcagcacaacgagatgccttcaattgcaacagatcagcaggccaggccctgcaaggaatgtagtattggcctctgcgtgcaaccacatgcagtggcaactaaccgtccctatgagctatcaatgctggatcaggaccatgcaatgctttcagattcgatcaagcaagcaaagagctagtctagtcaatgcatgatcattaggggatgatgccgatgccatttctatggaatctttcatcagaaagccccttctgttcgaagtctgaacattttgctccatgtcagattagtccgagccctgaatctgctgcaagctgcgtgttgtttcattgtggaaacatctctttcagagaccagtccgtgcattggcaggctctgacaatgccttcctgtaaagcatctgctgatactgttcatccagctggtcagttccagactgcaatggcagtaatagtagtacttcttcaccagtactacaagtaaaaactcatggccggaagcatgcaagttggtagtagcatacagaagtaaacatggtggttatgacagtttaatttctgcagattctctgaacctaaatgtcaatggtgatgaaggctagacactgaggcacttgctgagtactgctagtatgatataattactgtttaatgctcgaatgattcattgattttgatttgttgatacggttctttggcataatgtacactgaaaatgtagttaattttgtttaccttgctggtatctgagggtggatgcctcggcctgtctgatgacgtcctgaggattgcagctgatgaacaaggccatgttcagatcagggcctgaacactccttcactgcagcgagaaatctcctcgcaacctgccagcaatgcagtacaagctaattgggtagcattcatgaacaagaatacctctaacctactaaaattcagtgagtaattcacacccccaatgcactacacattgtcataatgcattgcattgtactgaactactgatacaaaaaccattaaacacgaacatattactgtcagtaaaactgtactaaatgttttaccatgacaggagtgatctctcctgagatgtaggcactggtgaagtcccggattgtccagcgcctgaaccccggcgatggcgggtcagcgagcaccgattcgaggcgagccgggaggcagacgacggcctcctgaacgcgctctgccggcgacatgtctggcttcgtcaggctcacattctgctcagggatgtctgcaatgaagcaacagcagcaggagcagcagtattttcaggttctagctgaatctaaatttgattttcaaatgtgaattctactgtgaacaaaagtacaaaaacggctcgaaatggtagggccgaaatcccaaaaggtaaggaacagaagacagaccttgccaggtgtgagctgcagtgaacagtggtggctccgggatttcggcatccgagacaagctacagtgaaattttcagcaactaatcagcatccaaacaatctgatcacagttcaagtgccattataatctacagcgtttcagctaacatttcaacttgtgtttttttactgtgccaagcagaagaagtgatgatcatctaccttgttgacaagattgtctctcttgaggatgtagagcacgattgagccgatgatcggcgcctcaagaacccatgcgaatatcttcaccagaagcccagcaacccgtggagctgaagaaagcaataaaacaaaaatgatcagacataagcatacaaatcacttccaagaactgaaattctgaattctgaatgcaaaagctctttgacatgaaaatggacagaaaattcagcaagagcttgtaacctttgacgttggggctgatgtagaactcgttgctgtcggcgccgagattgacctccgacgccggcttgtacaccttgggagccgagctgaagacacccatggatggaagctgatgagctgagctgagctcaagaagaacaaagacctttgcttgctcaacaatgggagacgattcgagtgtgcgatagagtgcaaccatgccacagcttatgtagtactccatgtcgcagttttggacggtagtgtggaggtggttgcatcttacagaggtaaattcaatcgtacggaacctacagttactgaaaaccagctctcatcactttcagacattcgagctatatatctcaagcatttagtttccaggcttataaactcgagcaaagcactatacaagtttcaagctgcatttcttcagtgacagattattcatcttgcattcagtgaattgcctacttatatgttcagcacatcttcagctcgaactgactagcttgtgagaatggtactatatgacaaacatcagtctcaactttcaacaagacttgcatcagaaactggtgaacgctgaaaagtaaagaaaatgaggctgagctcatagcagtaaaatcatcaggcggaacaagcacaagtaaccatcattttcctgtaaatgtacactgatctaagcatcaggtgacaactgacaaacatccacgaactgttaaataagtttatgcacaaatctttttcatcagatttcactttcttgttttgttcctgtagctaccaagcgacgataaaccgccagagaacactgacgtttgcgaatgtgtggaagacgactgaacacgaggaatgggtgacaggcagctcccattgctctttggaagatccaaatcgtacaggccatttgcaaagcctgctggtggcacctcaacatcgggttctctaaagtccagaagtgcatccccagactctagcttttcaggctcggctgttacactgtcgagatcggtcagcgattttagctgacgaccgaggttcgcaatcgtcttctggcactccacgagttttccagcagcactggagagctctttatcctgttacagaagatgaattgttaatagaaacttctcaactgacaggtctgattggaccttaggcacaaactaaaatacaggtatgtaaatcctttgggtgtgcttagatcattgaccagtactagatccattcggttacatgtcactatagaatgtgtctagggaccacaaaactacataccaatagttagatgtccc

SEQ ID NO: 20788 - DNA, 2873 bp, Oryza sativa
tgcggcattttgcttcgtactcctctgacagcagcttctcctgctcaatcttaccttgcagcaagcttaccctatttgtaagttttgtgatttccagtttagctccttcaagttggccttccattgccttccttcccaccgctgcatcctcggccttggcagtgaattctaccaacaatgcagtctggtccttaagtcttacttccaacaatgagatcttctcctggagcttcatggtttcctggtgtgaactctcaagctcagactccaacatctttcggatgccttccactgcctctagttgcatcttcagttccgaagaaaatgccttctcctttgctgcatcgcactccagatcgttcactgttccatgcagtttcgcaatttctgagttcactaccaggagccgtgcctccaatgcttctttggcagattccacgccaagttttttctctgattcaatcttcattgactccatttggaccacaagttcttcatacatggttttctctttttgcaactcgctctccagtgtttcaatagatcccctcagtttcccgatatccgcatgtgcggactgcagttgtgcctctagtgactttttatctgcatctgccatgtctgcatatgctttgtgctgcaaagacagagttctctcggcatcaatctgctcttgcaaggatgccactgtcttgcaaagatccgctaactctacagaagttgactctaactgtgactccagctctttcttatctgtactttcttccaacgaagccacaactgcctgaagtttctcaacttctattgacttcgactcaagctgcaatgccaaagatcctctctcagcatctaactgatcagcttgtcccaaagcagcaattttagactcatttgccaagttgaactgcatttgtaattctgccaacttgttgttggctgccatcagggcatcacacgacgcgtcaagctggactctagcctctgcaagggccatttcaagatcccttttctcagtctcaagcttttcaacctttgcctgcaaatctgtgacctggctctttagtgtttcagtttcgacttttgaagctttatctatagccacagcctggtcagaatcagtttctgttccaaagctagagcttacacgttctacttcagacaatgcagccagcttttccatctcaaggaaatcatccatcaggtcaatctcaacatgattgtttacaacatctcttgagctggcactactgttcttgaactgatcaagttcggctatcagagccgaggcccatgaatcagaatttctcatttcactgtcaacagtcagcatacgctccccactgtcagactggctatcagtgagagattccatgcaagcattgttaggcgcaggcctagaatcattggccaaggaagttcttcgtgtcagatggcgcagcttacggcattctgcctcaacccttgcaatctttttcacactttccaaatgttgtttacttgctgtctctgctgcttcattgctcagatctctttccagtgacagtctcttcaagtccttggctagcgtgagcagctcgatcttcaggcccttgttttccttctctgcagcctgaagtttatcctgcagatcatgctggacagccacagtggcagcttctaatttagcggcttccagctgctgctttagctcataaatatggttctggagctcagacttgtgagaatccaattcttgagtcttcttagcaactgcatcacgaattttctcctcttgttcttccctagcttggcgaagctgcctgacacattctttgagagcatcatctaggtggttcacttgatcatccaaagaggcattcttctgagttgaagcttcgagtaacctcttcagggtactaacttcagcttcagcttgttcccaacctacaagtaagtcaaaaataaagttcaatatgaatttggttccatattggaataaataaaactatgattttcttgagaaggtacaactgaggagacagacgacacactcactccacacacactaacacgcatgtgcagacaaacagaattattggttgatactactattttaactttgccaaagaactatttgaatgagtttcctctttcttagttctattgatgtcctcacatataaaattaattttgaataatgaagggaagccacagactcaataaatgcatgggatcacaataatgcaaaatgtctaaaatcatagtgaaaagaaagattacctgcaacagcctcttctgcaacctttgtatgctgcttcaccaagtcatctttagcattgatagtcaaaagggctgaagcaagcttctcactcaaactcttcacagaatcttgcatatcttcatctttgacatttgtgaagacatctggctgtggtgactgacaatgctgtgtggaagaatcatctgacacagtttccaacactagcttttcatttaaagattttgctgttgcagttccttgagtctcattatctgtaattcttgagcaaattttaggtgattggctatgatttggggaagcaccattcggaataggcttttcgccctggttttgccagacacagaaaaaatgagagtattttccgcaagcacttacaaataatttcaaattttaaatagtctacagaaaaagtaagagatttaatgattgtaccggagaagcaattcctccctcctctctcatctccggtctctctttcagagaacttgattcagacaactagagtatgctctcaagccaccaaagtggaaatcaaacatgtgacctgttacataagaattaacttccttaacaatgagataccacaggattctgaaaaaaaatctatatgtta

SEQ ID NO: 20789 - DNA, 5146 bp, Oryza sativa
cttgcgtaacattatccttagtttgttaatccacaaattacaattgcacttcatccaggcacctaactacataaagaatgcatcaataccacatgaagcataataaaaccatttgtgacaaggttatgttgcttacgaagtagaacattaacccatgcttaactcaaagcccatttgtccctatcagggaaaaggggcccaataaagaacccgctagaagtcttgggaacctttatatcttgtttgatgcatttaaagattgtgtaaccatatgtttggaagtacttagtagtctcttacaaaatcatataatcaggacgaatcaagtacaaacctaactactcaagtctatttccaaatattaaaactggcatgctatattgctattggttactggatgtctgatttctacaaatttattcattgacaagcgtgtgacaaacgagtgaccctgtaatggctggcccaacagcaacagatcaaattgcaaatttgcatgtcataaatctgtccaaagcagaaaaaatgacatctcagctagagatgccaacaggcaacagcatccgttatgtttattaaaatcagaaatcccaactttggttcttaagaaaagtttgttccccaagtctaattcgcaaacacctaaactatcaccaaatcatgatgtttctagtacagaagtgcagatgaatagccaaacagaattcagaatttcttttctcaaaactgaattcaaaatttcttagatatggatcccattcagacagaatttaactattgaggtgaacctgatcaccggagtgcaatgacatcgaaccagggcattcaaacttgtgcctccagagtcaactcttggagatccatcttgcaaccaccggtcatcagacaatcaaagcatcaatagtgatcacttggtctaccagccaccatcaaaaagcatggtttggatcactgaagtctgaaacacaaaccaatggagagaaatctcatcaataaacatcacattgcatattactaatgggattccttaataatgtaatgttgtaaactgagcaacaggcagtaactacaatcgtcctagggaagtaaaagtaaaactttaaaacgttgcaattaccaaaatgtgagcaatgcacaggatccgattttccactgtaatatacaatgtctataacttaatgaacacttcaaaacaaagataccaaggaacacaaaatccaacaaggcattgagtacgattccagaaaccaagagaaaaataatatatgcttgctgcaaagcacggtaatatcaaagtttttttttttagcaaacgtaaaaagtacaaaccctatcctacccttttctaagacaaatctttgcatcaaacgaacacatcaaagatcaaaatgtggctagtaaatactcctaaaacttcaaaaccaaatctggcagcacctaaaaccctacaaaaatgcatgccaaagcagaagattttacccaactccgaggcctcaaaacgagccaagaaatcaaaatcacttcgcataacgcaaaaacaaaagagagagagaacaattaagaaaccaccaaaaacgaagagagcaccgcgcgtaaactggattgcagcgcaaatcaaaatctcccccctttcaatctttggaaaaactgcacccgcaatcaaatctcatcaaaatcaagtctacgacgggtggagtgcgcaagatacagagcaaaaaacctacaggaaagggaacaaagaagagagattcagaaaatcggcgcaggtgaaggggaaacagggagcaattaatacctctgagaacccccgaattaaacccgtcgcctggagaacagcaaaaccaccacaagaaccatgtgaacaccagaccaaagttcagtttttttttgtctttactgctactactattctatctctttccctttctcctagtagtttatttgggataaagatcagagggaagaacagccgcagattcacattgctcacctcgcccacaaaatcaatcacagatcgaagcgaacacacgcggagaaggatgagagagaagcaagcacaggaggtaaaaaagcaggaggttactgtaccagagcagcagcatcaccatgaatgacaccatgcccaagaaaggaggaggagggaaaaaggccactgcttttgacgagatgagagcctcgagtgcgtagaaatcgcagcaagaatccaaaaaccgcctccttttttgcttccttttttctctcttctcttcttcttcttcttcgcggttcgcctcctctctttcccgcccaggcagctcaaaccaggactcactttcagctgctggtgttcttgcctcccctcctctcctctcctcttctactgctcttcaatgtgtcattattgtagtactagtactacctgtgctgctaccactttcatctcaagaagaaaagggagaagggagaagaaaaaaaaatgttgttaccgcagctgttacttgtatactgataaatacttcctgtctttgaccgggcagagagtactgccacggtctgctgctactgtgtaagggtattcctaactcaataactagatggtgtccatagtattaaataagttgttatctatgataaaaaataatgtggcaagtgaataaataagaaaaaaagaagaaaatcatgtgttgcatctacacaacatccaagacattatgtgagataagtaacattaaattaaagtaggaatagtggtgtttgcattggaagagtaatgtctagtactagtttttttgatgatgtggagttcatagaaaccatgtctagtgttatgggttgggactgccctaacgtactactacttaattccactaaacaaccaccattacttatgctaatctatacttgctggatttggatgggattttgcattccataagcataatgatgctaatcactgcctcagctcagctcagatggtggatctctgtattactgcaggtttgtagagcatgggtagagtaggggcctgtttagattcatttggaatggcaaaagttttggtggcaaaaattttggcattgcaaaagtactggttggtgtttagatgcatgttaaagttttgtcattctagtactaaagtgagagagaaaaagagagagggagtggtctcaaagcattttttggtacaatttgctagcaaataccaaatgccaaattgccaacttttactactaatgtttagatctaaaatggcaaaaagtgctataaaataacaaaacttttgctattttagaggatctaaacagggtctagatttgtttagtgaacacaggctgcgttgcacctggggtcctggggaggctctggcctctgggcgtttcggatttaattttctttgtttcttccgatacggtggggcccacctgcagcgcgtcgggaccgaggagatcccatcgtctcgtattcggaagtattcgtatggatcggagtaccctggagcttgcacacacaggtttgaaaatgtattacgtcctccatcgaaatatagaagtagtactccatcaatctaatatggaacttaacacattattttactatattaaggccgagtttagttccaaagtttttttttaaactttcaacttttccatcacatcaaaactttcctacacacacaaacttccaacttttctgtcacatcattccaatttcaataaaacttctaatttaaacgtgaactaaccacaccctaaatccggtactagatcgttatgctatgagacaaaggcaatactagtatggtttggaaataaaatgaaaattttcaaaaaggtcaaattttggccctctagctctaaactctcactccagtgggagcgggctcctatgagagttggggacaagctaaaaagtgtttgtctagcattcagctctagatctaaatagaaaaaaaaaagggaaaaaaagcaatccccaatctgaagccctaggttgccgtctccgtgtgtgctaccggctgtcggccgcgcgccatcgcccgccactggacacctcccatgcgccatccccacgtgcgccgtcggtcaccgcccgcatgccgtccccccaccaaccgtgcgccgcccgtggcctaccgcgcaccccaagccgtcgactatgccgcctgtgcgcctggccgggtgggagaggtgaggattatgggagggaaagagaggtgagaggtggggtagttcggtggcatttttatgtaaatatgttgaaaaattaaatggtagtgggtcttttagattggagtggaactgtgccgcagcaaaaatttagctccacccccgtattttattttttatgagtagcttagctaactccacttccaaaaacggaggatctgaactgtttggcacagctccggctccgggtaaattagagttaggaactagagctatgccaaaggggcctttctttgggacacatgaagtatatgcagtttttataaaatatattattccatttcaaaatataagagcacgggtccaataaattactcgtctatcctaaaaacccaatcttagaggatacacgctcatctacatgtgcgatttgaaccctggtgggtggagttaggcaccaaggactccaccatacttccggtgcttccccattttttttatagagggattatgtgtgagagagaaatgggacatatattaatgatgacgtgttgtgtagcgcccgttccgtcgtggcgcctagcgggaaaattatctcttaaaaaccctagttgcgaaatttgtttctttgcttgttgtctagtgtccgtgccatctcaagatctcaaatccccgatctatcgtcgagttcaattccgaatccaaatccttccaaatcaaattcctccgcaaaagtctattttgtctcccccagggtcgatgggccgaatttcctcccggctatctctctcgctctctctctctctccccctccccctccgctccgcccgcgcgccgcgcgcgcgtgcgcgtgagccgccgagccgagccctcctcttcgctccctcgctgccgctccccgcgcgtcgttcgcgcgcgcgcccgcgtggtcgtcgcccgcgtcgcgcctacgccgtctgcgccgcccggccccgctgctctgccgcgcctgcagccgctcg

SEQ ID NO: 20790 - DNA, 1389 bp, Oryza sativa
ccgccggaaaaattggagggggggaaaggtggccggttcgactgggctcccacacgccacgattgatgaataccccacgtgggagttttttcacatcgatctcttgatgacgtgtcaatgtcaggtgggtcccacacatgcacttgatgggaactaataaccagatggaaaaagtccactttgaccgaatctaatagccgaatctaattcgtacccctcaactaaaaaaggggataggacgactcctcgaactattgaaaaatcagtgtaatttaactcctccaagacagttaagtacaaattgcggagattcgcacccgatcggaaacaggccatacgagaagaactcgacaaacttctcaaagctggtttcatcagagaagtcatcaatccagagtggctcaccactccagtaatggtacgcaaagccaacagaaagtggaagttgtgtgtcaacttcaccgacctcaacaagacgtgtcccaaggactacttcattctttccttgaatagaccaatcggtagattcaaaagccagttgtgagctcttaagttttcctaatgcttactccggctaccaccagatcagcatggcaaaggaggacgaggagaaaacagcgttcatcacaccctttagtgtgttctgttatatgaagatgccgtttggattaataagtgcaggcaacacataccagcgcgggatccaaggagcacttggcgatcagcttggacgaaacgtcgaagcatatgtggacgacatcatcgtcaagatcaagacaggcgaataactgatcgatgacctaagggaaacgttcgacaacctctgaaaaaaaaagatattcgaagtcatactttagtatgatttatcactcacctgtagtcattgttaagaaccttcggttttcttagaaagcggaagaaactaatattctgatgtgctcagattcatatgtgacgggtgattagagaaggttctagttttagcaggattgagatcaaatgcagtagctactaggactgcacggtaactactgcacacaatctgagccctctatgtcaaaatctaacggccaaaacggatttggcacagtaaaatcagaacagtacctttccatcactacagtgttttgctacagtgctcggatatatctgggacgtccattttaaatcatgcgatgctagtttgactgcttattttgcagtcccactggctactgcacctgaatcggatccgttttagcatgcaatatgtaaaagtgaaaagaaaatgaaatagtgctttgttttataagctctttattggttggtagatatgctgcttaaataaaattgttacggtggtaatatactacctccgtcccaaaataagtgcagttttgcactattcac

SEQ ID NO: 20791 - DNA, 685 bp, Oryza sativa
acacaaaagacgggaatctttcgggttaccttccgggccctcctttaaggtcttccctggcgaaaaacctttcaaaaaggacccttattttttaggggattcctttaacaagaacctcaaaatgcctggttggaagttggggatttttggaccccaaataggatgaagtcccttccttgcgtgtcaaggaggacagcatcctatcaagaaatgagtcaccgtggaaacaaggagtaaggagatcaagtgtacgatctacgatcagcaggccagcagatctcttattacgaccaacatcatatagacttgacatatccatcatcagcttcccgatgacctttgatgtatctccaagtgaaaatatatcgagctttaggtccatctacacatgttttgtaatacggatcactaagtggttatatgaatgaaaaataagaagccactagtaagaaatatgttcttatgataaatctttaccttactggccagatggtaaaggaactgggcagtcaatgtcactccggggggaatctcatcaccatcaaaagatctaccagtagatatgggaggtagccctggactaagggaatcttcatgatgagtagataaacatgattcacccattgtgccttcagatggcaaaacaaaaggcctagaggaaaataggagagaaaatcatcggaaa

SEQ ID NO: 20792 - DNA, 644 bp, Oryza sativa
ctcgtggacgatccgcactagctcccatgtattgaaatgtggcacattagctttgatcccatctactaattggctctattgatttgcgtgcacacatgacgcacgtacacgtacccatgcatgcatgcatgcatcctaattaatagttagttaatgcatgcatcatcctagctaattagtaattagttatatgtatgcatgcatatagccgaacttaattagttactactaggatgttaatgattcagctatatgtgatgtatgtgtatgcccgccgatgcgatgcatggtcgcgcatccgacgatccgctccggccgcctcctaactccaccgatttcctttcctccaacccaccggccgtcttcttttgtttgtttggttagcttaattagtccctcaacctcaagagacgcggaattaatccctctcaagttacttcttgacaggtaaatatgtattaatgttctctaatcatccttaatctctatctagctattattataggaaaagaagctggatccctaccacctcaaccgcaaccgcaccggtgtggtcgtcacgtctgtcggagtcggagcccaagttgcattggtgcgaccgcgagtccgaccgacgcactaatcttgcggcgaatgaccgggga

SEQ ID NO: 20793 - DNA, 5344 bp, Oryza sativa
acactagaaaggtctcgcgcgctacgccgcgcgggtgtaatagacgtgtctaaaagagcctaagacgcatgttattggagcttactgaaagtgttatatttagctggcaatttagcctgtgtgggacaacagaacaagtagctcatttcaagctgtaatgagcttgattggttttatgtttaaatttaggctcttatagacgtactgctatgatttaaggatgtacacctcctgttagattcaggcactcagtaagtaagcatgttctcatgcttagattacatacagtctgttggaggtgcattatatccttacagagtgatgtgccatgctgggatatatagcatggaagaatcaatacatgtagtaactatatcgcaaaacatctccgatcacaacagttgcagctatagcaaataacacaaaggggcattttgtgccatttagtgaaagtagcctgcaggtttcagaaatggcaagcaccattgactgaatatgcacaatcctttgtagggataatttttagaagctcaatattatgaatcggcgatacgaatcatttagtgtttgcctattagacatggtgagctagcaatagctagaacatcagttggttgatccccaggccaatacagaagaacatatccttggtcttatcttcccaccacaaaacaaagagtggccgaagcgtgagcattgctatatttgagacagcctcttgccatggtaggtgggataatattacatgggagccccaaatataaagtgaatgggcagttagtacttgtttaaacaaataaccaaacaagtagaacataactgtttaaaataattacttacatttgagcgactccagtggcagtgtatctcagaatagctcgcacaatactgaagctctgggatgaccaccttcatcaggagatgagctacagatgcatgtcatttggcccatctgaaaacataattatattatatatcatatgcggctaacgaaggttttgtatgttattgcatcctaagcactctagtatgtccaattttcaaaacctaaaatattgtgaattgcatctttgaagtaacataaaagtaattatgtatagcttagcacctaaaagggtataggtttgtcttgccattccaaagatactagaaagaaatgcgcactacgctgcgccgtttgaagatgatgcacatgccaccattatgctacaatgtcatgcactaagcgtataaaatagcacctggccacatacacatgaatataactttattgagaaaacatattgttttatataaaaagtattattataatgcattagcagaacaaagaatatgcgtaagcatatttcagtatctgatacactacctaagcagaagatcataaagattatgcaatgtttgttgtacagtgtttgtaaagccgataaaccattggagtttgccaaggagtaacttacaactgtactaatgattttaatgacaaaataagagaagtaatatcgtatatagagaggcctcccatgtacagtctcttttatgtagcataaatcatgaccaatagagaaaaaatgtctcaattaccaaaacggcacaaaaatacacaccatgatatagtctaaatataggttttgggatacaaatatcaccaaacaaaaatagtagaaatagatgtgtttttcaagagcagcaatgctggctcagcttttgaaaggcgattctctgatcttttggcagtaactgaggtggtattgctcttgcatgagtttctctattcaccattatatacatcagaaaggaatctcctgaaaaaaaagaatagtcaaaactgatttgcaaaagatgatgcaatgttattgcaaaaattaatgaaaattgtgggaataatatacacacaacaataggttactgggatgtgtacttccagcgttagaggctactttatacgaagagagaagaaaagagaaatatggcatctatcaacacatgatggccatggattaagaagtggcacaaacagtaagcataagagaagtattccgtcatgaacttaagatagaatcttataattgcaattgctggtgaccggcaacatggagaatttatatgcatagaacattcctggtgcagctagcatattctagaggcccggccaaacccttggatcaaggcaaagacagtggtgcaaagacaaataagttgcatgtagtcttcatcatttgcacattacattataaaaataagagctatcttctaaaattttttttgttgggcagaatataagtttgtaggacagcattacataactacctgcttatgtcctatttgtcaaacatggagcagcaaagtcatctaaaacaccaccaagcaatgataaaacaatcataggcttcatttcctccatgatcttatcaaccttccttattgaactggaccgacacaacaaaccccataaactaatctaatcgcgcatcaacaatagcatgtacatcatctataatatctgcattgtacgcatcatgtcatttttggcagaaaccttagcaattttaataaaaagtatatcctttcaatgcatatcctgttggcagaatgctttcatataagctttttattgatagccttgtagtgatgcctagtaaggttttttttttttttttttttttttttttgccatcgatgtcattctatcaagctaggtaaggtggcaccaccatatcataccatatataatgtagcagtagaagcaataaacatggaatttctgacaactgaattcatatgaaataatctgaagtaaagaaaaattcccttaatagaagtgaagcataattgtatatgatcattataatataattaagcttttgttaaccgtactgtggtaaagaagatgaattgtgtcctgcaagatgaatctccctgctgaaactgtacctctttcagaatagaggtaggaacaacatgaagcagttagtgtttcctaaaattaaacaatgttgtacatgaacaatatggaaataaataaaaaacgatgcacctgcatattgtttgtgttcttcaaacttgaatccacaaaactgagcatgaacatgaatctgatcttgccacaaaccaaaagaagcaaacattaatttaaggaatatgatatcccttttaatcctagttaatcctagacagcgaacaatctagtcgagagagaatgaactaacctagtgcatactacataatcataagagaattgtattaacttatgacagaatgatttcttgccttactgcatgaaagaatattcttccccatactacatggaagcaataaaaggaatcactgggttgtagttaaaaacaaaaaaaaagaaggaaattgttggggtctagtagtgcatctaatattgttgacaaatttcacaaggagattatcgattgaatattgcatagtacataccatgcttaagagtgaggacaaagctagatgggtccctcggcaggatggcacaacagagtggtaccacacaagacatctctcttatctatgaacaacacctcatcgtaattcatcagtcactcgacagatcctaagggtaagatggtgttaaatctttcaatatgaatgcaggccaactgcagtaaaatgacagtcttaatttatactcccttcgtcccataaaaaccaaacctagggatgaatctggacggattcatccctaggacgtccctaggtttggttccctagggttggtttttatgggacggaggaagtacaaagcaaattcatgagcaaactgcaaactaccatccgaaatctctgacctgacagaatgttatttctaaaagatgaacacaattcctgataatttaaatgtagaagtaagcaagtaaatagcattttaaaccatggtctaatagtcaaatgtagaagtaggcacatcgcgtatgtgattacccaaaataaaccaataagcggtatgcacctatactattggaatagtatcaaccaaccacttaggaaaaggggaaaaaaaaccaggttaaacgatgtcaacaaaataaaatagttaaatgtgaaagcctaacagaagatagtagtattatggattactttcataagcatatgccacactacataatattaaaagagtggattggaagctgtaacctgaagcatggctacattatatttattttgcaacattgaatatgttgtggacataaccagaagcaaactggcataactgtgacttgcaacatggaaaatttatatgcttatatgcatagagtactttcagtgctgctaggacattctagaggcctaaactcttgtgtcaaggcagaggagaaagatgcttgcactcttcatcatttacacattaaattataaaaataacaggcacgctgaaagttatttttttttggcagaatgtaagtttgtaggatagtactaaataactacctgtcggaacgttttgttttatggatatatggcagcagactgagttgtctgaaacaccaccaagcaatgaaaaaataaccataagattcatttcctccatgatcctaccaactttctttgttgaactggacaaacacaacaaaccacataaatccggtgtagtaataattttgttgcaacaaattagacatcagtaaaagctttgcacactgtctatcggcgtgttatgctcccagtattagagctagggggttttgatgtcagtattgggctattggcaggtatttagcaaagttaataaaaagaatatccttccattgcatatcctgtttgcagaatactctcatataaccttatacttatagccttgtagtacctagcatggttttctttttccttcctgacgtcattctatcaaggggtgccatacaatgcagcaacaaaaccaataaccatggaacttctgacagctaaattcatatgaaataatctgaacccaagaaaaactcaccataatctaaatatcgcagccctgcttaagagaggatttgctcagtatgactgtagatgcgcagcataaaagtcgtcctctctgtaatctgcgaccaacacctcatcctagcccatcaatttctccacagaacctaaggcaagatgtgggatcatgtaaaaacaccagcaaacgcaatggaaatgctcaatggcgagtcaaaaccattgccttaccttgtggattttgtgctaaatgtatgcacaaaacaattgtggctgaaaggggtatcaaaatgattcaccaacgaggagaccaatggccgagaccatcgattccgatgacccccgaaccggatctgtagctcaccgaggatagggagaggaagagggaggcggtgggtggcct

SEQ ID NO: 20794 - DNA, 2591 bp, Oryza sativa
ttttttgtaaaatttgctgacgtggcggccctaaccttcaaccaatcccacggcttttaagtaaacacatatgactataatatctgaacataaaatgtctactaattctccatgatacaaagggcaaaaataattatcgtgttttttttgcattgattcaattcaagaagcgtcaagattgacctgatagtccatataacattactaatgccaccatgcaaaaatttaataagcacatctcagaaataaatcaaataagaaagttcataaggtttacctcttgctcagaactcagagcagagatcaatgcagtatgaatgttcactattatcttatcttgtgtttgtttctcagtggaacaattgacagcttcatccattatgttttcctgagctgaggatagtgcattggccctctagacaggaataggtattttgcaagaggaaatttgttccttcaaactgaccaacgatttttcacttgtctgaagatcaagaacaattgagaataatcagataccatggctgtcctggacgaaagaacaatttggtaaaatcctcttcagatatttaaagccgaacaatagctattgcaataggatgtttcatttgtataattttgaaatgggtaatctggcacataataccaaaccgcagttctcaatagtttaatgccatcatatcacttatatcgttatgtatcatacacagtgaagaatatagagaatgcatggcaataatttgtgttggtcctgcatgaactcgtgtataatgaggtgaaactaatctatacagataacacttcagcgaataaagtagcacatctaaaatttcccataagttttttttacaacaaaactgaaagccacttacctacaaaattgttgtgtaccctttgatgaatatctcttgctttgtacttgtatcttggatgacctaccgattataagtgtctggcaactatctcacaggctgagacacatcatatattagagaaaatcataatgaactgcacatatcgctgaaattaagtagaacatgactctagattcgttaatgcgaccaagtgaggtgccatgtcagttttcgaaaatcattgtcatccagtagctgatataaaaatattgaattgcaatatatacagaacaagaaaaacaagaaaccacaactctgttaatagaaaagcttgatacaataagtaaattaatacgcaaacattggattgaggatcacataccttacaacatttagttacagagtggcaatatttgaccatatagacaggatgaaaacccttgcaagttgacagctcgagttatggttgaactgcaatacaacagagttcagattgtgataacttctattctacttggtagatttccatgttctttaccttaatagagggcttaaggaaccctgtacaactctatagttatttgcattccttgatttggcctctaaagactgaaaaagttaggtatatccaaattgaacaattttgtgaaaataaaaacaaataactgaaattaggacaaagcacgaacctacctcctaaatatcaagccaatcatatctgaatctgaatgtacaccatacgatgagggattggaataggtagcctaaaaacgcattagcaaattacttaggtatcccagtttcctcctccctcacattttcccccttgttccttgattcctcctgttgctgcttgctcagcctcccaactcagctccatcttgcaggcttgcagccactgatgtagttgaccagagaagggtgaaggaaggggataaaagaaggcaaagaatgtagcagactcaccagagaaatccagagaagatgaacggagcagccgaggagggagcttgaacagaagaaaaccccactcccgtgtacggagatgaggcactggtcagtggccaatccggtcgccaccgtacggggagacgaacgccgatggatgcggctacacggattgtgccgacggaggagatcatgcatccaacatctgggcacgggatagcagatggcaagccgtcgtgggtgacgacctacgatggaagatcttggaggaggcgaggagcatcgatgccgcctctagacagaaatcaggaggaaggggatcgctcgatggggatgacgggatgcaacgtggggagatgagcgacgaccgattccacgggtaggtaaggacggagccatctagataggagacgaatggtcagattgtgtccacgcgtggggttgaacggctctgattcagtggactcgactggaaataccgaaataatgaggggatttctgcaaaaatcaatgagtgggtcggcggggcctgcagttaatctaacgcttattaaattttttttgcttgttatgacatgtcgatgtcgcagtgggcgctggcttcccaaatcgctaggagggcagctaatccagcacctttaagatatctaatactccctccgtcccaaaataagtgcagttttgcactattcacgttcaacgtttgaccgtccgtcttatttgaaaattgtttatgattagtatttatattgctattagatgataaaacatgaatagtactttatgtgt

SEQ ID NO: 20795 - DNA, 4356 bp, Oryza sativa
gatttttttttcttctttttcttcagaggggagaggacggtgaagaagctgcggctgacgaaggcggtgacgatcccggaggggacgacggtggcggaggcttgccagcggatggcggcgaggagggtggacgccgtgctgctcacggacgccaacggattactctccggcatcgtcaccgataaagtaattttcctcttcttattttatttttcaaatcaatctgtgatgtgttttctaagctggaggtggttgcgattggctaataagtgggttttggtataattgtactctacgaaactccatatagagttttgcttgtgtctacatcaagtgcctagatttcttaaagatggacgctttatgttattgcaactttttcttaggactgcacaactcctctttgccacatctgacttgttcaataatgaatcgttgagagtttaaatactttgactaatgctccatgaatcaattgttatttatgtattttgcttcttatgtattcgactgcggcccaaccatgttgtgttttctttttttcttttttctttgcgggtgcctatgttatgtgttcgactgtaagtttgtacaaatcacagcaatgatttaatactataagtacatgccaaagtatcttatgcttatggtacttaaagcttaaagtagatgctttatcttttcgcccttatttgcataattgggatataggacatggctggtacttctagcttaaaggagataaggagattctttatcgtttcgtttcttatttgcttaatttggatacaggacatagctaaaagggtgattgcagaggggttgcgggttgagcaaacaatcacctccaagatcatgacacgaactcctgtttatgtcatgtctgacacacttgctattgaagcactgcagaaaatggtccaaggtatcttgtaatcttaaagcatagacccagtgatctgcctgtttggttcagatacttcggacttgggtcaattgaactcacttcctttaactcctacaagctgctgtggagtatatttcatatgcattagttatctttgttgtagctacttattgtgagaatgttttggataataatgttgtgatcagtaaatccttgttgacaatgttggactagccatattgtttaaaattatcactatttttgtatttctgagaagcttcaatcagcattctctttccctgtttacagtataatctctttgaaaatctattcggtcaagactattaaactatttgagtacttccatttttttttctcttttcttgcagtcttttatgcattcatcagtttgtcttttcaagtttgttgcatttccttttagcaataatctaaattaatttcagaggaactttctaatttctagacattcttccagtattgagagtctcattggctaaatttaatttactataggacaactgcatatctttaacctctgaacatcagcattctacaatcccaatgacctgtatgcatattaagaaagcattattcacttgttaataaagcagtaacagctatgctatgaaatcaatggtcattgttagaaagtttgtttcttattttaataacatgggctcatcattccaattgttttatatactgtctctccgtattccaagtatgttcattttcctctccttagagctaatatgaaacactcacgttttaggaaaatttaggcacctcccagtggtggaaaatggtgaggttattgccatgctagacattgcaaaatgcctttatgatgcaatatcaagactggaaaaggcagcagaacagggaagtgcattagcagctgctgtaaaaggggttgagcgtcgagtggaagacaacttgccaggttttctgttgcatatggtgctgactagttattttcctttgtttcactctaaatgttcattgctacacaagaacagaaaatgtatactgcagtcagtagccatgtgaactaggttatgagcaatttgtaatacccagtttatcccaaagaataatgagatgattctcaggattggaactatgtttgatgtttgatgctttactgtatacatttgtacattattttctaaatagatttcacttaaccactgttttctggtcttgtttagctgaccaaattactgtgtttaccatttgcagatcattccagtgtaatagaaactctaagagaaaggatgcttaaaccttcattgtcaaccattatctcggagaacacaaagtacatgaaatttttattagtattccatttttgggataaatccacaccatgccactgagttttattcatatccatagtagaccactcactgtgaggatgacatgtggccatgtgggcagtgagacatcagtagtatattgtagacactgaatgaaacttggtggtataaaatggatcatccaacataatgtggtttgaatcatgggagttacctcttttttaacttgcagagtagcaattgtttcaccatgggatcctgtttgtgtagcagcacgaaaaatgcatgaattacgggttaactcagtggttatcactgcaggaaattcattgcaagggatttttacgtaagcatttcaatacttttatggaataattctttattctagagtttatattattttatatttcttaaggcactaatggctatgtcattgtgaaattcagctcaaaggatgtgcttatgcgcgttgtgacacaaaatctctctcctgagttaactcatgtagaaaaggttgtttctccagattgaatattattttaaatgatttaaactaccgatgggttatacaattcattctagactaacagcattactcactgttttgctcaaggtaatgactgcacaccctgaatgtgctacattagacacatcaattctcgatgctctgcatattatgcgcgatggcaaattcttgcatattcctgttgttgatggaggtaacacttgactcttcttcagcctaaggtttctctttatggtactagtattttatatctgactgaactttttaattttaaaaatgaacagaagggagagttgttgcttgcttggatgttctgcagattacccatgcagccatttcaatggtctctctgcacatgcgtattttttcgcttctcattccttgctttttccttatggtttccgttcatctaacatcattctgtgtgaaggttgaaggaggtcctgagaccacgaatggtgtggcaaacacaataatgcaaaagttttgggactcagctcttgctttggagcccccagatgaggaatttgatagtcgcaggttaattaacgcttccttttttgtcctttgtcctctttttcaaatttgcaattcttacctgcatttttgcattgttcagtgaaatatctttgctcatgccatcagaggctggagatggcaggagtagcattaatcctcctgttgttggcaattcatttgtctttaagattgaggaccagaagggacgtatgcatagatttgcatgtggtaggtgttacaagttggttgaatgttaaactatggttgtactgctctaactaacagtttggtttgttccgtctctgcaggttcagagagtttacatgagctggtgtcttctgtggtgcaaagattaggcattgatggcgaaaagggcacagttcaacttttggtaatttgttgtcccttattttatgtatttcgttagtgtttggaagcaaaaaaaaaaaaaaaggttgtcagtctgatcatcgttcaagaagttctgttgttttatatggaatgctaactgatgtaagaaagtacttaaccaccatccacttcaagaataagaatttatctttatcttatgtcaccccatatctgtatctcagtatcctgattttcttatagacattatattgaaccatagagactatatatagtgttgcctgtattatagaaatttataagttgactggcataaaacggtcttattttgagtagcgctggtaactaattatcccatgaaattgtgaatgcacccttaactgttacaagcacttcacttacagctcaattatcacacctcagccacaattacaagctaaattttgataatgttccgtacagtatgatgatgatgaaggtgatagggtgttgctcactacggatactgatcttaccggggctgtgctccatgctaaatcttctggattgaaggtttgtcttttctgtaatcctcaaatagattggtccctctgttttcacattgcgttctttttttgttcattggattatgactattgcttcaccggagtgaaattttcaatttcagtcattgaggttgtacactgatgagtcaa

SEQ ID NO: 20796 - DNA, 17316 bp, Oryza sativa
actgacagtctcaggttttctcaggaactgaggaactgggctggaagtggaactaacaaaatatggtattgctccatttttgtttttgcatgcagatttttcacagatgtagtgaaatgcatgttatgcataattgctatatgaaattatgaattactggtcaccacgaatctagtggattcttccctgacagaacccaagaaggcaagaaatgatatgaagaatacaacaatgtatgatcattctttactaatgtgagaaagaattaatatatgcagtataatcattctttattaatgtgagaaagaattaatgtccttttttttgttatcttcatctcttcgagcctggaaatactttatgcatgatgtggctgataagaagttatgataggattttgctccattcatcagtctcagtttgctgctgcaaaatttagctcaggaaaatgtgtttgtgcaacatttttctttaccttgttgcacctctagactaaatgatgcgttgccacttatttctatctgttctgaaagctatgtagcaactcgccagcatttcttctttggtcactttaatggtgtgttgaccattttttcctcttttttaatccctgaaaacaacattagatcttccttcttagatttaactaacaataattcgttgatctccttttctttttttttcttttttttcccttctttctttctttatcagccacatcatgtttcatcaggatagctgaatctatcataaatcggaataaatggctaatgccgacataatcattcgtctcctggaagaaaaataaattcaatgtagtttttatcaaaatttaacggcgcaagtagttggttttctcataatgaggctacatttccataagccagcctaaagttgggattagtggtaattccaggagggttgccagtgttatatgggttaaagagcaagtaaaatacgcgttgaattgctagccataagaatgtttatgtaagtttgaattatgaggtgaagagagaactcacagaagtgaggatgagctgctacctctcacaagagacctactagtagattgggagcaaatgaataaaataatattagtgtgatagaggtaatatactatgtatgctgtctcctaattactaatgagagattatgtggataaaattagatatatcaatcacctctacttttattaaccttgctcaccacacaaaaagaatagtacagtacgtagtgattcattattacaacatcttgattgcccaaaaaagtttactgcaacatcttagtactctataattgatgcattgattaaccaataatagatctaccttttgctaccttttctccaacagaactacagaagtgagatatgaactgttgtacgttatgctggtacaaaaacataaggggcaattgcatatttgagaagatacatggatggactaattgggtgttgtgattgatggcatctgtctatgtagttgcttgatgcccttgtgacttgtgactagaatcaattttccaataaaagttgtatttttgttctaaactgtgattaaaaagaacaatatatatggaaggattatgtggtgacatgccaaattcaccaccatcgcaccgtacttctttttctagaggagtttggatattgtccacagttatcgaattatgttgaacaaaaggtactttaatttcatataacaatttgggagtaataataggatgtaacttacaaatcaaactaaagtttgaggggtgaaataatatgtacatgaacgccttataagaacaaaaataaatagataaatagatcagattatctcgaataatactgacggagcgtggggctcctcaccgggagaccgcgcaggtccccctttgccggttcggccgggggccctgggtgaggttctaagctcctggtctgtggaatgttcgcgaaagtggaaacgcacaagacacgggcgatgtatacaggttcgggctgctgagaagcgtaataccctactcctgtgttatggtggatctgtgtatgaagaagctacaaagagctggagagcaagagggatcaaactctagaaaccctcttccttctttttgcctctcgtgggatcttctcctggattctccgggagtctccaacctctgatccccctcctaagtgggctaggtcctccttttatatctcaaggggataccacatgcaccacttctacctatttctcctttcgatggggacccatcctctttttactaaaacttggcccgcccttccttcatcaatgggcggagatttgcaatggttgccgtccgaatgaccttctgatgggatggcccatacctacctctactccgccggaagcaggtgcaacgtgggatcatggctgtctgccgacgacatgaccagggtcagaccggtcacaaatcggtcattcttgtccaccacgcgtcagtttatcaatctgcatgttcgtccttcttcatacaatgtcttgcttgtaatggttgggatgaagcctggcatatatctgaccgggaccaacgtgccatcttcaggagctagcacgctggctccggctagggacgagtgcctggaggctctcatcctgacgggatggggcgaggcgtgtgtcagaccgcctgttgccacctaacccgcgatctgatcggtctgtgaccggtcacagaccggataaacgagcgcgctgcactgcgttacatgcggcgtgacgcgctcgttcaaaccacaataaatgcggttaggtgagccccgctgtgctcacctaacccatacgcgacgcaaaacccacaaggggtcggggcgcgcctcggccctcggggccgaaacgggagcggtccgatccctcggggagacaaagagaggggcggtcacatcaccctcgggcccgaccccccgagggggtcaggccacgtgggtgattgctcctgcccaagcctctagtcatgatactcccggtcccatgtcatcgacaaatactatgaccttcggataatagggatagtgttttaatttcgccatgaaatgtggagccaaccctttgacatttgtactagccaaatgatacatagtagcgctcttagctactccctccgtcccagaaaaaatcaacttctggttatgaatctggacacacactacgtctaggttcgtagccagaagttagttttttatgggacggagggagtagctaggagtacaatactacaaaatgctccaacatgcatcaaacccaaaacttgtcatgttcctacgggtatccaatgctagagtagaaactcaaattctttagttttctcttttcgagaatgaaaaatacatatcattttgtttccgtcccgtatggacccctagaagggaacctactttggattttactttgaatcctttctcgagagcagaaaagaatttaaacaaactttcctttgcaaagggcaacatatatatgtgctagacaggaggcataggacacaagacagatgctcgcttccatgaaacgaaataagcacaaataccggtagtaaccggccatgtttcgagatttgtagttctgcatttctaagtagagagagagatagagaggggagataacatgtaaatgtaaaggtaaaatagggtaaatatccgttggaaatcctaactaaaaggtcacctaaattataaaaagaatcgcacatatagataagttgatgttacacaatattataaaaaatattatctaacctcaactttatttgtgagatataaaaataataaatttcaaacaaattattaccgcaaacaaatttatatataagttgagttttcacccaggtagatatagagtccaaattcaatgggaaccactaagtcacattaacaattttgagcttctcttgatatataggttttaattttttaaaataaaacagacggttaaatgttggacatagaaattcataactgcggttaaaatgagacggagggaatataatagaatatgaccggatatagtatatctctctctggttttcacactttgtctcagcaagaggtaaattgaaatataaatcgcatgaaaacaaaactagattggccgatacattcattaacaaaagacaaaacatattcgatattgttagaaggacaagacaaatagtcgtgagtaaaccggtaatccctcaattttaaggtgctcaccatccaaaggtgcatgccacctttatttatccattctcctttctttttccaaaagtttttgtgtccccgttagaggggcctccagtccttttagcgtgtgatggattgataatgataatgaattatatataaatttatctattgcacaatcgttttcatagtacaaataaaaaggattaaaagagttgaggtgtctatttacttttcatggcttgcatgcaatggaagtgaaacctttatcttttttctgttagcttttatgtatgtgatgtcttgtcatctttgcataattaatccatttagatcgtgtgtcagggacacctgataggaatgtactcgtggctgtagcttggaatctcatgattaatcctttctcttttgtctttggaagccattgttgttgtacgtagcttcaaaggtagtttttcagattggtgtgatgatgccatcatctggtagtatttgtcttcagagaagtgcgtatttagtttggcatgaagtcttggttgagaatcagttattcttttagtatcttgtaagcttcatcttacagctaacctggtattataatagtagcttaattaccaaaattaattgtagtaatgttatcttaattaattgaatgcggcgactgtttgaggagtgcaaaaaggtggtgccgtcgtcaattttgcgttgtgttgtcaacacaggttaattaccaactgttcctttctgtctctctgtcagacaagtaggagtactacatagcagcagtcctcattgttcagtaaaaaggtgttcctgtggacaaattaaattggagttgcttttgcttgtctagtaacctgcttcaaggttactactacattatatggagcagttagtttgatcgctgttaatcaggagggacttttgaactgtgataagcagtatagtgaagtttcagtataagtaagtgacaaaatttgggcttatttggaacacggaaattttacagaattttcatagaaaacagtttgtttcctacaaagttctcgtaaaattgttcggctccaatagagccctaaggtcatgttcttttcagcttattttactagattattaaaatagattatttgtttcacttttaaaaaatatttttcaaaaaaaactttattctattatactgcttgtatcatttctttaattttttatcacttttctacaatcaagtactagataatcatatacatgtcccccggtgcagtgaaccagggtcacacatgcagcggcagcaaggcccagcaatgcagtactagtattgcaatagcagcaaatcgcctggagattgcaaaggtttaggccgagggtgttgcattgtttgtgtacaatggcaatccagtacagtatgggcatactagtattttgcaaggttgaatgcagtaataatgtttagggtaccaaaatttgtactaggatcaggtccagacacagattgatggctggggcaagggtgacagtggacaactgtttttgtaccccgggatcgggatgtcctgtgtactgacagtaaaaaaaaacggactggtcagtgttcgtgcagcttgagctgatgcatactacttgaggagggtacataaatacggttctctacttaggagggtgtgtttagttcacgctaaaataattagaagtttggttgaaattggaacgatatgatgaaaaaggtgaaattttatgtgtaggaaagttttgatgtgatagaaaagttggaagtttgaataaaaagttgggaactaagggtgtgtttagttcacgtcaaaattgaaagtttggttaaaattggaacgatgtgatggaaaagttggaagtttgtgtgtgtagaaaagttttgatatgatagaaaagttaaaagtttgaaaaaaaaattttagaactaaactcggcctaaaccaggcctcaacattattgattgatactaggaggagtgtattcctactctgaaccttttaaaactttgtactagtagtactctctttatactaacgtatagccaactactgacttcaaattatctatagtcaatttaataaccaattgatataataattacctataaacatatactacataattaatgtttagtctcacctgtcatacacacatatcttggagtacgtgttacagctggctataaatctgtagcatactgctcttatttctcctcttttatcactttaaaatacgtttatagctggcttatagtctgctattgaacctgctctaaccatttatggaatagaattcaaaatttgtatattcagatatatagtagtattttctatagcattgattttaatgcatgaaaatctatagtacatttttagccaatcaaatgcttgagaaaaaaatacaaacaattcaaaatttgaccactaaggtaactagtaaaagggaatattttcccactaacttaattttgctaagaaaaacctagaaatacttagagtaagtttaataatatagccaacggctaacttcaaaagttcatacatatcatccataggcaatataataacccatccataaaatagttagttatagatatataaacaacatagtaccgaccggaactagcccgtgacgctccaaattaacctgtaaatcgatatcagtcccaggaaatagtgctggtatcacaggaagacagattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttactcctggaagaactcctcgtcagcgggatctgcttcatcttcttcagcaactgggggggaattatttatatagagcaagggtgagtacaggagtactcagcatgccatgggaaataggtgtttattgcaggcttcaaggaaaggctgttgtttttgcaattgatttcatttgaactcttttctgaaatcaactaagtgagtgcttctcaaacgacacggatgagacagtgcgtctcgtccggtcggagtatgtgcaatgtatcagtctttagatttgaatcaaggttggcacccggccaacagcttttcaaacggccacccgggccaacaactttcaaacggccacccgggcctagctgattccatcagctacagatttttcaatcatcgaacccctttccacaacagcaatttcacaagcagtagtcaagcaaaactacgctaggaatcacctcacatccgcccatgaccgtgggcacggctgttcgaacagtttgttaacctctgcagagggggtacactttacccacacgacattactaacccggatcacccaacccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagaagttactcagaattttaagtttgaaggcgtccgtcgatactcgcacagggtgcacgaatatcgggacgcaactagatggttacaaggggacatggtatatcaattagcaaaggaaggatcaaatgcaacaaattaggtaggtccgccgatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggtgaaaataaagccctattaatgacctctaagcgtgccattagatagatctcgagatttgaggaattttggaagttgaacggagtcaaacggacttacggttggaaggatattgaatttctaagattattggatttttggtctaaaggaaaaggatttaattaaatcctttttagaaaagaaaagaaaagaaaagaaaagagggagggacaatagacttttctcgggcggctagggcgcggcccgagagaaatggagcggtccggccgagctaaatgggccggccggcccaaggcggcccaaggcgcgcgcgcgcgggagggaggagagagagagccggtgaaccgggctcaccacgtgtggtcccgggtgggacccgcttgtcggtgacacggttcaccgtgcggagcgagcacgcggcgcacgcgcgcgggcgggggagggacgcggtgcacgcgcacgattcgcggtggatgcggatgcggcgggcccacgcgcagcctcacggctcgcggtggaacgcgcgcacggggaggggctgaccggggtcggctcgacccggccgagctggcgcctacgtggctgccacgcgggctggcgggaggaagacgaaggcgccggccgcgaatggaccgcgggcggcggcggtttctccgggacgccttgcgacgatgaggggcgacggggcgtacaccgggatgacgagggagaataagagcgagcgagccaacggcttggattcgccggagggagtccgtcggcggcggattgcggcggcggcgcccggcggagggaaaagggggaaacggcgacgaggtcacgaggggccaattcccggcggcgagagcatctacgcggctacgggaatccgatgctagcgtcggattgggcggagctacgccgagcgaggccggcgacgagcgggtgctacggagctcgggcagcgacggcggggagcacacggcgagcgacggcaacggtcggggcggcgccggctagctacggggaggctactcatgctaccaccgaaaactaagggggggagatggaccgaggaggaagaacggagggaggcactaccgtgcgggcggggcgcagtgacgagaggccgacggcgcgggagtaatctctccggcctcgggccggggaagaggaagaagacgagcgcccggagtcccctttcgcgtcctcgaacgcaccggctctcccggcgctcggcgatgaacggcggaggcgagacagagcacgggaggcggcggcaatggcgcggacgagaaacggggaggattggggggggaaagaggaagggagggcgcctggggctttaagggcggcaatgtcggtttggaaaccgactttgggcggtcaaggcgcgagctggcgctcggcgctcacggccaaatcggcgacaggacggagggaggataacgccggcgggagaaaaaggggaaaaggagggagagaaaggggtttgcctccttgccgctttgggaaaaggaggaggggagcggggcgtcgcggcagagggaggaggggctctgcctccgtcccttggcggcttgcgcgcggagtggcggggccgaggcgatgacgacggcgatgacggcgggacggtttggagcggagcggcgacacgggcgacaggtgcgggctggcgcggcagagggtgatggcgacggtgaccaggcggtcggccaccacggcacgcgcgcgcgggatgcaacgggaggcgcggcggattgagcggcgcggctcgggcacgcgcgctggctgtggggccgagcggctgcaggcgcggcagagcagcggggccgggcggcgcagacggcgtaggcgcgacgcgggcgacgaccacgcgggcgcgcgcgcgaacgacgcgcggggagcggcagcgagggagcaaagaggagggctcggctcggcggctcacgcgcacgcgcgcgcggcgcgcgggcggagcggagggggagggggagagagagagagagagagagcgagagagatagccgggaggaaggggggagatgggccgagagaaattcggcccatcgaccctgggggagacaaaatagacttttgcggaggaatttgatttggaaggatttggattcggaattgaactcgacgatagatcggggatttgagatcttgagatggcacggacactagacaacaagcaaagaaacaaatttcgcaactagggtttttaagagataattttcccgctaggcgccacgacggaacgggcgttacagaccaacccccctaacaagaatctcgaccccgagattcagcacctaagggagcagctccgggaactcggcgcggagaagatcttctcgctcccaggttgcctcatcttcagagtggttgctccattggactttgtagaacttaatggtcttccttcgagtctgacgtactgcctcttcaagaaccttgatcggtctttccttgtaggtcagattcttttccagctcgatgttacccagggggacttgttcttctggaactcgaagacatttctttaactgggatacgtggaacacgttgtgcacatctgcgagaccttcaggtaactcaagctggtaagccacttcgccacgtctggcggttataaggtaggggccgatgtagcggggtgctaacttgccggacatcccaaacctcctcataccacggagaggtgatacccgcaggtacacatgatctcctttttcgaactcaaggtcacgcctccgattgtcagcgtaattcttttggcggttctgcgctgtctttaaacgttctcggatcagcttaacttgttcttctgctgccttgagtatgtcaggaccgaataccagcgcttcgcccacctcattccagcacaagggggtgcggcactttcttccgaacattgcctcattcggcgacatctgaatactggcctggtaactgttgttgtatgagaactcagcatacggcaaacaacgatcccaagtgccttcgaaatccagggcacacgcacgtagcatgtcttctaggatttggtttaccctttcggtctgaccatcggtctgcggatggtaggctgtactaaaatttagatcggttccgagagcttcatgcaactgtttccagaaccttgaggtgaactgagtgcctcggtctgacacgatcttcttgggacagccaaatctacatacgacatgggtcatgtagagttctgctagtttctttccatcaaagatggttttcactggcacgaaatgagccgatttcgtgagtcgatccacgattacccagatggagtcgtacccgctaggggttcttggcaaaccggtgatgaaatacattccgatttcttcccatttccactcgggaattggtaggggctgtagcagaccagctggcctctggtgctctgccttgactctttggcaaatgtcacacaaggctacgtattctgcgacatctcgcttcattccagtccaccagaagtatgccttgatatcttggtacatcttcgtacttcctggatgaatggagtaggcggactcatgagcttcctttaggatgagatctcttaattccttcttggccggtacacagatgcgtggaccgcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacattagctttaccggggtggtaatgaattccaagatcgtaatccttgattagttccaaccatcttctctgcctcatatttaatttggtctgagtgaagatatacttaagacttttgtgatcagtgtatacttcacatctgttcccgattaaatagtgcctccagatcttaagagcatgaaacacggctgccaactcgagatcatgggtgggatagttgacttcatgaggcctgagctgcctgaatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgcagaccagtgaaacttcttttccttctttaacagctcggtcataggtctgactagcttagagaatccttcaatgaatcttcgataatatccagctaagccaaggaggctgcgaatctctaacacgttcttgggcgggttccaagcaagtacagcttcaaccttgctgggatctacatcgacaccgttggaggagatcacgtgtccaaggaatgcttctcggtctaaccagaattcgcatttcgagaatttagcgaatagttgatgatccctgagcttttccattattagcctcaggtgttcagcatgttcttcctcattcttggagtatatcaggatgtcatcgatgaacaccacgacaaactggtccagctattccataaagattttgttcattaagttcatgaagaatgctggggcattggtgagtccgaaggacatcactgtgaactcatatagaccataacgcgttgagaaagcagtcttcgggatatcttcagatctgattttcaattggtggtaacctgatcttaagtcaatctttgagaaaactcttgctcctttaagttgatcgaacaaatcgtcaatccgtggcaacgggtacttgttctttatagtcacttcattcagggctctatagtcgattatcattctctcagagccatccttcttcttaaccagaagcactggggctccccaaggggatgagctaggtcgcacataacctttactcttcaattcttcgatttgtcttttaacttctgctagctcattggctaccattcggtagggtctttttgcaattggtgcggtgcctggtgccagttctatggcgaactcaatctctcggtctggtggcatactcgttaattcttctggaaatacgtcgggatattcacagactacgggcaccgactccaaggaggtgacttgtaaacaggttaagatagaccgacttgcggtaggggtgttagaggtaaaacggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaagaatgggaagctcctgaatcaaacagaactattgcgggtacggagttgacagagaacatacccatcacaacgtctggagcatcctgagcggtctcagcttgaatgtggttcacccggcctcgaccaaagttgttggaagcacaagtaccttgtccacttgcctgagagctaggacgagactgagctgccgctggagtaggagttctggcagtgctgccattagcatgccgtgagctggtgttggtaggattctgagggcactgtctggcatagtggcccatctggttgcaccggaaacactgaacagctgacggtccttgcggtgacttgaaagaggtaacactgtttggcgcagtattgccactaggggcacgctgctgtggctgaggtgccggacggttcatttgaggacaaggggcgtagcctggctggcggttagcctgagtgaccgactggtggtattgcatgggttgaccgtagcgagggcgaggtgcgcctcgggaggaatttccctgatggttagacttgcgtttcttgtattcttcggtagcctcttttctggcatcctcaagtagaagtgccttgttgatcatatgttgaaaagtggggaagtcgtgagcaagcaactggagtctcattccaaccgcgattcctttcaagaatttcctgatcttcttcttatctgtgtccacttcctcaggggcgtaccgagccaacttgttgaacatacttaggtactcattgacactgctgttgccttgcttaagtctgttgaattcctctttcttcatgtcaatggtgctttcaggcacatgagctgcacggaaagccgtagcaaactcatcccaagcaatgttagtgggttcagggtatgcattacagtaattctcccaccaatctgcagtaggtcctcttagctggtgagaggcgtagagcgtcttctcaaccggagtacactgcaccaagttgagttttctatcaacatctttcagccaatcgtcagcctcgacgggctcgacggtctgagagaactctggcggacgagacctcagaaaatctgtcagcttggatctattattgcccatgtgagggtggccatttccatgcgcattgtgctgataaccggctacggctgcggctaatccttgcaagatttgtatctgaactgccattaagtgctgcatgttgttttccacatgaggtggggaagggaggcgttcttctccagaattgtgactggcagtgtggtgagagcggtgagactgttccatctctgcattacgggaagctgtgcgatgcgagcggttgctgcggcggggttgctcaacttctgcgttgcgggaagcagtgcggtgcgaacggttgctgtggtgagactgctcattagctgactcatgatttgcttctgtcacaactctaccttcttcaaaaccgaagcgggctggcgcacgggctgcacggggggggggggggggggggctagccatctaaactcccagaagagggcgaggtaagaatcaggtaagcacttaggagggcaaggagcaaagtaaatagcaactcagacagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctaacacacggacggctgttgaagactgcctcctctactcctcgtcagcctggctgcctcctgtagtcggctcctcagtcgaagaaacgtcgatcggctgacgcgaagggaccggcggaacctgtcgagggccggcagcagcacaggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaggggctaactgggtgtgggtagggggagtacactggtgagtacggcgcacgcgagctaggggagcgcgggccactgggagtgcgggcagagccgcgggagctgtgggaggacaggtggctggcgtgacagaggcggcctgagtcccaagagacagtgtcaactgaggtgacaccctcctcggccatatgggcctccagagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgcgtggccagaaggaaggcgtggaagctgccggaaggcggagcccccgagacggtggctgtagtcgtgggccaggcgacgaagcgcagtccaggagaggtcctggtacgcgatctggagagtgggcctggccacagtgaagtggtgtgggcgaaggccagctccgtgtatacctccacgggggtaaaggtacacagagagctcacagcgagggggaacacggtccacggagtaccccgtgtactcgggacacgagaagccaaggaaacgggcgaggtcacgaagctgagcgacgtggtgaccctcaccaaaaccgtgggagctgacgcttgcgttcactgccatctacaattttgaaagagggagaaaatattagtaaccattttagaaacaaactattggaaataaagaaaacaaaagaaaccttagcttttcgcaagtagttttgaacttagtatccttagggtcgtcctaaacgtcgggtttcgccctagggccaagcctgtgctctaataccatctcttgtcacgccccgaactagtaccgaccggaactagcccgtgacgctccaaattaacctgtaaattgataccagacccaggaaacagtgctggtatcataggaagacagattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcgtcagcgggatccgcttcatctcttcagcaactggggggggaattatttatatagagcaagggtgagtacaggagtactcagcatgccatgggaaataggtgtttattgcaggcttcaaggaaaggctgttgtttttgcaattgatttcatttgaactcttttctg

SEQ ID NO: 20797 - DNA, 668 bp, Oryza sativa
gataccataagtctttacggcagacttttgcccaaacatatctctaaagaaattacatagaatatcctaattaatagatacaattgccttcccaggactctatccatgcgtggcaatcatcttgaagcacatcaacttgaacccgatgacgtacaccgagtcatattatcggaatcggctgtatcggctaatcggctgtatcggctagccccgtccgactcgaactctgtcgacctaaccttagccgatttggactgcagccgattcttactctgtttccgcaacgatcttcatcttggattccacttcgatctgatcttcatctccgatgccaataatgatagaatttacgaaatttggttgttaacaagtatgcagatttctgaccagatcgtacccaaggtatgatagagatctaacattcttatattcatgtccttgagacaaattgttgcaacgagtgaatcattttctgctctatggaaatttgctcaaatccttcttatttgtctctctgctgtgcatatatagctcatgttactgccttgcttccaagatattgggttcaaatataagataacactaataggtatctgttgttccaaccatgcataatctcaatctgtttaactaatgcagactctgtttgcttttataatggtcatttt

SEQ ID NO: 20798 - DNA, 10989 bp, Oryza sativa
  unsure (1)..(10989): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnntgtaaggaaataatccatagatagcattctttgcatccgattccttatcaatcttctccaattctcctctctagataattcaagttggcgagctgatttaacttgccagctgccaacatgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccttattcctgcaagcaaatcgaagaaacaagcaagaacaagataaaagcaatctgaactgcaaataggaatgaatacacacgataagttggggtttcgaatacaagcagacggacggtctagccgacacgcgcgctgcaagcgaagtagcaatggctaaactttcatctaaacaaaacccaagaaactgtaaaggggtacctaactatttaaggaggtgggaggatgacctaaggggaccctagggtcgtgctccacccggttggggcgcaccccacatgggccggggtcccagacgaagttacaagcccataggcccattataggtgacacagcaccttgttgcttcaattgcggctcaataagatggaatttcgcaatgaggctggatccattggaaagaggactccaagagctttccatcaagtactcacgggccaaaaacggaggtcgtatgcagattcggcggccgtttgaagtcagcagtgtagtaggtggccgaatcggattccagcacttggaggacttgatcttgatatcttcttgttcatccatgatgtgagcaatggttgcatccgtggtagccatggtcacatcacaacaaatcagagaaaaatcaacacatgaacacatacatgaaagatcaataaattgatgcatcatatttacaagatcaattaaagcatcgtctaataggtggtatgacgctagcaccaagccaccaagcaccaccagatcaagatgttgcttgcgcttgatgttctattagtctcatgataaatttgtaattgtcaatagcagccgcgctaccaccaggattgctagatatacacatgcactagcacttgaggttctagttccaaaatccatggtagcacttgattgacacttggaacaaaggaaaatgcgctggtgaccgtgctgtgcctagcgacggaggtgctatgtgggggcggcggaggtgctgagcgctagctggtgcacccattagcttgcgccagcgcgctctgcttcactgcggccgagtgtgatgcggttgtttcggtggatacgtgcgggatacgtatccgtatccgttcgcgcatccgatacagatacgtggcttctctgccgtatccaggtaacgtaggccacagcatctatggcaggtggatcatcaaggtaatcatcttcaaccatctcatcgtctagtggccatcttgtagcatcggcggcggcggcggcagaaacaacagctgctgatgcgtccacctcgtagaagtcgatggccgcgtgagtgcccaggaggaggtcgttgttgtcgaagtgggccgcgtggtatgccggtctatgttgcttgtgcggctgcggcgccagcgcgaaggtctcggcgtgcacacgctcgtgctccccaccggcgatgccgtgtcgggtgtcggcccaaacttgtcgtacaccgtggtcgatgtcgttgaggccaacgagtccggccgggcacattgtgcgagcgcggcaatagtggcctcctagtgggtgggggttgcagggagagtctggcgaggttcttgcgctactccctccgtcctagaatataagaatttttagagttggacacggttatatgaaaatatatagaattaaatagtagagggttgtgatttgatgtgaattgaaggtaggtgagaaaattgaatggtggaaggttgtgattggttgagaagaaaatattggtgtagaagttgttatattttgcgacaaattctagaggctagaagtagttatattttgggacggagggagtacttattacgtgtagtctacaaaagtaacttaaattttaccataattattgtttagaacgtggttttgggctggaagagagcaagtatgttacggaggacattcttctctcaaaatagtctttaacagacaaaaaagtgacccgcgaatcatcaggggactactatttttccccttttttctttctccaaaacattgatccggtgacaactactttttttcaaaaaaaaaaacatagatttatcctgttaaatcaaagatgttgtagcagtctctaatcagaagaaaatagaaggctaaccacatacaaatggggcacatacaaatggggcacatatgcagcagttgagatggtcatgacaatctcatctattgtggaagctcatcgacgacgtatggtcgacgtcgccttctcccttgacataggtaggaggcacacatccgtccctatggcattccatcgtggtcggtgttgttgaggccaacgtgtctagccgtgcacattgtgcgagcgcgtcaatggcggcctccccagtgggtgggggttgcggggagagtcgagcaccagatggggttggagggggaagaagtcatagtgtgcgtcctctgcctcgtggttgatcgcctcctcctggatctgtccaacgaatgccatgaaggccctaccgaagaactgcatacaagctatgtggctttccatttgggaaatgggtatctcgcaggcactccggtgaacaaacaagcgtagcgtccaagcgctgatgcgcgcggggcacgcctgatattggcgctcctgctcctgctccttgaatgtcacctggcggacgccgacgcccttagcctcgaggatgctcttcttggcggcgaggttcttgcacatctccagtttttgacgcagcttggagagcttggcaagctcgcgctcgaccttgcgttctaggtgccacatgacgccggtggcgccggactggggattccttgcccacacttgggcctcgtatttgattgaactcatcaaatcatctcgtttctccggtagagttgcttggacaaaacggcggatattgcgggtgccgaagaggcgctgcgcgttgaggagccgtaccttctcgtccccatgaagtatgacgcgagcaggcactccagcgagcaccccatcttttgctccctgcaggtggcgcatcgcggcctctgctgctgcggcgggaacggaggcggcggcagtggagatgacttgggcgcaagggacggatcgtccaccattgtcgccgatgtcgactgcgatttgggcaattacgggagtggccggcggcgagggaatggaaggcaaggtcagcgggtgttggtgtgggctcgccgatggcaaggggatggaaagagaggtcagtgggtgtgggcgtgggatcaccggaagtgaggggagggaaggggaggtgagagaagtcgaagtcggtgggcgtgggtgactcggcgtggccacgtgggctcgccggctgaggtgaccagggcaattcatatacaaagagtgaagagctctctccgagttgacaagtcagaccacttacgccaccgacatgtgggcccaagttgtagtgttgtccatgaaaatttgtgcagctggctgttcaccttgtctatttccacatgtctctctccctatccctcaacattttccagcttctcgtcgcaatcgcaattcacaaccacctccaaaatcacacgaaccccaaggccaaaagaggtttttccttgtgtgccattaagaaagatggtgtctgcctctgtgcgactaaaaagttcgagcctccctctctacccacgtcaaactttatcgcgccctccacaccattcggttgctattttgtttgggtttaaccgtttggcagctctgacatgtgggcctgggcagaaaaaatgtcgctcttgccctttcagtcgctggcatattggagacccctgagcgggccctacctactgtactctcaccactactacagaaatggtttttccgtacgatggggtgatttggttccatgcgggtgacttgtgtccgtgcctgcaaaaatccctgccggggggcgggtcgacgagccgtatgcgaagatgcattatcgcatgcgactgcttagatcggccgcatgcgaagatcgattttcgcatgcagccgtcttaagtgaccacatgcgaagatcgattttcgcatgtggctaggccggccgcatgcgctaatgttgatctttgcagacgatttcgcgcatgcgggccagccaaccgcatgtggagatagattccagccgtctgcaaaaaccttttctgtagtagtgcacctctctctctctcccttcttcccgtcttcctctctctctcgtgagcgcaatcaggagcggcggtggccggcagccggcggcgggcacggcaagggcgcggcgggcgtggcgaggttgtgtgggcgtgtcgaaggatcccaatggcacgctcttgacgtggagggaagccgacaacgacccctgcggctggtccagcgtcacctgcaccgacgacggcgacggcagggtcgcctgccggcgtggtgctcgccaactcctcacttgcgggctacctcccatccgagctgtcattgcccaacaaccagctcgccgaccagatcccggtcgccatcacagcgttgcagaagctcgcggcgctcgcctggctcacaacctcctctccggccagatttcggcggggattgggcagcggtggaggtgtggttggagatctcggaggaggggtcgagcacggtgatgcacatcgctgcctgcgaggggcatgccgagatcgtcgagctgctgctccagcgcggggtggatgctgtcgctgccggcgagatcgccatggctgctcgctcgctcggtcgacgcccgcctccctgccacgcaagccgcgccctcaccacgcccgccgccggccaccgcctgcctcccggccactgccgctcccgactgcgcccacaagagagagaggaagaggggaaagagagagagagagaggtgatagagtatgagaggtgggagaagaggcagacaagcacgcgacgcaagcgagacagtgcaacgcaagcaagcaacaagcagctagctagctagcgcgcgccgcggcaatggcgagatcgtgggcgaggagtactgcgccgcggaggagcgggtgctcgatcacggtgagcaagacctcccacttctcccccggcgacggcttcgcggcctacgaccaccgcaccggccttcaggcagtcgagctaaggtccatctcaccacgccgtgggcgcctgcgcacggggtcggcgggccacgcgtcggcctcgtaagcgacctcgccggccgggctgacctcctccgcgcgccaccagggaccggaagacccccgcgcgccgacgaggaggcacgcgtaccggtagcgcacggcgggtgatcagtcatcaaccaatatatatatatatatataagtataattgccgccgatccaattaagccgatgagatctcgatcgagattggaatttcggcgcgctgcgaggctaggctaggctggtcgatcgatcggctcgctccggtggcacatgagcaaaatacacagagagatgcatggagctctggccgaaatatgcggccgcgtaagggcacctgcgttggattccgaatagggcgacgacgtacgtacggatcgttcgagtctcggattctctcttattaattcgtctcgagctctccatctctctcgtatcgtagcagtggccggcattgcaaaatccaccgcaatattgcagttgcagtaaccctgttcacatgttccgtccagctgcatactattaccagctagctagataaatcaacctcttctttcaattttgttgctatatcgtatatacggaagaacagttgatgctatcgagatcgatcggcagcaaattgctcgagtcttttttttttctgaaactaaatcggcagacagtggctgccaattatatttttaataagcaggaataaaaactcaaacgggttacgataaagaaaaagcatcgtgccgagaaagtattgccaagctccccaaaaataaatactaccgttgtcgaccgaacaaattcacagcacgtacaacaactcaacgctacaacccactcatagtagaccactgatggagcccaaatgcaagtcatcagtgccaaagcttgcacaaaagcgatagcaggtccgactttcatattgaaagcatgtcatcgttgttaagcttgcaaaagcaaagcacctccgacttcaccacaaacttgtatcgttgttgtcgagctcatcatagaaacgaccaagcagctccgacttcccacggcggacatcagccaaaaccatcatattaccacttcctgcttattgctagcaccagcacacctagaaagagactgcaccgtgttaccgttgctgaggttcatcgcgcctcaacaataaagcaacttcgacaccaccttgcaaactgaaacaaaggcattggctgccagccgcaagcaagaagcggatccaggaaagcgaaggcctcgccgaacatttcgggcctatttagcgttggtgtggaagtagaaatccctagagctaacgccaactccacgaccagagatgcgcatgaaaaggttctccaaacggtacccacagcagggacgcgacgtgaatcgtcgctgccgttcacctggaaactggggcaaggctttcacctggagcacaatggtgaaagaataagagggaacacaccataacgatgtctccaaggagagggacggtgccaaagggtgtccccatcgtcaagccggccaaaaggcacggcaagactttcgcctacagttccctgtccgctcctacacacctaaccaatccgcacacacgactgttgcaagaatgccgcactagccctgactaaccgaccctccggcgagcaagaacctcggagctccccgcgggcacggcctcaccgaaggcgcaactatcaaaccacctccaccacacaccaacacgcacggtccccgagagccgccgacctcaccaacgccgttcccagccgtgagggcgatctgggtaccggcgccacatgaccaccacggctccttgcccgacaaccgccagcctcaccgtcggccgcaccggccagccgcgccatcgcccgcgtcttctgccgccattagctcgctgaccagatccggcggcgacgggtcggttccagccgcaagggaggggccgagtggggggggggttggatccggtggcggcgaggcgggggagaggaggggagggttcgcccgcacctggctacgacgataggtgcattgtgatggttcaatttgaagattgccgacgccctagtaatttactattaatgcaatctggagataacctacaataaactaaactctgaattcaggggctacttgctactaatgctgaaacaagagactactttaacgacgcactagtaatctatttccaaaacataggagccaaactgtatttccaaaacctaggagccacactgttaatgcaatctggacataaacctacaataaactaaactctgatgaattcagaggctaataattgtagcagcacgtctgaatacaagattgtcttcgttggcacaacgccagcgaaacatcaaacatctgatcagatcaaagcgcggtcctcctgacgccgctccgtagacgacaccgcagcatccatggcagaagtagttaagggctcgagctcgatcgagtgcgtcgggtgccggcggcggcggctgggcgtattggcggtgccgcgcgagcgcgctctgcgcggttgcgagttcggccttcaggcagtcgagctcccgctcgaggtccatcaccacgccgtgggcgccgcgcacggggtcgtcggcccgcgcgtcggcctcgtaggcgacggacaccgcggcgtcgcgccgtttccccgggtccccgccggccgccagcaggaagccgacgacgttgccgacgccgaagaggcggaacgcgttccggaatagccggccgtccgctggctggtccccggccgccgggaagcagcgcgccagcgggcatcccgtcgggcacgcgcgccccaggtgggcgcacgcggcgcacgccgccggtgggtcgtcgtcgtcggccactgcgaccggcgagatgtcggcgacgaacgggcgccaaggttgggccatggagatcggcggcgagacgagagctgggtctccgtcggattggtaagttggggcaccggaacggagagttcgcggcgaaatatgcggccgcgtgcacctgcatgcgtcgggatatatatacagataacacaggacgtgcttgaggtgaatttgggccaaattaaatggagaaatttaatgggatcgatttttttttttacacatacaaggccgcacccgttatttgtataacttagctatatagaatttttttaaaaaaatggtaaattgattgggacaggattaataagtccattctggtgaaattaagatacatatgttatcttgatttggatatttttcaaactactaaatgatatattttgtgtgaaaattatatatatgtattaaagttgatttaaaatataaaataaatctaatttttaagtttatagtaattaaaactaaattaatgttaatggttttcttgttttttgtgccctagcttaatctttgtctaatcaacttcaaacggggtaaacatgaaggataaattcagtctacaatgaaaggaacaaaaataataaaaccaagcaacaaaaataataatagtactgtgcatgcacacaaatagaatttattttttaatgtcgattaaatttttatttgttgtttttatgtagattaaatttatattaatttgcatgtttgtataatagtgattttggatctgtcataatttatatcagcattgcgtaatgttgatgtggatcggagtagagttagcgcaaaactctcacaaccctaataccctaaaataaaacaaaaatccgtacaacatcaaaattctgcctctatattttacgctacataagacttgccattaacctgagtcaagttattcactgtttcagtgtttcatccccaatcggccggtacttttacatattttcccattataaagggtaattataagctgtgtttccttgatggcgtcaacaacggtcagcactcctccactgctccacaaggagtcaagcaacgcaaggaccgcaacctgcattcggtgaatactgatcagcaatatatgtcggccttattcattattattatttgttcaactttttttttaaaaaaatatttttttcaaaaaactttgttctactgtattttaaccacttattttaagctatttattaattatattatatatcaatatttagtttatgatatacttaataatctaaaccaaacatgttgtcaataacaaagtataaagaataaagaaaaatgtggaactatgcgggaattaacacacaactttggtgcgacaagccaacaaataaaaaaatgaaggtacaaaactaaacattagagatatgaaaccattttttttcttgaataatttggacaccactgcataacaattatcattacaaattttcctaaaagaaagggatcagaggcggctgtggcaattcggctggtaaaccgatcgagtagactggtgtttgctaattacgcgtgggtctacaaaagtaacttaaaatttcaccacaattattgtttagaacatagattttgagcatatatatgaaaataataaatttgatttgttaaaataaaaaaattttacttattttggatttatgtaaaaggattttaggtggtcaagcttgttgacttaaaaaaaagtctaaagacgaccgcttttatgactagcaagagagcaagtgtgttactaataaaggatattctcgtttgaaaatatagactttgacataagagatgacccgtgaactatccggtgactacttttttttctccaaaacatagattcggtccggcgactactctttttttgtcagaacatggatccggcgacgactacttattttttttaaaaaaaaacatagagctatcttgctaaatcaaagatgttgtagcagtctaataaaaaaatagaaggctaatcacatacaaatggggcaaatatgcagcagttgagaccggtcgtgacaatctcatctatcgcggaagcttatcgacgaggtatggtcgacgttgccttcttccttgacgttggcaggaggcgcatgtccgtccccatggcgttccggcgccgtcgacgtcgccgcagcagcatctacggcgggtggatcaacgaggtaatcatcttcaaccgtctcgtcgtcgcagtggccatcttgtagcatcatcgtcggcggtggcggcggcagaaacagcagctgctgctgcccctgtggcggtggcggcggcgaggggaggaagcccccattggaggcgacggcgacgggcggctgctgttgctgctgggccgcggcacggcgatggagctcgatcagccccttcaccgcgtcgagctcggccttcaagcgggcgagctcctggctgaggcccttgacgatgccggcggcgccgccgagggggtcgatcacccacgcgtcggactcgtagacgaccgacttcatggcgtcgtcgcgcagctcctccgacgccgaggccatgaccctgaggatgttcttgatgccgaacaggcggtgcgcgttccggaaccgcgccggctggttggccgggaagtagcgcgccagccggcactccggcgtgcacct

SEQ ID NO: 20799 - DNA, 5959 bp, Oryza sativa
  unsure (1)..(5959): unsure at all n locations
tgggggcgtggtgctggtgttgaaggtgggggaggagtgtccgnacgaggacggcccggcctcctcgtcgcccatggcaatcgccccgtgtgtcgcggtggatatttgatgaggacgcggctgcggcggcgtagggttggttgcatgccttccgatttgcacgggatgtttttggttagtgatcaaacggccggagagcgagatacgccgtcgcaacgacgaaccctagctagctagagttcagtgttttgggcctttagcccgtaggctcttgaacgaaacagaggttggagatggcgtataggtatagttggccataaggcccgaggcccgaaggcccagcccatggcacgcctttttggcccggcccaagcacggcacggcccgacttgggtcgggcccgtgctggcccggcccgaccgtcgggccgtgcctgggcctccccaccggcacgctgggctggcccggcacgatgggccgacaggccaggcccggtacataaagtatagggactaaaaatagacatataaatgtaacagtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggctcggcaaggcccgaggcgtgttgggccgtgcctgggccgtgagtgcggcacgtgggctggcacggcacggcccggtgcgtcggtcgggccgtgccggcccgacaagcctcggcccaggcacggccgggcctgggccgtgccgtgccgtgccgggcggcccacatggccaactatacgtataggctcattcttgaatgaagtctctttattatcttattatggctaaagtatcgtgaatgcccgaattataaatcggggcagcctaggctggggcgcccgatcaattcggagtaaaatcgggcgctgacgttagcgtccgatttacgtgcaaaactattttaaactgatttttctcttaaattacttatcaaaatcataatccgattgtaccattaaattcgttataattaaatcttcaaaacaagaccatatatggatatattccgatgaaaaaaaatattagcttattattgaattattttttagtgttgtacgatgttccactagttatatcggaattgtttcactaagtagatcgaaaatatttcactcgtttaaatcaggtgttgtttcaccttatataaaaacaatgtttcggcaaatagcgaaagaatgtttcagttcactgcaacatttgatccacacatagtgaaacatttttcggtggaacaaaaaataaaacgaattcccttaatagagggtttccaaaatatgttggtttttttgttgcaatggaatatttcagttcactgcaacattaaatctatacatagtgaaacattgtgagtgcactaggtgaaacattttttgtggaacaaaaataaaccaaatttacttaatagagagtttccaaaatatgtggttgatttgttgcaggggaccggcactgttgtaacataccgaaaattaaccattttctaactctgcaccatgctgagtcttatgttcttaataacttcttaaacctaggaaaatataattagagggaccttctaaaactaacttgcataaaatccttctctggtattcaatttcttttgtgtttttcatttaaaaatatatttggttaaattgaggtatttcttgatttggttttaatttaaaaccttccttcgactaaaattcttttattcaaatttagtttcaaaacccttactattttttatggattatgatccaagaaaccttcccaattttgccattgaacctaaaccaaagtaattctaattttatcgggattatttgttagcccatcctttgaccttaaacatatcctttgattcttgatccaaattcttccttttgatctagccggtgatctaatttctgtggcttgatttccttctcggcacaagaataatattattacaaacattgtgaataattgctcttgtgctaagataatatattatatccttgtcatccaaatcttctttaaattcaaattctatccaaatatcctattagcctcagacaattctttgaaacccatgccatatattttgaggctaaaaatcctatctatcttcctccatttatttcctctccctctcatttgagtgcatcaaataaattccgttatattctatctctcaaaatattgcactcaaactagaaaatatctcttttggaaattatatccaaatataatttcctttcaaaattccctattcagattccttccaaatactaatctcatccaatttctatcatacaaataacctacaaaatttagaattgatttctaaatttaattgggctaaaatccctttatctcttccttttggcccatcttcctcttcggcccagcccagccgagccgccccttcctcctccgtgggcgcttccaggcgccgccatgcgcccgctactgccgccgtgcacaactcagctaccgccgccgccatattgccttcgacgccaagcaatcgccgccaacgtcctgtcgtcgccgctaaggcatcgccgccgacgtcatctgccacctcacgccgccgacgtcagcctctggagcaaaccgacatctccaaccaatcacaagccacagccggcgccgtcgccttccttctccacgtcgccgccaccaagaccaactccatcttctcctctacaaccgaccttcacaaccgacgtctgaggcctataaatagaaggccagccctccccttttctccacatatgagccgagctcctcgagctctctctctcctgttatgtctagccaccaccggccactgccgatctccctcaccggagtgtttctggccaagcccttgcgccatcgggtttgcctcgacgaggcgaactcattttcctagtttccccttcctttccccttccgaaaccaaccatcacagccacctcctcttgttgccggagcaagctcttgccttcgccgttccggtctcctccctaaccctctctaccggaaaccaccctccctgagtgcgcgttgctcgggaacgcgtgttgccgccggcgtcacagtcttctatccaccggagagccggcgcccctcctctcccttctctctgtttgttcgtggagaaagagagaagaagcaggaaagaagaagaagaagaaaaagagagaaaaagaaaaagtctgacaggtgggcccctgtacagtactactttatattttctagatttaacttgaatcctattctttagaagcccatatctcctaaaccgtagatctgattctagtcaaacttggacctaaattcatctaaattcaaaccctaccttttgataccaaatttgctatttaaatattttatttgaatttccttgatttatttaaatgtcatatgcttttcaaatatctccttttactccaaaataccctttagccagtaaaaagccgccggttggaactttacgcctttcatggagacgtttgcggtctatcggccccgatgtcgaaccgttggtcgtaaagcccggcaaaacccaaacccaaggtcaaagtgctgctccgggtaccccacgcctcaatgcgtacaactgtcggagcttcactattccctcgacctccacagcacgtcgcacaattagctctcgggctctgtgtgatcttagctgctcagccgccactcacggttgtcggagtaacacttccgccccactaaattaacctgcacccacatcttattcctctagccgatatgctgtctgctgacaccggcgagagaagacaccaaatctagtcgttatgctgttcaacactagcatcgactagcacacaaccaaaccctagctgacaccttgctagttaaatcccagttgtcatccaaattccacacccaccagtatcgcctatccaccctactctcagtcacctactctctaactacctagaacctatacataaaatatagagcctagccaatatgctgtcctatccccaatcggcctaaatataaccaaaccctagatatatactacctaaacctgccaccaaccaatattagctacatactcgcttaaccagtcatatctcttactctccgaacaaccaagacccacacatgaaatataagtgacatttgttgcttgatcccctttctatcttagcctccaaccctttagaacccagaaatattagccaataatccctataccttttaaaggagatatttataccccaaacccagcctttctcgccctttatcgctttcttattattttgtgacttttattgaatttggttctttctcttctacgtagagtctgttatattttggatggcaacctgtggtatttcaaggatcggataatcaggttgcctatctcggatttatttgcgttggagcaaggcaagttattattcctctcctttgagcataataatcctatattctatatctccagtatcttgtgcattagccatacatgattttgaatgcataacctgaatatatagcaaaccagatatatgctagattttgcttagccatgcctagttagattgcataaaatataataaacttagattggaacagtactgtagaaatggttgatttccgggtggctagtactgttccaaccgacataaaattgccaagtacatgtgaagaacatacgagtacgaccgcaattctcgtatgggcatagacctagctgattaagttatctagcaaatgtggtacctttgtatagtggttcttcttaagtcctcgcgcaggaagcaaacttacgctgagcagggcgattgcaatatttaccgaggcgcaggtaaatatttgagataaattgtgatatcacaaactgtgtgtgtattgtgaaaacctggttgagatgacgggggtctctcaaccagttctcttcaaaaacctcgggaacgccagaattcctctcgctgctgataacgctacgttcagagcgcatggggactagagttcatggaacaggtaccactgatgttagtaaccgaaaagctttgccatgacaaggctaatgtgtttggcacgtcatggattgcgggtaaagcgtacatttactgcagtaaagtataaatgaatctattcgaatagccgtgctcacggatttgagcattgggactcatatggtatttggttagaaacttaattccaaactttattaaatattgttgcatttaaaacattctaggctttattcctctatattctttgatttctgcaagtaaacctagatctactcagatattaccatttcatgcattcattattgaatataatagcttgctgagtacgttgtactcacccttgcttcaaccccctttttcagagtccaattgatgttcttaccgaagctgggagttcaatcatataagttagttccattctaacttaatcctcaagtatagactagataaatggtttaagtctatagcaaaatagtagagttgagtcattctatagcttctgttgtattaattagccacaaatttgtaaacacccataaatattttgtaataacatatccttcggagtcatgtttaaatgtatgcaatgaggatccaaattgttaaacctgtatcaatctactgatccaaggcttgatacagttttaatatgtcggtttccaaatcattagttttgggacccgacaactgtggtgggccagacactgtggtgggccagcggcatgcaggcgcacggccgcgcgctgggagcggggccggggggagcgcccaattttgctccccccgcctggtcgcccggatagcagaatccccttataaatcacaacttata

SEQ ID NO: 20800 - DNA, 829 bp, Oryza sativa
aaaatctatatagaaaatgactgatcagttcattcatcatactcctatatccctatatagagttcatatattactcccaaaaaggaatgcatcacatcacattattggaatgcaactgagagggtgatatataattgtaagttttctagtgaagtgcaattgaaaaataagaagaaatatattactagagtatacaaaaaagagatgatgggtgcatgtattattattgattgtcacatagctttagtttttccttcacctgatccgtgcttagcttatacagttctctcctcctaccaaacgaacaaaaaattacaaactccctgactgattgcctgcagtaccgtatcatatccatccatccatgccttcgccatggctgcttttacttgcttgcttagcttccaagatcatgagattatatcataaacacaagatgtttaaaaaggagaggagaaatatgagagagatttacccatttcaaaaaaggcatctttgcactagagtagtatagcaaaagcagtgatggcctgaccctagctaagagcaaggcaatggtggtggtggcaagtgtgatgcatggctagctgatgagaggaggaagaagaaatggctatggctaaagtagcttagcttagctatggctgcccatgccatgccatggctcgttgctgccgccttgctgttgctgctgctgctgctggtgctggtgctgtggctgtccatggtgcggtggtggtggctcgtagccggccatgccggcggcggcgttcacgtggcccatgcacgacgagtcgaagccggcgaggaggatgtcgcggtgggagaa

SEQ ID NO: 20801 - DNA, 5594 bp, Oryza sativa
attcctgcagccccagagcggctgcagcagcgggtggtggtggtcgtagggcatcgtcgtcggccacggcgccatctccggcttcacggcgtacccgcagttctgctgcaccagctgctgccgctgctgctgctgctgctgatgctggtgcggcgactgcatgacatcctggtgatgctgctgctgctgctgctcctgcagcgcggcgagctcctggtggtgcgccatgaccggcggcggcgagaagagcagctggtggtggtggtggtggtggtggtggtggtgccccggcgcggccatggcggcggggatgccgccgatggccttggcgctctcctcggtgagcgcgtcgcagaacgcccggtgcgtgatgaagctgtcacgcctgcatgcaatgcaagaaccgaaagacacacacatcaaaaaccacacggatcacaccaaaaccaaaaaacatcaaatttcaaaaggccaaaagccaaagatatcatatttcccccgtattcttgctcacttgtcattgttgcttctacactcctactacacctatagccatctcaaaaaaaaaaaggatagagagagatgctcaagctagaatgaactccatggaagtgacaacacagagagatagccatgcatgaacactcttgcagagtagagtggagtaggcaattaggcaggaggaatagtggctaggatgaacagcataggcaaagcctgggagagagagggagagagagagagatggaaaagccatccatccatccatgcaggagcaggatgcagacgactgcaaagagattcacatgtctctctttcttcctcctcctcctctctttcttcctccatggctcagcatcatcagctgccaccacagctagctagccatagctcatcatcatcaagctcagatctcccctccttcctttgtcctatgggcaaatagctttgctgcttgtttgtttcccaatctctcatttctctctctcatcacacggacgcaatgcaaacagacacgcgcatacgcacaagccagtagtactaccaccaacctagctaccactagtagcgtcgtcgtcatcgtcgtcgtcgtctccatcgggtcctgcaccgtgcgcattcatcagcccggatcaatccaaaggaggtttcagccatggatggcagtggcagcacaagccaagaaacaaaaagaagaagaggcaagaaacgactccaatctcgatctcgatgtcgatgtcgatcgatcgatatggcttcttttctttgcttgtttcgctgctgcagcgagcagctagctaagctacgtactagttgccactgttcacaaatcttttcggctagatgctcgcggcagggatgggcacatggttgttgctggttaatcaacaaccggtatatctatcgctgccctaattattggatgattacaggtgtgttaacactaacaaacgctcatcttataggctgcttcgattcctactcgtcactgtgccaactgaaagcgcaggcggcagcgagaacactggattactggcaaagtggcaatgagaaaggagcacggcaagccagccaaggcaggtatatctgagcagaaggcagtaggagtgcaagtgctgcaatcgatcgccatggatggatggaagcaagcaagatggaggaggagggaggaagaagaaggacctggagaagatggtgccgcaatcgcacttgtactcgcgggtgccgcagatcttggagtgggccttccagtcggagtggacggcgtacttcttggagcacttgtcgcacttccacttcttctcgccgtgcttgcggaagaagtgcttcttgatgccggtgaggtcgccgagggcgcgggaggggtcgtggtggacgcagctggcctccgggcagatgtacaccttcttcctcaccgcctccttgctcccccgctgcttcagcttccacggcaggttgtgcccccgccggtgcagctgcaggttctggtccctctggaaccccttcccgcagatctcgcacacgaacctgttcgtcgccatcagcgtcgccggcgacagcgccaccacctccgcttccgggtctatatataggttcgatcaattgctttcgcttaattgccgagaaaattaacggagcccggatcgatcgaggagctagctatacaagaacgcacctgggttgcccgggaggctgcgcttcctcttgttgctgttgttgccgttgttgccggaggatggcggcggcggcggcggcacggtggaggcggaggaggtcaggttggacatgctgctctcctgctgctgatctgctgcctcggcggcctcttccaccaagaacaatcctcctccctcctcctcctcctgctgctgctgctgctgaagatggtgatgaaacataggagcttcgatcttttcttgctacatagcatgcagcatctgcctcaccatggaagcaatgaattttgggaggctcaagtgaagtgatgaagaggatgcattaaaactgaagaatggaggcaggagacaggagggcatgtaggatgaagggagttcagagaatctcaaggaaggaacaaacaagaaggaggaggggagggggggacaaacaaggaggaaactagggtggtcaatgactctaaagcaattttcagattcttctttctttcccttcctcctcctccttctcctctctctctctacagtctacacacactcagagcagaagcagcagcatcaccaagtgtagaacacaacaaggatgctcaagagaagagagagagagaagcaagcagctggaagctagctagccaggcaagcagcagccatgagagagagggagagagagagatcaaaggattgggggagaggagcagtagcagtgtgttgcttggcaggcagcagctgaagtagccagaggggagagtggagaagcaaagctgagcaaatggaagaagagaagggcaccaaaaaccaaatcccttttcttcttcctcctctttatctgctcctgcctgctgatcctatactttactttcagggccctgtgtgagccagctaaaaagattaaaaagatttgtagagcagttcagactttcttcagactagcttcttcacttttcttgcttgcagaagaaacaaaaattgaacccctttttttttcacttgagtaattaccacagtgccaatagcttttttactacatgtgctctcactggttaattttgatcagtaagccaaggggttgtttatatcaatcttgaatagatatttcaattttaaaaaaaatcaagtcttgagaatgcatgactagtgtacatatcacaatatcacagtgagtgaactgttttatgcattctcaaggaagctgcatctgcatgaggcaagaacagtgtactggtagtagatgaaccagcactagctatagctagtagaattgtgtactacagagtagagatgaggagcaactgtttgggtttgtgcctgaatcacaaaatcacacaacactcctaacaatgctacactgatgttgagcttttctgtcttttcccttgtctccttacaagtgcagataccgtccgtccctgatgatcaactcttgcatttcttctttctttttatttatctaacctgttgtacacctacttggttggtacaccagagataagtatgcatcaatggaacaataagctagacaggtagattccaattttatcacatttgttttataaattccagggcctgcactcaatgtatatgatagcaacaatacatatgatatataatagtactcatacatgtacacaccaaccataatgctaattcacattcatgcatatgccaatatatttttttgtacattgccatgtgtgatttatcattcttatttttttcccatcctctctctctctctctctctctctctctctcttttgatgagtcaccctgggccccatgcatatcatggatggtcgtaattcaaaaatagtagaaatcctatcctgtcatggaccagttatttgtccatgggattatatcttcagagttgctttggttttgcaagacccacagctgatcttgctgcagtagtactatcagtttttaattaattagtagtttatttctttgtcatttgttcatgaaagatggagcattaaataaacactcctttttctcttttgttctcttgaggtggaagtacatcatagaatgatgagtttccaattgacctgatgagggggagaaagagaacctagggaagttcaaggattgtctgtgcatgggaatttaatgcgacctaattaagcaagcaaatgtgctcatctgatacatccatcccagctactactaggccctatttgaaagattagcccagagctaatgtttagttatgaattggtaagctaaacattagtctagaatggcatgtttggatccatgggctaattcaatgctaaaaggtggagagagagagagagtagaaagagaggagagagatagctgcttttttatggtccccacagaaaattagtctcattaacacctcctttgaggggctaatgttttgagggggaataattcactttggttccaaattagcccacatatttagatctttgggagctaatttagggctaaaaggtgggggctaataattagcccatgaaaccaaagaaggccctagctaatactccagtatcagccatgtttaacagaactcgagattctgataagtgtagaatatgaaaaaactaggtaccaaacttctagtttcttttatcattctctatatgttacaactagattttttaaaatctatgtgaaaatatagggtctaatggtaagagctttaaattctgagaaacagttagtgagaatccaaccggtgagaatctaaaaaagctaagaaaaccagcttgacttctagttaactttctaaattgtatgactacaacttttcgaaattatgaaaaaagatacagctgctaaaaactctctaatcaagcctattgactgttttgggagccagagattatgaaggaaagctacagcaaacagctgccagaaactctccaaacataagcttggtagcattagacaaaatagaaagattaattaaagcaatgattattgaggcttaactaagtgatgggtgttgcttgttcacaaggcaagtaacagtggcagtgcacagcaacagtgctagtactatactactgtactactagtaggagtagtagctggtaggatgagtaaccagatgggtgagtagtagaagtaggatgcagcaagctatacactgcacactgcactagggtgtttggcaatggcatcaaggattttggtagtactgctcctctcaaaaagatggagacgtattttccaaagttagctggtgactgcagcctaggagcttcatgtgacactcaaaagcatgcatactcttgtgcttgtgttgtgtagggtgccaccagcccaggtgtactttttactgcaggtaaaaaaacactttgcaggaacagaatcaagaaagagaattttgctattaatgtacagtgatgacactactaatcctgtaagattagtggtgagtac

SEQ ID NO: 20802 - DNA, 3645 bp, Oryza sativa
ccttaaaaatcatgctttgtgatctgatggtttgatcccctagactagagaacctccaaaagattcatggacatgcataagattgagactgaagcatttcgacagccccaagaagacatttgggaggcatcttaaagcttataggagcataaaaaagaatgatgtagggtctctggttaaaaaaaggatttggacatttgacagtccaatgcaaagcatgcacatgcaaccactggcttaaacatttttagggtctctggtgggggtcaccacatatcacaatgtgaagaatgagagggtggggcccacaatgtcagctatagttttcacctgaaagagataaaaaaaaaagttaccaagcctcttttttttatgcatgttgttgcatgctactgtttttagggtggtgccagttatgtgatgcaacatgctccattgaacagtgtagtaggagtatatttttgcgcacactttttttttagatatggtgcatttatgtgtagatggggaatcttgacagaagcaaatactaggctacatgggcctacagtacgtagtgcaccgagtggagaaatggagtgtatttttcacaaaaatattaggggtgtttagattagggttgtaaagttttagcgtgtcacatcgggtattatatagaatgttgtatggtatgttcgggcactaataaaaaaactaattacagaatccaactacgagacaaatttgttaagcctaattaatccatcattaataaatgtttactgtaacaccatattgtcaaatcatggagaaattaggcttaaaagattcgtctcgtaaattagtcgtgatctatataattagttattttttagcctatatttaatacttcatacaggtgttcaaacgttcgatgtgatatgctataaaattttagggtgggatctaaaatttagtagtcgtttttgcgtcaactcagatgttccttttttttcatagtttctagtatcattgttttgggagttccaacgataaactttcgtccatcactgacgcgccgagattgtgagtgaagaacatagggggcgggtaagaagattcagtctaattgtctcgtgacctgaaacttgtaattgcacaagtatttagaactttaacatagagaaaataataataataaatcttccaacctctgcacaatttctatatgcgggggcggagccagccagaagctaagcctatggctcaactttgttattttatcctaattccttataaatttatgactagatttcacaaaactatatatatacttcaaccaaactatcataaaactacagatttaaggtgatgtgtcgaaaaactacatattcagtgctgaagttacgaaataactacaaatttaagatggaagatcaaaaaacaatatgttttgtacaaagttaagtgcataactacaacatttgtaactctcaacatgatagtagtggcatctgtgttttgtgataactccaatactcaagctgtagttttttatacttggccttaaatgtatggtttggtgataaatcttatattaaatatgtagttttatgatacaacactttaaatctatagtgttgtgataatttagtcaaagtaccaatagttttgtaaaatttactctaaatttatatgctcctataaaatttatatgaaatttacatagagtttgattcctagggctagggcttaagcctttatatgaaatttatagcctgaattcgcccatgtttatatgcatgggccaattctattttttagataagtcgtaaaaacaatatatattaggttattaccaattataattcctcttatgtaatcaaatgtttccgctacttaaaaaaacattttcacaggtgggtaaaatccgtttgcagaggtaggtcgatggactgtctctaacaaaatgccagtggagaaactgctatatgtgcgaatcaacttttggatagggttttagactacatgaccatcattgttattataagaggattttcttatagctcatcagtaaaaatgaaacccatgtgtttgtgaaaatagtttctagtgtccctctatgaaatataagtcatgctgtatatccatacaatcagttaataaaatgttagtcctttacatatgtgcacaggatttaagatatactgctagatgataccctgcacgttgttgtgaaaatctttatgaaattaaaataagcaaatcattgagatgaaattagaagatattgtgtatattataagcatgtcacaacttgatatgaactaacaaaagatataagatcataatatgctgatataattaataatcgattgctagtccatttggttgtcaaaacagaactgagtgttgtctttttttacatgatgtttttaactgtttctttacatgatattaacatgacatatagcaacactggtctagaattgatgatggatgtggctgatcaacttctagattaaatagagataattatatatggctacgaggtaaattcaagcggtataatgtataaaactgaaataatctgtgaagaataatcaaatggtcaatagtaaaggtactttggggtgatctggagctctaaactttgatctaattgatgaaatttattgagctaatgtggtgcaataagagaagaggaaaacaattttaattgtatttagtgggaataaattatatagacatatatataggataaaatatatttaaatgactttctaccctttcaccctttgagaaaagcaaaggggagaggaagtctaaggatgacttctacaataattgatggctggtacagtgcagtgttactctgccgtttgcaccaaccgaataacagttccataaatcaaacggcttcaaagttcaaactaatataattatcgtgtaaaaaaatgcatacataccagctttccttgtctgagctgtaaaaaacaataatacattccttgatcttcaccacaaagtttgtgtctgtattcaaagcaaagtgtaaaaaaaagaatgtattgtgcacaacttgtgctaaatgaaagagagaacttttttttagagggagcttgcacaagcagtactaaacctgatagtatatacttaaataataatacctgtattttttaatttatttctttataaaatgtcacataggattccatccacttgataacatggtgcatttctatcaaattaatttatccgagataaaaaaaataaaagcaaaacaaataccgccgcccacccaacatacatacgtgtacgtaagccaagcttaattagccttccgtgtcttccaaacccctataattaattaagaaaaaaaacccaaagattcgccaggagcctagtgcgaaaagttaaccgctaattaattaaaaagttaatcctgattaatttatcttaatgcttgatctctcaggcaaactagcagctaggccggattagagattagattaggaactttttggagctatcatgtcgccggccggttgcatcagtgtggggcccacgcgtcatcccctcaatggtgataactaatgggattaattagccatggaaaataaatattaattaatcttaaccaatggtgattagcgtgaggaggagctgcctaatcaggggccactg

SEQ ID NO: 20803 - DNA, 14796 bp, Oryza sativa
ctggagcagagtggagcaggggttaacactggtgattagcagagatagagagagagagagagctgtggtcgctgtctgattctgctgtattatattcccctgatggcatccggacaagcgtcaagaggggacggacataccatgtgccacctcatcctcgtgatccatgggcataattgctaggtgcacacggcggggttctggttccggcctcgatgggtggctgacgggtggggccgtctcacaaaccgtgtgcggccaacgtgtcggctttgcggaattcttgctagtatttcttttttttttcaaaaaaagtttttattcaacacgcaaggaaaaaaacgatatagagatatgattgttgtaaacagctcaaacacgctggctacatgaaaccctagcggtctgagtttatacccgacagtcccataaacccttagttagcatacggactcgaacatgtgatctccccttcccgaattcaagtggttttaaccgctgggatgtcatttgacttgtgaatagtatctcatatgtcattttccccttgtaaattgagctttcgtacttaggtctcaggtagtaagtatttcccgaatatatttatcctatatcccaaaataactgatcactttattacttatgagtcaattatgagaaaaggtaaatgacctagatgccctatactaatagagatgtcactagtgggctgtagttgagggtataataaatatatataatttttaaattagaggttggaagaaattttggattggcaaacaatattcacttatttagggataatttttgaattttgaaatttgagatggattgacaaatagtactacttgttttcccgttgaaactggtagggtaaatactaacagtttgtgtcataaaactgctacaccttcacatgatgtcttgtcagaggttttgtttaaatctctcaccctttttgtggaacaataaaaaagcattactcctgaagcaatggaacactcccaaatcccaattcaccttttgatcagaagcacatgtacatgtacatttgtacacaagctgcctgtcttttttgctttggtccttttgggctaggctagaaaaagcactcatccaacacatgacttcctgatccatccaacacttttattttttttctgcagcaaatcatcattcagatggtttgcaaagctgccattctttagcatccaaagagatcagatgcaaaaaactttttcccagctactacaagacggccaaaaagaggaagcacacatgaacaccaatcattagcagataattggcacgggctttggctttttagtagtgccttcgctctgaatcgagtcaaacagcacaaccaaaataagagttgtttgcaaagtgtgagcatgccatcacacgagtgcaagaattgtgtatttagcaaccaatcaatcacaatcattctttcattcattcagacttaccaaaaatttcttcagaagatggtggttcttttcccctcttccttttccaacccatatcgacatcgatatcgatatgcttgaatttctattcatgtatgattttttttaaaaaatgcggtcaaggcgcgaattatgagccagaatataagcaaagtctgcatcaggacaaggacatgctcctccccatcttgcagtcgcagtttttgaatctggagaccctgaaaacacaccaacatggagaagaagaaaagctaaggattcagcaacagggacccctgaaaactggatcttctgatccacaaggcaaacaagaacacaacaaaattggcaggacgaatggttagtttgttagtacaagagatggacataagaagatgataggaggaggaggaggatattatgaaatgcataacaccttgatgataattgcttgcttggatttatttattttttgatgaacatgaggacaagccactgatcaggcttcacagaaaatcgaattcgtcgttgtcgccaagttgtaggtgttcttggatgcttggctccgtttctaactgagaatgtagggtggtgacagcaaccttagctgcaaatctgtccaaggaaaactgtggtttggtaggataatatactgatgatgccattgttctgtcaccggtacagattcaagaaagagatgtacagtacaatatgagctagatggcactgacaattggccaatctccagaggtttagagacccataatttcctaaaccctgctgctccaaatgactagccagggccaagtctatcaataataaaagctgctagctgtttgctcatagatttccttcatgataatctgagggggaaaataaagacatgaatggtcaaggctatgatttggacatgtaaataaatacacatactagaatagttaatctcggatttgattcagacatgtaaatacctgaaatatggcatttaaagtttcttattactgactgacaaggcatgaaaaagacatgtaactaacatcattattcttttgcattcgcccccggttcttctatctcgcgctgttcttcctatgtgcatttggctcaatcatatagagcagaatgacctgtttaaattaaccacagttaaataacagtacagtacactgtacaccatacaaacaggaagtatcctattagcaatttaacaggagcaggcttgtcccaggagaactgtagcagctgaaatgcagagaggccttggacttcagacatgaactgaaacggattcaggaggagttgctgtttgctgaggggagggtgtgtgccagtttgatgaagcagatgtcccagtggatctgtgtttgtcagccagcccctgtggaggattaattcaagtgcagtgcaagtgagaaagacaagaaataaaacggtgtcgggacagcgatcgccgatcaacgaatgtaggcgcagtcaaaattcagctcttttttgaaaactagaatgaaaacattctgaatattcagtttggtttggtcccatgagacaaaaacaggtcagcagaaaaaggtcaaaaaagagaaaaagtttgcacataccatatagttattgaagtagaactgatcaagacataaatggactctggaattttctgataagtggttaggtccaaaagcttgtagtactagataatgccgcgaagttcaggtcagcactcagcagacaaatcatgtcatatgaaacaatttatatccaggaagaaggacgcaagctcattgtttcctaatttctagcctttttcattttgagtggaggcataccatatcttcttcttcttttttccttgttcttttgtgtgaaagaaatgacaattcataatatagctagaaagcagaaagtgtcaaatgtcatgattctgaaggaggacaaaacaagaaggaagctgaggcagagattcatcatgaatataaatggtgagcaaaggcagaaatgactcaacaagtcatttcccttttccaaaagaactaggacaagaagagagcttttgctatgatcatcctaacatgcattggtctgttttaatgagtcaaatcgttgactgaataaaaacagcagaaatcttctctgacatctgctgctcaagatgacaaaagggtaacctgccacacacacacactagcagcaatcttgaaaggagccaagggatttattgtgtgaagcaggttttcttgaactgaaactgtttttgaagccaagcatgcatgtgagctacagaatggagatatttattttcctttgtccggtgaaatgaattcggttgtcagtgttgcatattttgtcgagggcagagttgaattgcaattactggccaccagcatgtaaacaaatggaaaaaaagaaagagagaaaaagagggagaaaaagaaatgcattttgcttacttgacgttcgccattgttaggggagcgagagagattcttgaatgataaaaaaaactgacctgctgatgccggaggattgtaggttgcaggggccatagttctcaatacctcgacggcgagaaggcagagaggggagcgccgccgccctggcggtgatgaggcgggcctcgccggccggcgtgctcaaatccggcggaggtgatcggaagaggcttcagggtagtaggacagtcagcggtggaaatgggcagtaatttcctattttattctttttcactcgttttgttttcctttgggttaatttgggttttcaagcttagggggtatttgaactttttttttttaacttcttcatatcctgtgtgattttcaatttgctagtcactaactaccatgaaaaaaaaataaggtagatgctattacgcataaagatgttattgttttcactttagagagataccgacgaatattacacacatgtggagaatttagtgaggttgagtatttattcttgattgatttccatttattgcgcgtactaataggaaaaagcgtttttttaagaaaaaaactaaaacaaatgagagtaaatttctttctttttttatccatattcttcaatttcagttttgagtagagtaaattttataaaaaatagatggaactaaattttataaaattttaaactattgtaaaattatatatacacttgacagagtatcacaaaatacatatttgacactaaatttgtaacaaaactatatcttttgttgctccaacaaaacattagtaccaaggtaaataaatcaaaacattaatgctaagggtttaaactctaaagtctataatttcaagataatttaatcattgaaactatagttttgcaatacttcatcttataaatgtatagtttcataacaaatttggtaaaaatctatgataactttgtgatatacatacaacgccttataaatttacaatagtttgatttgagatatctatagttttgcaaaatttacccttcctttttttctattatatctagttgcacagttcgggccggataaatactcaaggatttgctttatctccaacgcagacacaatgataatatcaaggaaagcgaccaagtagctaccctccacagctccatttctttggggccttccgttttcgcctgaattgacatgccaaggaacttgcttatccatctccagtgtcacccaacgcatacaggtcgttcaggtcttttctagtcggttgctttcaccactgacacaaatattcgagcaactgaccaccgagataacaagccaacacagccacgactctctcatatacggtggtaaaaccaggtaaaaaaaaaactgacagttccatcttaactacctctaatgaaaaggccatcggaatgaacggacggttgctaagatcaattcattttcatcaggagcaaaaagatttgactgtttagtgagatagtagacagtcgctgtcacttgggcatgtgatagcagcagtagagagggacatgtagttcaggtgattgcttcgcatggcaagcccggactgatgaaacggccatgtgagccctcccagcgatcatgtgaaatgtaactctgaaccgatgcaacaacacccgggattttgacagcaactaggcacggacagatccaaaccatgtttgagatgtagcaagcaacgatcacacgttccagctcataactggggccccttatcttctgcacttgtgccccacggcctccacggatagtttcacaagcaattctgaaccaaacgataggacggaatccagattccagagtgctatgtgcatgtaaagcttaaaccattgcactgatgaaaccagaggctgatgctggtgtcctgtgaaggacccatggttctggcagagatgtaacccaaaatcatcatgttgttcgacgactaaaacggcaatcttctagctgccatcgtcacatggcaatggagtaaagcttttgcctcaagaagcttgatgccctgaaagccccccaaaagagagattgatagattaatattccttttattttctacttctgataagcacactaaatgcttgacaaaaaaagcagatggagaaattgctttgtataatgcccatgttcatggcgaagcatctctcaatagacagcgcaacagaaagaaatgtgtaccgtaatgaatccacccgacaacagcggtacctcaaaaaagcagcccttgtacagacatgaatgacacatcaaatctccattgctttactaagtcatatggcgcttagcattttcataatcccaaacaaagagataaacaccaactttccaattcaaatctgcacataaattcaacattcaattattgcatgaaacaattacaagcctgcagtttttaagtgtacatgatatttggatgcatatttaacgtaagagtaagagcacactagtttttgagtttcctattatgcatttaatccaataatattgaaacaattgtgttttgacctttattttatggtaactaggtgtattcaacagtcacctttattgaggaacatacttaaaacctgtaaaagaagactacgtagttgattatgttatagaggaacaagcaacaaaacgatccacctaggaattagaagcccatgtgcaaaacactggggccctaaatttttaaaaacactgtagaaccaaagtataccttcacttaatatggattgatgaaatgaacaaataaactcctatttcataaccaaaatcatacatttcagaagacacgatcgatgaggactgatgaaataaacaaataatttcctgcttgtttataacatgaatttgaaacttagagaagaaaacaaattgtagggaaatgtgatggcacagtgaactcacgagctgatggatgcacacgggcatactcccttttgctgcactgttggcttcttgctgctgcaaactaatgaagattaggaattgtgatttgctgttgtatgcctgcgcgacaccaagccatcgagtagcgcgtgggcagcaatggaggagccaacgatacagtctttgggcctggtagtccttgtgggcctttttcttttttcatttattaggccttgtaatttgctggtaattaagtatagttgattagtactaatgatagatttatttggggacccctaatttttggggccctgaacacatgcactttgcaccggctaatgtatgaccctgcccttgaactcataaacctccaaaataacactccacaactcagacaaatacatgcacacaaaataaacagttgttactggcatcataattcatagagtcgcaaaagtatatgaacaaagaaaacttccagtatgtgcacgagtaaaaacagggaagcagcagcaatatgggaaagaaattgtcaccaaagttctaaaaagattcaatcacaatttacttttatcatgttgaacctactttactatctggtcatgagaaggaaagaggtactcttatagaagttgtattgatggcgtgttctacacccacccactcttgaatattttttgtggctatatacatgcaggcatgtgtgccatgtgctatttgtgtattttcatttctaaaaaatactaactttagtacgtgtatagtatatatgtcgatgttgattgattcgtgtaaaattgagtattgtagaatcttttttaaaaaatttgagggtaattattttttgatattgttaacctagaaacttataaagtttatagtataatttgccatccattggtacaatgctaataaaaatataagaccaaaagaaaaaaaatatgggctctgtctgaggatgtaatagttttggagttttcgtagaatacagtggtttccaaaaagtactatagtatttagtttgagaacagaaaatactgtagttttctcaacgctatggtttttccactcctggactccttttcttttgtaaaccaagaaagtgaagcgattccacagcagttttaaatattgcaaagtcttggggtataatactgtctgtaaggtagttttaaatccatctcttatatgtgagcaaatctgggtttacagattgaattagctaatgatcgttaatatgtgtaaaagctagggctacgagcctacgacacaatggtacattgatacataggagttaaaaaagctatgcatagagacatctgtcagtacacgttgatgcttcacatacccatcttctaattccatgcacccaagatatctaaatagaactagccaaacaattcttttttgaaaaaaaaaacagtaatgtggtaaatactgcagttgccaaaacaagaaactatggtttttgctacagtgtgaaaaatgtagtattcaaagactggcgtattcatggatgcaacaaacttggaagtattgcatagagtagttctttaaatctgtagcatcctaacagggcctacatttacaggccaaaaaacatgcatgttacaatgtcctagaattcctaatagctaagcacgagagaagttaaaaccatcgatctaatcaatcatcttctagaaaagaaaaaaaaagcaatcattgagtcacagatagtactgacatatatgttcgcatatcaacaatgacctggaacagtttagaataaacatttattttattatcccagtactacatatagggcctgttcactttgatgccaaaaaaaaccttaccaaattttaccattgccaaaattttggtaacttgccaaaattttggtaggatttcttatatagttgctaaaatttggcagcaaactaaatgtagccactttttttgtaactttaccaaaatttggtaaggttgaaaatggcatcaaagtgaacaggcccataaagtgtgtcccatgaatcatacgaatcatgtcaactttttcatgaaactactgactcaaggagtgcatttatgacaacactaggcctacatcttcaaaaccattcactaaatggaactaacctgtggattgaacagaagtgcattcatttgatagttaccaatcttcaaaatctgacagtaaatatttgccccaagttctgcaaaataagtcctgaatgaaatttattggtaactaaagcgcaataaaacaccacagacaatgttgttctcttttcgacataccacatcagcagttgcaacttgcaagatggagttacagcaataaaactggtgtgcggaatacaaaaaatgctgcacaatctcatgggcacgggttcatcactgaacaacatccaagtatgctgcaaaattcaaggaacatttatttaactaccaatgcatatatgtagtctacaggtatcaaaggcatagtagtagattcatacttctctctaattgccagaaccaaacaagaactcctgcaaaatcctggaggcctctgaaacttcatgctgagtgcttactgagctgggcactgcagcagtggtaggcaaactatttttctttggttctgaacatggatgtagattagcttgttttgatgagtctttttcatccaacagtggagctgatctatgtccattgtgcttgccaagttttttcccgtctgcgggttgaggtcttccaaagttctgatgtggaccaccagttggattcttatgcttctcagtggacacaacatcctgatgcaaaatgctagaatctggtctggctttattgaaaggaagaaactgtataccccttggtatacgaacaggtaccttttgagcatttcctgatatgccagcaaggtttttaaggatggaatgatgtttgataggaacagaggttgcaggttcaccactgtatactgttgaagttttctgacgacttgtttgctcttggcaatttgctttttcaggtactgatgacgcattagatttctttgcatctggtgtggacggaccttctgcagttggtatctgacaacgagtgcaaagcttgcttaattcacagcatttgctaatattaaaatttaaccaggctataacaccaataattaaataagagtgaatgatttgttaaattacgtaccacatgagaaaatttgcatttatcacctctgatgcacattccattttccataaaattgtggcaagggtactttgacaactcatgatcataagggcaatcatctcctttcaaacaagaaccacgtgcataatgcgtgcagggctgtcaaggcaaaaaaaaaatcaggataaaattcgcaaaacctcaaaaggacagatacaacaggaagtttagtaccaatacttggatcaagatttgggtacacttcagtttatgatttagcactatactgatacgtattcataacatgtgcagtgcgaacctgttctgtgcatgctttaaagttcaaattcaatattgatgtcacattttcatctaaaaaataggtggtatgcataggtgcgtacaaaatgagctcatgcttgcgtgtgggcagaccacatagaatatatccacacatattaaacagcatacatgcatcttattataatacattatgattactgcaagcatgtgataaacttctatgaaatggataccttagattttgtcaaaggtgtcgtatcatgggagaacttgcacaaattgccctgcaataaaaaaataagaaatattaggtactacatccgtttaaggttataagactttctagcattgcccacattcatataaatgttaatgaatctaggcacacatatatgtctagattcattaacatatatataaatgcgggcaatgctagaaagtcttataatatgaaacagaggaagtattttattaaagtaaatcctgtgaaaagcatttttacagtctttgtaacatatttatatagaaaacataacacatatacaaagaataaagtggacatgttacatgatgaaaacaatatgattatataaacagtgttcatcatggtctaagctctcaggcagcacaccagcgcctaatcagcaaatagacagacctaggcagggctaatcgttaccaggtgctatctagtggacactgaatcaaaatatgcatcctatgctactgatatggctaatcactaaattacacaaatataatcagtgtgtccagaaaatcgctacaatatgtttcaaggccagggcatgtgctgtgcagtttacaacagcaaagaatataattttttgtcgatccaaaagtgaagcagatgatgactaccatctgtctgatctgagagacagactcacctgctggcacttcccatgcaagtagaagtggcaaaccttcaccactttaggctttataactggttgaagtttcagtcttttcaccccttcggcttcccgttgcaatgctctcttaattcgtttagttttctgcatattaatagcattgaaagcaaatcttaatatttctaaaggtaaaaactatttgaatgcacagttcaaaaatgtttatacattggaaccaaatggtcctgagatcagaacataccgtcttcttagcttttctctcctctgtcaaggtgcgctttcttgtgtttccatgtttgagagcctgcaatattaatatagaacagactgaaaatccatacttacgtagctaagaagaaaatttaacacagacgaatcaattgtattgtatattgttcttaaaaatcttgcattgtaaattgactgtgattaacttgaagttacaaagaaagtcatgaagtgtgaacactcgaactgcattcattgtactcaagcaaggtatgtatgcgatgattaaaaaaagctactgaattcagttaatatgaaacatcaaacaagaattaatcaaaattgtgcataaacaatgaagcaacaaaacagcgtatgggtaccaaaaaaagagagaatatggcaagcttgtacgcatttgtggttgacaaagaagctataccttatcatcaggcaaaggtgtctcattccaatcgagaacttcatcataactgactgcttgcgccctggcaacatgcatttgagaatcacccttgctattacatagcatgttccgtgcagtgtcgccatttcctttttgaggtatcaaatgcaaattgctctttaagtcatggccacatgacccatcctcctctatccttctgctatcaaaatcctcttccaattccacatcatcttgaagctctgaattgccagaatcatctgcatctaaattctgcgtgtcgccctcaatctctccttcctcaaaaccaccaccaccatccagtgacccatgatctaaactgcacacagatctgtcattgccaatcccagctcccaattctttcacctcctcagctactctgtcatcactctgcagtttatctccagatactccacagctctgcgccgacattacacaggcactagcatcatcaatcaaccctgacaagttgttcatcatcgcatcgagttgcaattgctcattgtcattaccaaccatttcaatcaccaattcactatcctccccgtctaagcaagcctgcatcgacctcaaagcctcgtcatcccccatcagtccagccccagcccccaactcatcgccatcggcatcagcctccccggaagtgcctccggcgaaaacaacctcttctacaccctccacccgctcgaccccagcgactctaccctcctccgtcccctgcggcaccacgccgggatcggtggtagggttcacggcggcgtccggggacgccgaagtcgaaggcgtctcgtgcggagcatggtttcccagagccacctccacctctaagttcttcccccgatcgcctcccacgtctgcaggaggcggcgaatccccatggggaagcccgccggagccgccgggagggatggcggcggcggcggcaggctcgacctccgcgtcggggcgtgccgcgtgccgcggagggtgcaggtggaggcagtgcgagaagagccgggagagcgcgcggtaggaggcgctgtcgagatgggctctccggcgagagaggacatcggtggtgggcggcgcggcggcgagggaggcaggagccgccgcgggcgggacgggcgagggttcctccatggcggaagggactggatgagtgggtcggagctagggtttagggttcgcagctgtgagctgtgcgtcgcctcgccgcggctgctcgtcggcggcggcggcggcgacgtggcggcgagacgagaggaggaaaacccatcgcagggaaaggcagaggcggcggcaaacgagggcgcggccagaagcccagaatataggcctagtaattgggcctaatgggccttgctacagctggttgagtaaaggaaaaagaccacttagactctcttaatagttcaccgaatctaattcgtgacccttaactagaaaaccgggtaggacgactccccgaattattgaaaccagtgcaatttgactcctctagcggttttggagggcggtttcgctaacgtggcactgacgtagctttacaattaaaaaaatatctgtgggaccaatctatcattcacacacaaaatatattgtgggacccactgacatctggagcccacgtgtcatcctttccctttcttcttcctcctccctctctctctctcccttctctctctcttctctcccccttcggacgcacgcgaggagcgggagccagatcggcgacggcggcggccaggggctggaggggcgacggcggcgtgcgggcgagggctggagcggcgacggtggcgtgcaggcgacggccgcgccaccgcctgccccgtctccaagccggcccaccgctgctccccctccttaaagtcccagagctgcagcctctgctctcccccattggtcgtcgccgccggagcagtagcagcagcgccgccgccgcctgcaaggaagaacgagaggccggcgacctcagccggagcggcggcgaacctctgcagcaggcaggggtgctgcgacggcggcggcggccacagcgaagctgcgacaacattggactgaagtgtgcgctgatcgaaggcggccaccgtggcgtgctgctggtcctgcgagaacgcgaggtggggtggcatcgccatcatcttgaggtggggcaagcaagcgtcgcctgcttgctgctcctgctgatgttgcatttgcaatggcttgctgttgctgatgttgcaatggcttgttgccgttggtgttcgagcagtggaggagctcggcgaacgcgccgccgccgccgttgtaggcgttgccattgttgtcgcagggggcgttggcgagggagagcacggtccgccgttgccgatccggctcccgctcctcgcgtgcgtctgaaggggaagagagagagagggaggaggaagaaggaaggagaaaggatagacatgtaggccccacatatcggtgggtcccataatatattttgtgtgtgaatgctagatgggtcccatagatattttttttaattctaatgccacgtaagcgccacggggatgaagactagattagcaccgccacgtcagcaaaaccgacatcctaaaccgctggaggagtcaaattggactggtttcaataattcggggagtcgtcctacccagttttctagttaagggtcatgaatattcggtgaacaattaagggagtctaagtggactttttccttgagtaaaaacgggtggcctttttacgtcggaaaaaaatacgaacgattttgctaaacttttgtcgggtgagttttttctactatgatatttgacattttattggccgtagaatcgtgcgtcgagattagtgtaggaatcagcgacgtttctcactcatttccccacttcgggcctgtttggcacaactccagctccaactccactcctcctggagctggagctcagccaaacagcttcagctccaccaaaactg

SEQ ID NO: 20804 - DNA, 19210 bp, Oryza sativa
tccacaactctactccagactcaactcctgaagttatatttaggagttggagctgtaacaaacagggcccttccttatcgctctctctcaccctttcttttctaaataaaaatagataggcagccccctgtcgtcatgtagtcgatcttgggcaaattgctttcgaattccgatatataaacgtggaaatatttgcaaggcatgggggccctggtcaaccaggagctcggcggctcgcgcacggtgcaagttcaacagcagcagcagcagccggcgttggacttccaggagaacatcctcctcctcgtcggcgacctcaacgcgcgcgaatgccggccaaagaggaaaccatcgtgtacgaggcggatccggacgcactcaccgtggaccttgtcgacgatccgttggttaaagagttccgtgacaagttagtggatgaggtcctcaccatcgatgccggagatatggaggcactattcgaggaacaccaggagaatccggagctggagaggacgctgatgctgatctctcagtccgaccaagacgctgatgccgccgatggcgacaccccatgagactcttattacctttctttgacgtgatttgtctcggactttcattttttcggcccagcatgtgttgggctgtgattgtttcttttctttgacctttgtcaagttttctttcagccttagtaactcttctatttttttttctagatcacagccgaattccttccttggataccctacacgtactactactactacttctgcggccgtggataaggcggcggagacggaccaccacctggccacacgtgcctgcaggcgctgcgtcttgataattctgccaacggagaaaacccatgaggaggagtttatatttataggacgtgactaatactcgtagagactatactctatactgtattaactatagaccagggtttcccaaaccgccggggccggggttaccgcgcaccggcagtaagcacggttaccgcgcggtaaccgcggtaaccgtgtaaaaccgtacaaaaccgtgcaaaatttataaaaaaaattaaattattttttaaatttatttgaatttaaggatgttatcgcggtatttatattactatacccccgcggtaagcctggtaaccgcggtaaccgtgtggttaccggcggtaggggaaaccttgctagagactcatttcaaaccttgttgcctaactagtacaccaaatgtatacatgtgtacaaatttaatatttcagaaaagattatatgtacaaaatatatctattataaagtttctatgcgtaaacttttctacgtataaatatttatttttctagaccggagtaacacgctgataaattcattctaaatttaaacgtacaggtttcataggtacaaaaattacatttaaattactcgtacagggtatctgaaatttgtataagtatagatcggtgtaaaaatatgtatataatctctatattcttttaaaaaagtagtggtggtgataatgaatttgccaccccacctacctacttctattatgaattctgcaaattatctcttcaacttgctaatatttaaaacaatcaaaatctggatataaagccacatataaatcaaatggatagccacatgccacacattttctatagcaaaacgatgggtaacatgtttcatgggaattttttttgtttattttattttatagcaaatatgcccatgtgtttcaacgggagatggctcttttggttgaccatatcgtccatgtagaatgtagcatcgttagtttttactcttggttaaaaagacaataggcaattatgttcttaactctgttttcgttctatgattttgtccttgcttattaactaaaggtcaagtttgcctccatttcattaagatgacttagcggtgttgtaaatttagccctattattttctgaagaatttatgattttggtcttgatttgacaaaagtgtgttttgacacgattttttcccaacctgaattttcatattctgatcagctaattattaaattttcatattctgatacatgactactcattcatatttaaaatatatatatgaaaatagtactctgataagctagagtactataatttgatagtactccgaatatgagtgagtgtcggatcgccattgcagtgatcaaccttctcaccgttggccatgcacaacatgcagctgaattttcccttcagcgtgtgctagcatgtgtggtggactcgctccgcgctgacgaaccttgtcttgaggcacacccacacttgtttcgccgtcttcttctttgccacccgcatgaagagatcctttggaagcgcatggagcaagtgcgacctcaccttcttgtcaaatgccctaatcttccatcatcgcctgcagccctgcacccggatcacctagctggtataggtggttgcagtgaccagtgagctgcgggtagaggaaagcgctccccgtgctacgccgtgccgcgtctgccgtcgtgacgatagacatagctctgttatctttttttgaaacctaaggcggaacttagttccacttttatatttagaagaagagaattggcccagtctataaggaaaatcgggcccaaaaaccatacaactgcacggttaattacaaacccaccgctacacaactaacaatgacggcggagcccaatcgcaggacgtcgccacaaagctaaacacaaaagcgacacaacagcttccacatcgcagaagaggtgttatcgttgccgagctagccgccccagcgacccagcagcgccaaagcgaaagtcgccaaagccactgaagacgaaagtcgccaaagcgaaaagcggctccggcatccaacaatagacatcagccaagccaccgaggagccacttccttcacacggccagcaccagaactccttggaagagactgcaacatgtcatcgttgctaagcgtcgctgcaccccatcagcgagcagcttcgacttcatcagcagaaacaaccgaagagcatgtcgcccaccacaaaaaagaagcagacccaagaaggcgaagcctcaccgaacacaagatatgaaagcttttgaaccgaaaaggaccatcaacagtcatcgatgcattggaacttctccgaagcgacgcccctaaggaggatacgacgtgtgacgccgccgccgctcgtccaaaaatcggaacaaggttttcacctggagagatttgtgaggatatgaaagagtgccatgacaacgcctccaaggagggaaacgacacccacgggcgcgccattgtcgaaccggccaaaagcacggtaaggctttcgccagcatcttcacaacacccacacaagcacccccacatcgatggccgcagaatagttcatgacgtctcagaagcaatcataccttgattgtaaccaacggcaaagacgggcccttggccatcctcgaaatgccatccatccgccgcaaacttctacagcaagccggagcctccgccctccccatagcattccccatgaccagaaaagggtccggccaaggggggaaaccaaagagagggagaacactcggccgacaatgaggaagtcaccgtcacggacatcaagcaccattcctgcttcacgccagcacaagccgtcgtcccgccatttccacatccgcacatcgctgcccatcaacaacaacgagacccaccaccggcagaagccccctgccgagtaggaggctggctgccagcgagccgccgccgcgcttgccgtccacacgcagccgtcccaccgaccagctgccatctggcgtggaggcgacgaatctagccgcggacggccagatccagccaggtacaggggatgaccagctagggcgcgccgccgcagcattaccgaagccaacaccgacgcttgacagacgccgacgacaacgccgcgaccatgacgggagcgagccgccactgccgtcgcccgtccaccgcgacgccgcccctgcctgccggtttccgcgcctccccggcgccgaccactctcccccagcccggattggagaggcgacgcgagggagcgccgttgccgctgctccacctttcccgccgcctgcatctcccttccccgcctccttgggtgccgccgtcgtcccgggaggaggccggaccgccggatttggcgagggacgccaaatctggcgtcgtcgccgccgcccccgttccgcacccagccgccttcgcccagctgttccgcacccggtcgcctctgcgcgcctagcccgacgccccgacgccgacgccgatgccaccgcaccgtcgccgcccccaactggtcggggtcgtgggcaccgacccgcgccctcgagggagaaggaaggccccaccgccgacttcctcgcagccgcgcggtttccggcagtctgctcgggcggcggcgaggtggaggagggagcaaggcggcggtggggagaaagacggcggtggtcgccacccgtgtcgcccctgcccctggaacgacacgggggcagttctcatagctctgttatcgatcactggttgcctagaacctcaatcgaacaccttgcgggcagggactctagttgctcggcaatgccaaagaacaaagaacttaatttgtgacctatctttgtgactttgtgtgtcttctattgaatggaacaagttgggatacaatttgtgaggaatgtttcctttctttttgtagcaaagtctaaaaacagaatccggccagcacacatgcgtacactagcgcgattaacccaaacaattttgctatatatttgtcgataaattttctcctaaaaatttgacaaatataattacagtataatcgtagtgtaattacattgtaactacaatgtaacttatatgtaactttcaaaaatctctccgtaacatgttatttgggtaaaatggaggtcgtgggaacaaatcctttcacatatgtgtgtgctgtgattttttttctttctcaccagaacaaatctggtaatagatctaacgattcaaaattacatgaaatttacatacaagttacactattgttacatgcaagttgcagtgtaattacatataagttacaatataattacactataattatactataattacatctatcaaatttttagaaaaaaatttgtcgacaaatagaaatagatataggtgttctcaatccgaaaattcggaacgccacgcgcacacacgccctgatcgcgctcccggcatctagctggctccaatccgttgcacggccgttggcacccaccgagccctgacaccgccgccggcgaaacagcaagacgacacgcatgatcaggtccggtcagctaacgaaatgctgccagacgacacgcatgaggccttcgcgccgtacgaagcatgcatggtttctgttttctgtaaaaaaataaataaataaaagtcttctgcattttcctggtatatattccgatccgttccctggtttcttaacagtgtatccgactcggacttgttgatcgatcgtcttttttctcgacgtgcgcacgcacgtacacagaccgaatcggattatttgtgggcgagcagtgtctatatatttgctccggtggccgaagcgagcgagccgacaagccacagatcgatctctagctcgatttttcaacgagaacccctcgctgatcgaccgcacgccgcgcgcagtcgtcgtcgtacgtcgtcgtactcgatcgtcttcgacgacggcaatggccgacccgacgccgccgccaccgtgcgccgcgtgcgcgcaccaggggcggcccagctgcccggcgggctgcccgctggcgccctacttcccggccgaccggccggagcgcttcgagtacgctaacctcctctacggcgtggacggcatcctccgccgcctggaggcggccgggccggacccggggacccggcgcgccaccatggcgtccatcgtcttcgtgtcggacgcgagggccgccgaccccgtgcacggcgcctacggcgtgatacggaacctccagcaggagctcgccagcgtcaaggccgagatcgccgccatccggcagaagcagcagcaagcccagccgccgccgccgccggaggacggccactaactaagcctacgcaccgccatccgcatttatatatgcatgctgtggagacggttcaattagattatgtttttcttagtaactcattagattgctgcaatattaattatctgaattcagagtttagctccatgtttcggaaataactaggattagcacccccacacgttgccgtgcagtgggtgcgacggtatttccaaaggatgtcaaattactcctctatttactgtatgtcatatatgattatatttgtatttaaaagtgtcttataataatattattatgttgaagggcgtgtagaaaactttgcacacttctctgtctttatctctatatctaactctacgtgtggcgtttcggttcagaccagaagttccagattcagaccggaagtttcagattatttacttccctgcaaagtatgaatttcaaggaacgcctattcacctcctagatctatatctatatctatatctataataactaatataaatattcggatttttccggtcgtcgcatctcttttcgtccgtattttcgtccgtccgtcgtatttcaatctcaatcccaatccgactatgttagcgatggaaaaattgcaaaaaaaaaaaaaacaattcatcacagattcacaccaacggattctcaatcccacccacggattcgcagccaattcatcacagattaaaatccacaagaaaggagaaaaacgaaaagacgaaaaaccgcaaaaaagggcgccgccgctgggaaaccaggccaccaccacctcccctggatccaggacgccggatctgggataccgagccgccgccgcctgccaccgtcgagccctcccgcggccccatggcaagggagaggaggcgaggggcggagaggcgctgccgcccgttgccacccgcggaaggagagctccgggctcaagacgtcgactggagaggaggaggtgcggggtcgcaggtagagggagaaggagagaggaggcggagagaaagagtcgccggaggcggagaggcggagagaacgagagagaggagttgaggagcggcgggttggtcgcggctgggttggtgcggtgtggggatggatacggattaaacactgtgggccgcctccgttttttttttttgttgatttttctgggatagattcgcctcttgcgggcacgtatcactgttgccaccgcaaacgctaaaacaaaaatgttcgatttttagtctattagattgactttgagattcgtgttcatggaacataaaaaataaaaaaaaagctacgcacgatacaagaacgattttgctatatctcactcgaaagattttttcttatctctcactcgattttctcactcaaatttacagtgcattttattgtaagttacagtgtaatttatgaaacttaccctgtaacttttgtaagttacactgtaatttttgaatcttcgcatgtaaattttaaattttgtattggatttagtctttttcttgaggatatggtaatttagtgtccataatgtgtttcttaattgctttttgctttttattatatctatcggattttaatccaaagattaaaaatctgtgtgatacgatcataaaaatctttcgaaagatgtataggtactcccatacaagaatcgaccccgggaccttcgatctgggcccaactacttaaagaaagtttatttgctcagttgggataaaattagtttttctctctcaataattttaagcatctttctattttctattttcagaaatagcattagtaccattttaattatttattactgcttaataatttaattccaactaaattgaattaactaaaaatttgatttttctcatgatatggatttatttttcgactaaaaatataattatttatttgtcatgatataaatttagactaaaattaaataatattaatatgaaaatttctaaactataagagtgctcatttttttattactttactaagttaataacattaattttttccgttgcaacgcactattgaataataatttattatgagctactatatttctctctatcatttgagactttttttaacgagcaaaagtaccaaagcagtgtgaaaataacttcgcttaaaaacaaatatttttagttcaatacaccgtagcaaagcacgggcattttgctagtaatactaagatcctttcaacgcgtattgtctccttagcatcaataatactagaggctggggcgcgccaatggcgcgccgcctgtagacaggtcgatggaaagatgcgatgcacacgttctcttaactaagaaaagctaaaaagcatatggtaaaaagaaacaacaaatagtaccatagtagctgtagtataacaagccagctgtttgtacataaagtggttaattgttcactcagcttatggataacaaaaggagctgaggacaatgataagcagttataggtcacgtgcttacagagcaagtgaagttagatagaccgcaagcaaaggataatagagaattatagtagttgttccagtgtagataatagcagcgactactgaagatgcaggtaactttcacagagcatctatggtgagcgtgaggtgacttgtcctaaaaagtggaagatgcagattgtgtaagttgatgctgttggctgctgcaaagctaaccaccctgatgttaagttgttgagggtcgacctgcaatctgcactctaatgtttgctgtcttgcctcgaaccaagttcacaatgtatttctttgaaaactcggtcgcaaagtactgaaaaagaaaagtgacatttatatgctcagtatgggtataagaagatggaaatgttgtgtcaaaaattaccactctgtcctgttccatgaatgttctgttcatacgcacgacatagaacttgtttgattcttctagaaaatctgcaatctctttgatgtaactcttcaattcagctgtgagcttaatctggtggcagaaggaggtgtctgctaggttttcttttgttactgcctgctagtaaaaaatgacagaaaatgattacatatgaatagaaacatagatagaaagatttaaatcacttgtccagcatgtgcaattttgcaggaggcaatatagcacagtgttttttagccaatgtaagttggaggagtatctggctgatttaattgtatatcttctattacccggcgaaaacagaatagacatgttaatgggtagtgtaagttgaaaaaatgtgatgaggcaaactttgtacctgttccattcctcagaaatggaacgcttttgctaggagatgcatggtcaaatgtgcttgctctggttaattgacctgatggatcaaggggccttttgttcgctgatgagctgttggatggggtcttcactggacatctaataaggccttgtctgttcagtatcataacacacgctttagactgtgatggcatccagaaaagaatcgtttctccagtttctaatccagttgcctctacaaattatttccatcatgtcgtcatgtacagtgtgctagctacttccttgattttgatctttatcttcaagccatgggaagtttttaacttcagattatctccacgctgcatcttatatgctgtcgcaagtgtgattggcacaggatgtagaaagaaaatatcatatccgcactggtgctaacagcatattgtacatagaaagttttgtttgactttgagcttaccaagtagctttgatttgttgcattcagcctcattgatgcgaaaactgcggaagacatgattgtggctacaatatatatacacatgtagttagatgtatttgataaataaaaaaagttatgagaggctcagctagttattagagtttttattataatttttttattttcaaacagggtgagtattttgggatatgtagaaatgcaatgaagtatgtgatctataacttgatgtatgtaagtatttatgtgatgtaaatcttagttgtagctggaaagatatatatggtaagaacataatgtgctgggttaagtggctatactacggtaagatataagataattatgatgcaagaataggactaaatagctgtgaaaaagcttaataatttacagttgatgtaagtatttttttcagtatagtagctaaaggatttatgtgaaagagtattaattatttattgtaatttcgtgtaatggtattgttctaatgtattgaaaaagggaaatttttatattagaaatattaggaactgaatccgatattagcaagtcatgacacaaatataaaatataaagaattgaaaggggctaaagtacgagtatacatgtttcaataatgggcaagctaaaaagtataacatttatatctgaactgaaataatgattagtgagagaatatgtaatagaataggtgtatatttaggatgccaaatctacatagttaaatgatacaatcaattagtctacccctataataaaatggttatagaaaggtttttctgggtcagctaatatcaaagagggtttgtaggttagatcacttaagcataatcactgattagggctgtcaacagtacttagggttaatggtagatctatgatagtttgattgacatagaaaaagacaggaaattttatccccccgcgtcgcccacgcgcaggcgacacgggggtgaaccctaccgccgccgccgccgcccccctctcccccctccccctacctcgctgccgccggagctcaccgccggcaaagccggctggtgagctaggatggcggcggcggggccttctccgcggcggcgctccctcttcggcgtgatggaggtggtgttcgccggcgtcggtacgccggtgagaggtggcggcgaggtctcccggctaggcggcggcagatctggcgtcgccgtcgccggatctggcaagccctccgattttcggcggtggaggaggctgctgcgacgtgtgggcggcgacggctcgcgcagcggcgcgtgggcggagtcggtgctggcggcggccgctggctccggtggtcgaaggccagcgctgacggtggccgccgtctccggtggtcggcaaggtcggggctggccggggtctccatcccgccactactctcttcctcctccctctccacaaccaccctcttcttcccccccctcccctcattcccttattctctcttgtgatgtccctctcctctctgtgccgtcggcacaagcgaagcagaagtggaggtttccttcctcccttcctctcgccatcgctgctaccagttgatctctgctgccagttgtccaattgctctgctgctcgccccagcgctcctctctctctgcgctggtggtatcttggaggtggttgccgtagtcgtgaggttttgtcccgcgaaaccaggagttcctcgccggagacatggttgacaccgaggtcctgggttcccctgactccaactctcagctcctcttcaggccggccaggtctcctcccctccgtgatgcttctcccttctgttggccgtcttccagacctggccgtggagtctttcggtggttgaggagaagtgttcgtccttgaaggtggtccagtccgtctgaagtcagggctcttatgcctcgccagtgcttcatgtgccctgtgactatgtggacctatcttagtgccgagtttggagcggtgtgtttttcctcttcggtgctgagcttttgtgttaaggcggagtcgaagctgctgcatcgggtcagccgatgagctaggcaacgacaactcttaacacttttgctttggcttcttggaggtcctacaccttttgagggagtcctaggcgaaagccctgtctggtcttccaggatcggcgacatcgacgcctgcgggtgccgtttcctccttggaggtgttgtcttgtggactctttctccctttgggtgaaaacccagtccagttatgggcgggcgtgggcagcggcttctgtcgttgttcacctccttggaggcttcgtcttgaaggtcttgctcctctctcggttacttctgtggttcatagttttgtcacgggttttttttgtgtcttctgtgtaaggttttgccggttttcccttagcaaaccgtgcagttgtatggttttctggcccggtttcccttataaacagggtcaactctcttcttctaatatatccggtagatctcctaccgtctactgtttcaaaaagatagtttgattgacttgaggaagggtgtgacgctcgatgatctaaaaacatatattcggtatagagaaaatggggaatgaaaagaatagaaagagagcgaaatagtgtggtgatagtaaaggcatgtggtttggagatgagatctctaaaccctgcgaagtgagagtagcaagcgggggaagaaggatcgatggagcagcggtcaccgtcgatggcgttcctcgttggcgtcgcttttgtggctaaattcgtacacttgccctttacttggggctgcaaaccaagattgtctgcttgcagaagaattagtgaataaatccatatacacaaactatgtagaatacaccttcagatttcaagtgcattttgagaagaatcacacaattaatccatgtatatatgtgtaatcttattaaaagaggcaagaagcaggctgcttggactgccaatgattgtagtctgagcataggcagtaagaaaacatcaatttaatgggactgtaggtagcaagtaatacaccacaaattacatattaactgaaacctcggttatgttatggccaaactgaaaacataatacagcggctagaagtaagagtagaattgagtggaaaatttacccatatcatgaaatccaagggatgtacgcaaattgtctctctctgaattgatactaacaaaaaggtgtcaaaacagggaagaagcccatgagtaccagagcacttagtaagcccaattacaccaacatcgcaatgatctccaactgtccaaggctgaaaaagaaaagatatcacattatatgttaaaaaccaccaccatcaccaccacaaacaagtgagaactgtgtgccttgaaaaggaaaattacaacattacttgattaccaatagtcaggaaaaaaatatgtatttcaagggagagaaacactaacaacgtccatgaccaacaaaagcccatacattctgtgtaacttgataagctcaagcaatggagcaaagtcaccatccatgctgaacatactgcattttatcaacaagaagatcatctgagttggttacgctagccattgataccaaaataagtgatttttgaatgaagaaatttacttggaaatataacttgtctatgtgcgaaaaaaagaatattttccattgattaatgggacctgctagtgtaatcacaaacatagtttataactaaatcaattagtgcttaacattatgacatgtatgttacgactgggaagtgaaaaaaatacccatggatttttttttaagtcttacacttactggaggatgcgaagcaagcagagtttaatctcaatgacctccgattgtccaaggctgaaaaagataagagattacattatatggtataaaaacccctaagagcacaattcacattttcaggttaatcaagctaagccattaaatgaagcaaaaccaagcatcagcgcgcacctataacataaacacagatatacctcaaggatgcccgttgggataaaaatttggacgggtaaaacatcacaaaggagatcaaatggcagctacaattaggattgccaataaattaatactcacatgggaaatgagcaatgaaactacacccgcagtgatccagttgagcaccgtgaaattatttaggttacatgcagatgaaactgcagagcatgaaaacaaaaaatgaaaattaaatagcatatacaacatctgtaggaagttcaaaatatcatataacagcaaagaatcagctatagtacatgcagccaaagaagcaagctatagaaggggcatgatttaaaataatggtgttagtattagtacctaatggcacaacggttatcatgtaagtaaatcaatattcctgtcatgcttctgcttgcctctcacctgcaacctttctcaattgcttgtggaggattgaacttgtaacatgtactggtagccaagctgaataccagatcagagaacattttgtattaacaaatctgatgcatgaacattaactaatcaaaactgattgaatggctgaacatatatcgagaagggaatataacatcacatagcgtacggagataaataaaaacaactatgtaagcagcaatcaccaaatggcacatggaccagctgatatatcagtggagcatagaaaggaaagataagtggcacaaaggaaaaagtatattactatgaccacatctgagatgggtaacgtaaggaaagataagtataatgtaaaggcatccctttcccttttcctttccctttcctatgcattctctcaaatatccaatctaaaatcaaaaattgcaatccaagaacaagagaaaacagagattggcaggtcctagctcactcagctcttatttgcagtgtgcttctctacttagcagcttagacagaggcatgcccattatttgcatctgagtgctgtggttgtggaactccttacctcagtgccggttggcgggcgctgctagcctacacctcatcagtacagaaaaacaaaaacaaaatcaactccccacaacattacaaattgatgcgattatattacttcattttgccttcacttattagatcaccgaacatcagtttattgggaatccgtacctgcaaacattgccaaaaccactcaatacaacaggaaaacagtaggtaatgtcagtgctacaaatactatcacgtcattaacctgacaatacaactgaccattctcgatgatacatactgagcaatgaaacatgcagtaaaaatgtggaaccaccaactgttataaagtagtaatatctagagcattagcatgtagattagtatgactaatcactaacgagaacgatcaaacaacaatacacctgcgtgcaacaattgcaatcacaggctcgcagttaccacatgggcaacaaacacaatcgtaaattatcagcatcagtctatcactaacaccactaacaataacaaccactcaccaagaccatgccagagtggtcgcagaatgaggaaggtgaggccggcgtgggcgcggtggagagcgacccagccgcagaggcgcacgcagcggccggcatcaccggcgccgagctcgtcacacagctcgtccctcgtaggccactgcagcggctgcagcctctcgagcttcgcctcggccgcggggtcacggtgttggtggccgctagggttcggagcggagacggtgagcacgaggcctacgtggtggaggtggtggtggagagcagaaggaggcggaggaggtgcgaggcgggcagcctagggttgagcggctttaggcgggagaggaaggagagcggcgaggcgcagagaagagaggaagccattagattggacttggagacggtgggaaagcgagtagacgaagagaagggggcctgggttttcgaggaggaagacgagatggcatcggatccggcggccttgaggtcatggccatcagatccggccactccgatggcagcgagcgggtagaccagcaagttgaagacggcggttgtcagactcgtaagaagaatggaggaaatttcagaaagttcagagtttcagttaactgaagatgcaaaggagggagaaaacgtttcatcctgggtaatgaagatctaagagatgagacaaagccacgtgttcgagagagggatccgacggtgttaacgtcatgagaagccgctgtagctatcaaagcttgtcgttttgctctttacattcactgtaataattttagctgctgtaaacttacttaagctggcttttgctgtgggaagaagataagaagaatcacaatttctatttgtcttaggagtagctaacttagaaccctaggagatagtcttgcggcggccacccaaatcctaccaaaattcacaaatcgctactctgtttctccatttctggttcagggttctgacagaggtatcagagcacgagcgaatccttggctcttggatctctctggtgaaggttggtggaaggcggcggtgagatccaccgtaaaattcctgagctaggagggattcaatccggaggcgagtggtgcttcagatcggacagcaagggttgggttgccaccttcgtggtgtgcacctgtaaaatctccggcgcttctgatttgaggttggcggcggtagatccgactgcaggggtaataggggaggaatcttgaattctgaacctaacctgcaggggcgaaatggtgaccaagacgcgctcaaacgatgagattgtgggactggaggagatgaatgagtttcgctcagatgtggcatctctgaagaaggaagtagtagagcttaagggcttgaggtcataggtgaaggagatcaaggaccttctgctggagttgtgcaaacagaaggggaacgagggacaggagaatcctgtgggagatgctgcaacaaaagagaagagcacgggagaagcaggacccagtcgatctgtgcaggtaaccacgcctagtttgggagttcagttctctattgaaccaaatactatgagcctatctgcacctatgggtcaagaagctagaccacaggggggagtcagtagtgttcagacagatttggggcaggtgactactgtattatcaaaacctccaccattcataccatttgccccatttccaaaccagagggtacctttcttaaactcagctccttttcaaactcaaacaacagttgggggaagagtgcccaattcaaattttcaaacacaagggacagccactagctcaggcactgggcaacaaggggttcacatattagatcatagcagacctggtggtatggtttatcaaggagaaaatcaacattatgctgaagctgtaatcaagggacctcggttggaaataccactgttcacaggagaagatcccattgactggttgaagcaatgtgagaaattctacgagattactgggacaccatatgatcaatgggtcaatctggcaattgcacatctgcagggaagagcaatgaagtggtttagaggagtaggtattccttggcagttgattccttggccacaatggtgtcacatggtgagcactcgtttttcggctgcaaatgagcatgaggcagtggaactattccagaatgttaagcagtatggttcaactgtggaacaatatatagataaatttgaggagtatgtggatctagtcaggagggaccatccttacttacaggaacagtatctgaatagctgcttcattggtgggcttagaggggatatcaagcatgatgtgtgtgggcaaaaaccacaaggtctgttggagtcctattggtatgcaaagaactatgagaaggcagctaatgcaaggaaggtggcactgaatttcagcagaaacagaaatcagaacaccaatttcaacaatcctggcaggaacacaaataatagaccacaaaggggtgatggtgagaagaaagaagacagaaaatgctggttttgtaaggaaccatggtttcctagacaccaatgcaaggtgaagcaagctatcaatgctttactggtagagaatgaaccttgtactgaagaggaggaggatgaatcaaaagagaaggaacaagaggagctggccactgaccaaatagaggcacctaagcaggagggagcacatgaggagttaatgagtgtgtcatttagtgcagcttctggcacaactcggcctgatactttttcagtcctaatcatgatcaatgggaaacaagcagttggtctaattgatagtgggagtactgggactttcatgacccatgagtttgcagttaagtgcaagtgtcctatagcaacctcgactattaagaaggtgatagtagcaggaggaggagaattgaaatctaatcttgtagtcccagaagtggcatataaaattcaaggggtgaaatttgttaatgctttcagcttgatcaccttgaagggatatgatgtaatcttgggggcagactggatttttcggcatagtccaattactttggatctcaaacagagggaactgtctatcaccaaggaaggtaagctagttgaatttcaggatttcactaaacctgggaaacatttcttaattgatggtcataaaatggagaagctgataaaaaaaggagctgtggggtgtgtgttacaagtgaatgcgatgactgaagaagagaggaaggaggaggctgcagtgccagcagatgttcaggaagttttatcacagttcccaggagtgatgaaggagccaaaaggcttacctccaagaagagcttgtgaccatgtgataaacttgaaacctgggtcagaacctcccaaccagagaccctatagagtgccacattaccaaaaggaggccatggagaacatggtatcagatctgatccagtcgaaggagattaggttcagttacagcccttatgcctgtccagctgtaatggttagaaaaagggatggatcttggagaatgtgtgtagactaccgacagctgaatgccctaacagtgaagaacaagtttcctatgccaattatagatgacttgttggatgagttacatggggctagaatattttctaagctggacttaaggtcgggatatcatcagattagaatggctgaggaagatattcctaaaactgccttcaaaacacacatgggtcactatgagtaccaagtaatgccatttgggttaagtaatgcacctgccacttttcagtcactatgaaccaagttctagcaccttttttaagaaagtttgttcttgtgttttttgatgacatcttgatttatagcaaaacaagggaggaacatatcaagcatatcaaggcagtattgcaagtcctggagaagaaccagttggtggtacggctaagaagtgtgcttttggtctgagcagtgtggcttactt

SEQ ID NO: 20805 - DNA, 6209 bp, Oryza sativa
tggtgcaggtgtttatggataatattcacaaactgcatgggatgccgatagctattgtgacagatagggacagagtttttactagcacattctttcaagaagtgttcaaatctcaaaaggtccaattgaggtttagcacagcttaccatccccagacagatgggcaaactgagagggtgaaccagtgtttagaatcttacttaaggtgcatgacatttcaaaaccacaaaattggtgctcttggatagctttagcagaatggtggtataacacaacataccacacagcaatacaaatgactccattcaaggccctttatggatacagtccacctcaaatcagtgaattttctgtcccatgtgatgtatctcaagaagcaagggtaaccctggaagagaaagaggctatagttcagaaactcaaagcaagcatggaagatgcacaaagaaggatgaagtattatgctgataggaatcgaacagagagaaagctggaggtgggagatatggtatatctgaaactacaaccctatagacaaaatgcttttgggatcagaggatcattaaagttaagaggcaaatactatgggccattcaaggtgctagagaaggtaggtgctgtagcttatagattgcagttacctgaagaagctgctctacatccggtcttccatgtgagccaacttaaaaagcacctgggtactcatgctgtaccaatgccaaatttaccggcagtgggaccagatggtcaaatcaaaacagagccagtagcagtgctgcaaaggagaatgattccaaggaacaatgttgctgtcactcaatggctaattctgtggagcaatttaactccggctgaagcaacctgggaggatgcttcttatattcagaaagtgtttccaaattttcaaccttgaggacaaggttgggcttaaggggggagtaatgtcagactcgtaagaagaatggaggaaatttcagaaagttcagagtttcagttaactgaagatgcaaaggagggagaaaacgtttcatcctgggtaatgaagatctaagagatgagacaaagccacgtgttcgagagagggatccgacggtgttaacgtcatgagaagtcgctgtagctatcaaagcttgtcgttttgctctttacattcactgtaataattttagctgctgtaaacttacttaagctggcttttgctgtgggaagaagataagaagaatcacaatttctatttgtcttaggagtagctaacttagaaccctaggagatagtcttgcggcggccacccaaatcctaccaaaattcacaaatcgctactctgtttctccatttctggttcagggttctgacagcggtgaagtcgacggcaggctgaggatggcgacgagggcggcgaggccagtagcccctgccatatggatgtcgtctgcctaagccaccgccgatgtgtgccaccacgaagcaccgccttcgcctccccctcgctccgtccccatcgcctcgcgccaccaccgcccactcgcgccgccgctaccactcgcgctgccaccgccgccccctcaaaccctagccgccgccagcctctcccacgccgccatcgagcgccgccgcctccgcctccccctcgtgacatccccgtcgccgtgccccgccaccacccccgccaacgctgccgcctccacctccgcctcgtatcaccgcggaggccgtgcccggtgacggcgacggcgttccgcgaggggaaggcgctcggcaacggcggaggcggcgacggcgacggcgtgagacagaggcggaggcggcgctcggcgacggctccgtgagaggcagggtgagacgagagggaggaggggactggcggcggcggctagggtttgtgggagggggagtggtctagtgcacgtagttttgcaaaaaagcccctcggttttcactttttagagcgcggtcctaaatcacgatttttctctccttcgcatggaatatccgtttttctgaaggacctccacgtaaagtaacacctcatggatactgtttgtgagggacctcgatcgaattacgcacaaagaggagggtttttttcgcaaaatcgccacccctgcactgtagctatccgacgtggacacgccgagcagccgcccagcccgccacacttaatagtttgggggtaattgtgttcttgtccctatttacaactgcaattgtgattttacccttgtatttttaactctgtgattttaccctcactattttgaactgaagctcaggtatgccctgttccgttaggaggacttaatggtgttaactgacaggtaaaaggacatctatgcccttgcagatttggcttgtgaggactttgtgttttggctgtgtttcacgattacagtagaaaacggaggtatgaacttgccctgcatgcttaattattttaacaacgaaatccaactttgtaactacacaagaaatacgattctccagcatatgtttaaaaaaaatcaagggatttattaattaagaaacactatggactgaggtatgaattcaatgcctcaatgcctgacgtatgaacttgccctgcatgtttaatcattttaacaacctaagggatttatgaatatgcaaacaagaaacactactctcatctctttctttcaacaacagaatagctttgttggtcctgtccagtttaggaaccaaccaatagtccaaggcagtaagaaaaataaaaactaaagggggagtgacaaagaagaaaaagtaaaagacaataaaactcaaatgttcctctcctcctctccttgctgttcttctcctccttgtcaccatcatgcctcaggcgagctcctcgcggccatgctaatggtggcaaggcagcctagctagctacgcatatgcagcagtacgtatgtactcgatcatctgctgtgcagtggttcgggcactatagccgaggccgatgccgacgagcccagtgaccaccacggcggacggcgacgggctagctcagcttgacatcgccatttcgcgccggcccagcctgcttcaccccgcgctcctcgctcttctcgcttgcccgcgtgtgccgccaccgctcgcgagggttaggaatcggggacggaggtcggaatggggtatggggatcgggaggagtcagcagtggcttaggttgaaaggtttgggatagagatgtctttttacattttgcaagtcaatttcttattttcttaaactcatttaatctgagtccacctaacagacgtttaaaccaggggcaaacagaccattcaacatcaaaaagtgagggcaaaatcacaaagtttaaaaagtaagggtaaaatcacaattgcaaataaaagtaggggcaagaatacaattgccctaatagtttctaattgttagtgtcttcaatgaggctgtacaagaacctgagcacgggtgaaatgtgtaggatccttggtaaattttgttctaggttcgctgctgaccacggctggctcatgcatgcatgctgttgtcatcttgtagcgcatctagccatgtatcagtgactctagtttgattgttttgacgaagatcattttagtacctgccgtctatttgattattgtacggtaaacagttatcaaggcttcatggctatgccatttagctttgttaaacaataccagatagctcataattaattaagataaccaagactaagaaaaaaaacagagaacaaaggctacaaaattataaatactcaggtagatgataattaagagaaccagagctacaataccagatagtacaatttttatattggaagctaagctacaaagctaaaagttacattcacagacactatacattcataaatgatgtaccagttaatgtcatactccctccgtctcaaaagagccaacttaggtaccaatgagacattacatagtacaacaaatctagacatgtcccatctgtacttaggttggcttttttttttgggacgaagagagtattttcgagcctgaaaaacaacgactagcatgcataatgtgcagctttcagaacaggtagtttgtgatgccatcccatcactagcactagcacaaactgagagcagacatcaacaaaaacaccaggcattacagctaaagttccaggaacaaaagtacaagtttaaagctctaatgttcagcaggcactttcagcgcttgaagtatgtttcttgttgatctccctcctgtattcttcagatgttgctcccttctcttccagctgatcattgctccaggctcctggaattcagccttcctctgtttcacttttcctccaatttctgcaaaggtaaccgggatttaataccatgtaaagtataatagacaaggttagttggattttaaggcatttttctgcttaaaacaggctgcatttcggttttccagatcagtgccattattcccatcatcctcttgtcaagtttgtcaatgtctctatgaatcaacagcttcaataggacatttgcaatggcatgtgaaactggtttctcagtttaaatatgagtaatctcatatctcatccagtaaccttgcaattctgcttacagcttcatgaactctcttcctccatgttatcttcactatctattaactgaagtggtaccttttcttttacgtaaaactgatgtggtaccaatcatgcaaaataagaatctgaagaatgcaaatgatagcgcaagaataagaggtgaaaactatgaacaatatagagtagcaggatcttataatatactcactaaaaacagataagatgtatatatactgctccaaacaaaatggcataggagaacaaggttcaggaatcgggagatgaattagcttaaaaacttggtagcttcaaccgcacattatttacttaaagttaaagaagtgatcatgaaaagaatcaggtagtaatccgtagtttttttgttttttttttggtctaccacaataaaaatcaactaattggaagcaacagttagcataacgtatatgcatcaaatttctaacatgaattcacaagaacttgtactaaattactagaacaacattatgttgagtgagtaggcaggaaagtttttcaatacaatagacagcaagaaaaagcgcaagaatcttgcaagaactgaaacccaacagcttcgcctcacagatcaatcattcaatccccaaatataacatccgagaacaatttcaaatcaaccgaatcgagggcacacaatcccacgagaagcatgcacagcagggcagggagagaaggagatcgaagagattgaggggagcgaccaactcacaagttgacgacgagcgacggggaaggtggcaccggtgaagggaggaggacacaggggaggtggcaccagcgactgatgggcggcgagcggaggaagcggttgtccggccacgggagcggacggaggcatcgtgttgtgtccacagctcggcgctaccgagctcgccgccgtgcagcaccagcccgcgatcgccaccatcttcctcccgaatccaagccccagcagccaccccatcctcctcccgcacactcctccttcggtccttccatcgtggccgcggcggcggggagacattttctcaaacagctcgtgggcaagccagccgccgcccgccggccttgcacaacttcctccgcaagtcgcatcccaccggggggtgtggggcccacaaaatctcagggccggacatggagcaaatggtcccaggtgacgtggtccccacgtaactaaccgactgccagatcagatcgaacacgcaagccaagcggccaacgccacgtaggccggcgacggcgagagctcgagctctgccgctgtatatattcgctcgctctcgtgtcgccgcagcgagcaagccgacgccgccctcgcctcgccattcccgtaccacaagtcttggtcgacctcaacgcaatggccgacccgtcgcgatccaccagcagcggggcggcgaagaagccgtcgccgaggaatcctcggtgcgccgcatgcaagtttctccggcgtgcttgctcgccggaggagtgccggttggcgccccacttcccggccagccagccggagcgcttgcagagcgtggagcgcgtcttcggcatgaggaaagtgctggagctggctcacaaggccgggccggaatacctcgacgacatcctcagctccatcgtctacgagg

SEQ ID NO: 20806 - DNA, 23508 bp, Oryza sativa
  unsure (1)..(23508): unsure at all n locations
gggaggagagggacgatctcatggcggctatcgtctacgaggcggatgcttgggccagggacccccggtacggcgtcgccggcgtcgtgcggagcctaacgaacgagctcgcccgcgtccgcctcgacgaaatcgccttccacctcctcggcaccgacgagacctacgacggctacaaggaggaggacgcgctcgccgtcgaccccgtgagcggcgcccaagcgggcatcggggtgctcggtggctcgggcgcggacctccaagagaataccggcatcctcctcggcgccgacgagccaggcccaggcgagctcgccgtcgacccaatcaaagacgtcttcgacatcgacaggttactcgccgtcgacgatgacttgtcctccgggacccagccctgataccaccgccggcgacaattaatggaaggtacgtcctgtccgatatccatcaaaatgctttcgttcctcgtaatcatcatgctttggtgaattcttgataacctagtcccttcgattagaaatcatgcataaacacgactagtgaatattcttgtaaaacatttgatctacaccgaaattccccttagttgttgatgatgtgaacttcttgcaagacgataaaataatcaagtccgtgatgggaaattattgtaaaccgaaatttttgcttctagaacagttcggccctccttttgattgtactgctagagatcatctcttcctctgggagaagcaaaatactgaagcttttccttttcatgttcagaagttgcaaaaaaggctcatgtgcaacagaacagtaaacttccttgagcattgaggagataagtagataacatatagtgctatatatcagtcataggcatcggaatatcacaggaattgatagacagtgtgttccttgcaaactacagcatgttcaacacttatttacttatttggtgaacagaaaattggacccacaatgaggtgcctcaccagttaccagcaagtttgctattgaacttaaatgtcgctgccaatttgaatcaatagggcgtattgaattatgttttacaagttctagttttatgcacacatgtttgatcccttccaacagtgttacaatcatcagccagcaggcgatcatctggttggcactgagaaacagcattttaactaaagataatttatttgaaagagggtcttgaaaaggaagtaagaaatgccaattttgtaatgaagaagaagcaatagatcacttgttctttaaatgccaattagctcggtttgtgtggagtgtaatgaactgtgtttttgcctgtggcattccaaatggaatgagggatgccctgggagaatggatgaaacaatttaataggacttaaaactggggggccagggggaatgggcttgcctttttttgggcaatatgaaaatgcagaaataaagcttgttttgaaaatctgctaccaagagacccgttgacattttttttttcagattactcactgtatatcatcatggggaatgttgcagagcaaggaggacgaagcagaaaaggcaggtagaaatgaggtgtatggactgcagcatggatggtgtttgagaagaaggatacaatggtcaagatgcagaatgggtttttgtagcctggaatgtgatactgccatgaccatgctgctatcttccatgaaagatgcagaaagtgttcttttgtcgcctggaatgtgatattggggctcgagaaaatggatatttggctacgttcaaaactgggtttcgctattatgccatcctcaaaacgtgattcgataaaatactatttccgagcacgtattactcgccaaagtgccatttttgctgttttattcatttccaaaacgaatttcactcggctgtggggtgatgagacgaaaatgccctgttgacaggtgggaccccgggcttgttatccccttgcagcgagctcaatctttatactgtacagcaatgaatggaaacgaagaattgtcgtcggcgcgccgcacggtggcctttcggtagaaccacttccctaccaccgaccccatcataaacaacatcgacattgccacgatgtctcatcccgcgtcgtcaccgtcacagccagcttcttcaccgccgctgccggcttcttcacgtagatctcatctccccctcccccacccgcctcttctctccctcctgcagagaaagaagtgtccgcaaacgtccccagcagccgccgcctccgcccccttgagctccttccatctacgtcgtcgccgtcgctgccctccttgagccccatcgccgtggacctcccaccaccgccgccgcctcctacggacgcgacggtgattgccgccaccaaccacctgctccagatcacgcgagcctcgcgaccgaagagctccgggcgcaacggtaacccgccggtgagggagctcgaggagggaggagggattgccaggagggaaagggatgaagcgtcaccatccgtggagataaagaggagggtgggacccactgacatgtgggccctagtaatttgatgttttgtttgactgacgtgtgggacccacatttaaaaaaaaatcaattgcactcctagtccacgtcactaccacgcaggacaaagacgaagtcagactagtcacatagacgccacgtcatccaaaccgccttaaaactttatgtgcactggttttgtaagttgggggatgccttgtatccggttttgcgcatcagggatgaaaatcaaactggacgacaaattgagggacctaaagttcagactggcgataaattgagggacctaaagtgaacttattccgagtaaaaatgggtggacattttatattcaagaaataataataataccagcaaactttgcagcgaagttgcataaacacaaacacataggaacaattatctctgtaattcgcagatccatcatattgtcacctgttctaataacttaacagtataaagtattcacattgataagactggcattcgtatttttcctcggctacattgcagagacagtattgtatatctaacatcacgatttttttgctgcgcccagcagaatttacagtaacaaatcttcaatcctacaaactcctggcttgcattacctgagagtgttcgtttcctatatttaagctctgttccaggagcttatgctattcatagtacagacttctatcgaagtgggtaattgatatacagatattcagacgttataaacacgttccactattctaaggacagattgtattcttctcatgcctctagtgttccacgaactgcatcggctccacaaggtatgggcagtcatcaacccaaccacaaggccttccgacgaactcctcgacatcgaaggagccaatcccagccttttcttcctgctccattccagtttcaggtaaggcgtccagctcttcccagacatcatcacacatattctcaatattctggaaattgcacattggagtggtctccactttcccaactgtgccacagccagtgctccctggagaaacatcagcttccatcacagatgcagcttccatacctttgttcaatggcgaatcagcatgctgttcttcgttttccatcagccgttgtcttttcgcggcgcctcttaggccattcttattcacatagttgagtagaacctgctgcacgaaagccgggttggtgagtaccttggcaaagaagccgatggtctgctgttgccttctctcgatgttgcggaccatctcctccatggcaatgagctgagatttacaggcgttgtactgctgcttaagcatgatgacctcagctctgagggctgcacggtctctcttcaagctcacaacctcaccaggagcctcaggctgtccaaaaacaacacttgctttatttcttagttgtgaatccacgagaggcttggaaacacgcctcctcttgatgtttttcagcaaatgcttctgaccagctaagaaggcttcatttgcaaactcccaccgatctggagtgacctttcggaacccctgcatagcaacaacaggtagaggccggtaagtttttctagaagcagctgcagggaaccaaacccagtctagaaagtcagcagtatttagggattgaaaactgtcaatggtaggtatacgcatattaacaaaagaatcagtctatggttttagtctatcagagattaaactagcaatttcacttctgtgttctaccgttgaaccacaggaccagcattacccagaagctagaaggttcagttgcctgatatgaaatgtctatttacagcaagaaaagtatatagataatatcaaaacagcaagaatggtggtgccattagcaataaacacaaacaggccaaataaccgagaacacactgctagataagctcattgacaagaacaaggtaactgttctgtacttctgtagctcattgaatcagataagctcatgtatgtacaaaagcacggagctccacatcatcaaaaaagacaaaagaaaaagtgggggagcatagttcacctagatcatgttaccatcacctttcccttttaactattaaaggtatggacaggtcatgaggtattaggtctttcagagtggtggaaaaagacttcaagatttcgagtacgacatacgagctacctggacacttgtaatgcccacaagaaggaatattatccactttaagtattttagggatcagtatcttggattgcaacgtgaacagacagaacataggtcatatccagtgacagtggagcagatgaaatccaatccaagtgcatcatcacaaaggggctaaaaaccaagacaaacatttgtcccgtagtacagatggatgcaagtaactagcatgactttgcatcgtacaatacaagtataccaccactgaacattcagcatcctacaaaaacatggctgaggatttcagtttcttggtaagacaaaatttctggtatgcaccatcctaaactagaggtggaacaaaattgtatatacaagggatggttctataccatttgcagtccaatattaaccaatttaggcatgatttttaaattctggtcaaacttctagaattctcctgctattatcaccaattttgacaaaacaggatattgtatatgcgagcgcattcgtggacacgaacaaaccacagcataggacagtaccagttcatacatgatacgattcttgattagtacggaaacgcagcaaggatttcccacgaatttggtatcactccttttcaaatttcattctcataatcagttatcttgttcgatcaactaacaactattgtctcaccagcatcaacgattcaatttacacgggaaacagaagcacacgagaccgatcagcggttcacagaaagaacaccacccacaccacaagcagcagatcgggcgattgggatacgtacgtaggtgttgagctggcgaacgaaggaggagaagttggcgtgcttgaagaagcgcgggagcacgccggcggcgagcgcgtgcgggtcccacaccacgaaggaggcccccgagccgccgggcccccacgacaccaccgcgtcggtggccgcgtccgccaccatctcgtacgtcttcgccacgaacggcgccggccccgcctccccgagcccctccatcggccgcggcggcggcggcaccacccccagatcacccccgccccacccctcccccgcctcgggcttcacctcccgcttcaccggcgccgccgccgccattcccccctcccctcctcctccggagaagcggcgggtggtcggcctggggatgagtagtcggcagagggaggaggaggaggaggaggacgccatgtgggaattgggatgcgcggcgcggcgagcgctaggtgtttggggtttaagcatttgacacgctcttcgcctccgctataataatagtagagaaagccgttggttaaccccacggggggaaagcggtggcaatgcatggctaacacgagggcacggattgccacctgactcaccaccctcccctcctgctgccgcttgtgtgcactactagcaagtgttttccacgttcacactagattcattaacatcaatattaatgtgaaaaatgtttacattgtaaaagggagggagtagaaaacttctctagataatgagtgtgacttaataccacatccgtcccaaaataagtgtaatcgtgagtatccgtgtcctacgtttgatcgtccgttttatttgaaaaatttataaaaaaaattaaaaacaattagtcgcacataaaatactattcatatttatcatctaataacaataaaaatattaatcataatttttttaaaaaataaaacgaacggttaaactttagatataaatagtgtaaaactgtggacggagggagtagtttatacacatactcctttcgtcccaaagtaagtgcagttttgtatgattcatctccaatgtttgaccgttcgttttattcgaagaatttttatgattactgcttttattgttattagatgataaaacatgaatagtactttatatgtgactaatttttttaaaatttttcgtaaattttttaaataagacggacggtcaaatattggatatggatttttacggctgtacttattttggtagagatgtagtatatattgatttgaaagaagcatgatgttggcagttttaagaagatgatggtacggactacggagaggttgccagttttaagaagaatataagtgtttgtgtctcgtctacaagaacgtgcataaatataatggtttggtagagggactggtaaactgtagaaatgcttttaaataccgatatgtctttttgtaatataaaaattcaaccgaacggtttcgatcagcccgggtagctaatattgagattagcataatggctatcacgtacggagtagctcatatggctatcgtaatgtggccaatggcatgattttcaactttgagggccttttcactttgatgtcattttcaaccttaccaagttttgataaagttaccaaaaaagtggttacatttagtttactgccaaattttagtaactatataagaaatcctgccaaaattttggcaagttaccaattttggtgccaaaatttaataagtttttttttttttgcatcaaagtgaacaggccctgatactttgagctacaaccgatgagctgtggaaaattgaatgaagttgcatacgatgaaaaactttaaaatcaacttaaaattaggtcctaaaattatggctgataaactaacaagatgatgagagataatataagagaaatagaaacatctagtcataagaagaatgaatagaaaaaagaagagagaactatggtattgtcttacacatcttgaagatgttttcatggctaggccaaaaaccatttaaattttgcgaaagggcctgtagcctagtggttacaagagcctcactagcacctgaggtcctgggttcgactctccatgggagcgaattttccaggatttaacggcgtcgtgctttcagtggtaggcgacgtacccgtcgacagcgagacgcctgtggtgacttcgtcaatctctctagaatttgccggcccagtcttcgaagatgctcataggggtagggtttacgtgcgtgtgttcataggggtgagacgcctgtggtgacttcgtcaatctctctagaatttgccggcccagtcttcgaagatgctcataggggtagggtttacgtgcgtgtgttcataggggtgagtgcgcatgcgttgtgagtgtctgcgttgtactgtgtaattctaaaaaaaaaccatttaaattttcaatgagttttagacccctttgaaacacataattagcaaaatagagaaacagaaaaaaaaatgaagaaaatttacataaatgtaagtgcaaatagaagattatgaaaaaaaacaataattatcatttggataaacccagaaaaaacacaagaacgggtcgagagagataaactcttctaagaggttaaaactcttactaattttcttcaaaatctctaagaccattcattccatacaaatttaaaagaaattgataagattcaattaattgattcgaagttctttatagaaatattttatatagaattaaaatcctctaaattttctacagatggggctgcccatgattatactatccctccaaagttggtgcacaaaacaacaaaataaatctagctgacacgtgcgagctcacgactagtccgtctagctgacacctgcttgactgctttattatctcgagtgcagcacagtatctccggcaagtcatccgcggcaggcacacacacactggtatcgcctccggagcatccacgtacacaaggctacagccacgtcgcacaagggtaggggagccaacgaggcacagagccaaacaacaacctgccatgcgccgcgcaggcagcgactccatccccggttagtcatcaaacccaagtattttttctatattttttcaatggtttttttgaagcggcggggtacgtgtagaatttcctgacgaattcatcggcaacaggagtccgcagcttgcatttttcttctcatcttctgcttgtcattcaccagtctgaaaataaaataatcctggttggatacgcagggaacaagagcacccaacaagcaaagctcagcatggcgtccagatgagagatcatgattagtgttcacgaataaactactagcaaaagaatggttgaaatggattcaaggacagaaggcagtggttaggagagccaagaagcgcacacagacggctgtttgaagttgaaccctgccagctgcgattgtgcagatgttggatgtgtaaaaatttggccaatcagtccaattgcctagtttatttcgtaaagataattcggtacatggcactactgcttctgctgcagctgtccctccacagtgagggcggtaaagggtgcagaaactgtgagctcttagatgttcacgaaatggatgatgtgaaggtgcagaagagctatgggtttttcgttacactgaaattctgtgcctgcccttggcaatcctgcgcgcaatcaccttacgcccacctttggttgattttctattgatgaaaaagaaattaatggaatatcaatgcactgaacacaagcacctgaaccacaattatgttccagaaaataccaacaaaactaacactggtggtatgattggattttggtattcaaaaataattttcccataacaatgcagtacaaaagagaatgatattaacttgaaaaacatagcatcttttgcaggggccttagcacaagcaaaacaacggaaagttcaatcagattagtagatatcaataccgtgtaagaaacccatgggttcttttccgcttgatggtactgggctgataagttctttttggaagtagctccaggggttcattagcaacaggatcctttcctaagaagagcaaaaggaataagaaacaaattagaaaccatggagccagtctgattgatgtaaataaccatttcgccctagctcaccagatcacaatcatactcctagaagctaacttactagccattttagtagcattcatgtaacaaataagacaaaacttgagcagcagtacaacaaacaatattatatgccaccacgcagataaacccagattgcaaaatatgagttcttccctatttctcaaaatatatatggccagaatttagatttgaagtaattaaaccacaacatcataagttgagttggttgtattacggttatgtatgctaactttgagttggttggttgatgggtaactgtgaaatgttctgcatatgatgaagaactaggtcccgatcggtgatgtcctcataagcatatctctggttgctattcaagctaagaaattgcatccaactattcatgagattgaaaatagcatatactgtattacaattattgcatgattccatgcataatatggtgatcattaagtaaaatctgaaggtaattcgccaaaccacaatatgaccaatatcactatttgaaactgcaagtcatcttttattattttcataaagctgttggtcaagacctggtccatgttatagattaacaataaaaagagaacaacagacagtagtacattctatgattcacatgtgcaaaacataacaaaattgcatatcgatgacaactccttcacaattgcatgatatacaacaaaaagggaaacaatagacatcttctcaaatcataataactccaagcaataaaatagttgccaataccaaatgctacaaagaattaggctgcccacgcaccaaatcagccaaaccaagggacattaactaaagtagaattcctaaaccactctcacagcattgagcaaatgaaccaaatttcataaacattcacactggatcgagcgcacgaagcatgatatgaacatattatcccaattcattcgtgcacactccgcaaggcctcaaccatagtacattctatgattcacatgtacaaaacagaacacatgtggaccagatcgaacaatcacacaacttatcatatcaatgacaacttcttcccaattgcatgatataaaacaaaaggggaagcagtagacatcttctcagcttataataattccaatcaataaaacagttgccaagacctaatgccacagttaagcagtaaaaggactgcagagaattaggctgcccacacaccaaatcaaccaagggacattaaccaatgtaaaattcctaaaccactctcacagcatcgagcaaatgaaccaaatttcccaaacattctcaccggatcaggcgcacgaaccatgccattaacatattatcccaattcattcctgcaagctcctccaagcctcaaccatagctaataatctaagcacaccaacacgactgaaaccaaacagagcaagcatttctgtcgaaatcagataccggcttcaactcattatgtaatgtcctgcactatatgcatgaaatggcatggtaacgattctttccctccttatacatcccccgttcaccattgatccaacaaaaaggataaagctaacgcacgatccgaatactcaaacaatgcagcggccatcctaacaagggaggagaggaccgtaccgtcttcgatgatgaaccggagcgaggggaggccgcaggggaaggagatctctcctgggagcgagctcagcctcgccaccgcctgcgcctcgtaggcctccaccgtcgtctccggccgcggctgcggcggcggcggcggggggacgagcggctggatcctggagagcagcgacggcggaggcagccccgcgcgaaggggagacggggacgcgaggaggcggccgaggagggaggagcccgcccgcgctagggttttcgccgacgacattgccgaggacctgagaaaccctagctttccgccccactttctgctcgagctaatggtgaactggtctcgggccaaatgggcctaattgactgtgtggagtggagcccactttagctagctaggcccaaataagaaaacaagcccagccaatagcagtggcctaactgtgtgacttttttttttctaaagaaaacggtaaatttatcgggatgacattagtactccctccggtgccaaataatagtcgctttagattaagaaacacagtaaaaaaaactaagaaaataaaatagtcttttttcttaaaaaacatagtcgctcacagcgtgcgggtacaacctgtccttaagcactgaaaggacctttatatcgcctagaggggggtgaatagacgtttataaaaattatcacaacttcatagcatattggaatgatgagaattttatatttaaatcggaacttccggtatgtgattcgaagttccgatctcaacagaaaagttaggcggataacggaataaaacactagctatgaacttgtacctcaaacaaacaaaatgtgtatgaatcaaaatgtgacaaataaggtatctaagtaagatataaggtcaccaactaaatcaattaagcatgcaagtacatcgggtaaaaataagctcaagcacaatatgagagaatgcaagaatgtgcaaaccaagagaagagacacgtgatttatttcccgaagttttccgttgaggagctacaagggccgggtctatttcaaccatttcctcacgaggtagcacaaatgtactccttggtttcactcttgattttttctcttgcggaggcgaaattgaagccttcacaaactttccgtagcacaccacaaccttggatgctcaccggcgatgcctaaccgtctaggagaccttagtccccaaaagtaacaaacacaatcgaagatttgcttgctatgaactcgagtgctcaaagtatagagtgaagctcactagctctcaacttctcaatctctcaatccaactctctccccttctcaaattcctcttacaaagaggcaccacaaaggtaggaaatgtggatgtctatttggctttggatgtgtctaatactccccaagaacaacagccactcaagggaggggtggaggagtttatataccgagcctctcaaaaactagccattggaggcaaagactggaattttcggaacttccgaaaatttacagaagctaaactcggtttcgcagccattttcggaacttccgataatttttcggaatttccgaaaagcacaaagtaaaataaccataactttttgctcgggagtcccattttgatgatcttagactctatggaaagctcactcagaggactacccaactcaaccaaaaacaagatctaaaatcacttaaaggataggttaaagtttagatttctctcaaggtagcactatgataggtcactttgatcatcgagacatacacaaacacatcaacgttgcatccctcttgatagtacgggattcctatactcaaatttaaatagtaggagaattgtactaatggaaatgctttctttccatcttcctttcattgttttaagggacgccaacgccaaaaccgtttcaccatatattcttcaaatgattgatgtggttacttgtagcttcaaatggtctcgcacggtccatcatgacaaagccgtcactcgcccttcaccaccggattcagttcttcggcgccaagccccttgcttgcccttcaccgcgcatggttcatcacgaccaagcattgcttgtccttccccgtcttgccatagtagccactttatatcccacatcttcaatatctccattttgtcattcttggtattattaggtgtaatgataccatttgagtatcaacacctttgtaatccttgggaactatttctctcattcaactcaataaaattattagtctcaatgattcggttgtcaacttccacatattgaccaaccgatcgcatatataaaatgagatgaataagtgatgagtatttgatgagtattaatcaacaccacaagtgtgatatactcaaatataaagatctcaattaaatgaaagtgaataacttggatcaagtgcatgcataactaaggtatagaatttgctccccctaaatgtatgcatacggaatgattgtgtgaagcaagagtatgcataaatagagatgaaatattgggatcttatcctataaaaaaatagaaggcgtttatcgaatatagatattagaataaaagcataccttcatcatctccacgtcctcaacgtaaataaactaaacaagcgataaaactcaaacaaaacattagtctcacatgcatatgtcaaccacatgaaaatgttatatatgaatatatcaatatgtgcatggagagaaagagtgatacatatagctcgatctccatgcatttaatccttgtgatttggatccaccatcaatgaacgtttatatctcaactcatatgaagtttgggaatcagctctcacaaatttcactttcatatccacatgagactaagcaaagaaatgcttataaaaacattagtctcatataattggatttgtcattaatcaccaaaaccaaattaatggtacttaagctttctagcaccttcgaaagactgggccaacatatcttgagattgataaagccaccaggacgtcttgttgtcgatgagaatcaatgaaagaataagcatggctctatttacttattctgcattgaaaaaaattgaaagagtcggataagtactcccccgtcccaataacaaagttcttttaatgttctaatataatttaaatattatttgataaaatagtgttattggattgacatttcaaattattttcctgtggttatgattttattgctataaagataataagtatatgagaaatttaaaatcaaatattaattttagaaaccgtaaccccaccttaaagatggaaaggatcctaaaaatcgtaaaataacctctgtttagcgaagagttagatgtctgaaacgacttatatttggtataggatgaaataaagtacgtgtagcgaccacttatcagaaaaatactattaaaaaacctatgggtttgagcccataaaggcaccgaaacttttcatatatgaaagaatgttatataaggaggagaggggcgttcatactgtacatttggtgctacaggaatgaatgagaagagagtctcactccatgtctccacttttataaatattatgcaacccatctgtactacggatgtgctccatccgtttaacaatgtaagactttctagcactgcccacatacatatagatgctaatgaatctaaacacatacatgaagtcttacattgtaaaacagaggaagtaatacaggggttgcgtaataaatacttcgtcaacggtaattttcgtgctagtgacatgctaggtcagcgctagaatatataaatcaattcatcgatgaacaaagcataaaaattagtactctacaaattaacgagagttgtgcatggtgaaaatagcatattccagttgctacgagggaatcaaattaacgttaatccgatataggttttccggattaataatcggtctaaatgcaacacaaaagagagaagaaatcacggagctaagctaagattatccactcgtgcccgtacgcgctcctcgtatacgcatcctactatacccaaattgaaccttcgctaattacgtgcagctaccgaacaaccatgacgattacagcttgtctgcttcaagtaatcaactcgcatttacttctgagatacagattgaatttgaaaaatatgccacatttttagtgacacatcgacgctgttcttccatttgttcgatcgatccatccatactgattaaattagtatcaggaaattgatcactgtagactaggaagcaaaagatgtcagcatcaatccggggtgcttagattcagggctgtaaagttttagcgaatcacatcgcgtactatatagggtgtcgtatgggttgtgcgggcactaataaaaaaaaactaattacagaatataaaccacgagacaaatttattaagtctaattaatctgttattagcaaatatttactgtaacaccacattgtcaaatcatgtagcaattaggcttaaaagattcgtctcgcaaattagtcgcaatttgtataattagttaagtttttagcatatatttattactttatgcatgtgttcaaatgtccgatgtgatagggtgtaaaatttttgtgtgggactaaacagggcctccaattctcgatgacacacatgccatcgatggctcgctaaatttctgattttgattttgatgcccgcagcaagaaccgacataaacgtgttcatcctccgattggccgcgagagacgagcaatgatgatggcagcgggagagcttcatcatcttcttcctcttcctcgtgttcgttaaatccattggaattgatgtttttgcaggtcttaatctctcgctactggctaattaaaagcgtcgtgagctgtctgccggctcctccttctctcatcccctcatctgctcctgcttaattatctcgatttaaggcgccggccgttcctatcgctcttaattttcagatgtttctgtcaatcaggaatagtcttttttttttgttttctgataataggggagatctttggagcacgagttgtttggctatgaaatctgcagcaaaaatgtacatttttcctgtcattttcagtgtttttagaggtgctgtttctgaataacaaaccagaattccatcaaactgcgcagacaaattcatatagcggtgtatgtttctgaaaatgggggcaataatttgtccgggtttatcatttctggcatctgaatgatccaaggttgtatctgaacatgaatttttttcatgaagtgacaggataagataatttagtcacatcaaactctcaagatacacgtgaggtatatccgtatatgtgaagactggttcaattgtctgtgctgctgcaagaagcaaaagaaagtgtacaagataggtcaaggggactccttgtgtaacacttcagattcaactaacatattttttactaaaatacttaagatataatctgcatggcatgtgttcacctttctttggtgcaacaacctctctctgataaacatgattagttgtgctggttgagtcaaaacacaggatgacatatctacaacaatatcagaaattaaacagaaaccaattagttttggtctcatgttgtcgagtcaataaagaaacgaaatgttcagctctgcaagttattagccagggaaaaatatcaagaaattagaggctaaatggttgctggttgaggccttgagggtaacctgttgactagcttaaattgtagcaacaactaaacagctccataaaaggaggagcactttttttcctctgcatatctcctctcttgtcttcttctcttctctcatctgctctcatcatctccattgcaacttctctctccatttgctgctcatatcaacttatcaaagggaggtaggtaagatatgcatatgccccacatgctcacatgcttgtgtttcttgtcttgtttcttttttacttttgtttttgttgtgttaccctgaaagtttagtggaatgaatgagtttttagctgggtcggttgaatgatgagtttgttagggtgttgtttgccatgagttaagggcatatgtgttgttcttggtcacctgattagattagaccatgttttttcttcatttgcaatagtttcggcacatttggttgggattcctccctcaaaatttcagtaactaggaagaaattggcctgagttatgaatcagtagaaaccatgttgcaaaaccatgtgtggtccatttttctctctctctctcttagtccaaacaacacgtgaactagtatgaattgaagaaatttctgggttttgtgtagtttttcagatgaaggagcttggcagtgctgaagttagcatgaactgcattacatggctgttctgaatatgatccaggcagttctaagaaataaagaaattaatcttaggcaataaaattgataactagatttgatagatggtgcgataggtcttggcgattgcaacaacaatatatcaagagtcaatacaaatatacaatcatctctttgattttgtgaatctgattctggtggattgcttacattttctccctttctacatgaactgttgtagtgcaagaggaagaacaaaacaagatgtttttccagagaaagaattcaaagaaagtgaaggactccaatggatcgtcgtcgaagaaggacaaagatagccgcgggaagaacattttcgacagtgccaagggaggacttggtgcccttacaggaactctccagacagcaaagaatggttagccattccattcatttttagcaacaaaaaaactactttacaggaatgctatttatgttgaaacaagcctgttcgtccttttgagttcaagtattagccatgataggaagtatctgacattaatagcatgtaagagttttgacagcaataaggaaatacgaatgatttgggtttgaacttcgaatgcttgaccgtcgaattatgatttgtgcatgttggtgtattaacagatgcctggatagtacgattgcttgattaccaactcaatacgctgatattttgttggcacacgtcctgagacagacatgcaaatgcccttaaaaagtgtcaaacacaggaaaatagaacagctaatattactattttttatagtgggtaatatgctacacacctacacaagaaaaattctgatactcacatgaacatgtaataattaatcaaagtagagagaatgcactacttaatcagagatgaagttttttttctttttctgtttcagaattgaaatgaaaaggagttcgtgccttgcatatttcttcacattagctgttcaaagtcctaatggacagcagatcatatgttgtactttcaatattgtcatgagtccctgacctttgaaatcgatcggtagatgccggagagaaggctgaaaaccttcaagatgatgtgaagacaaccatcggagcaatcttgcgcagaggatctggtgttcttgagaaagccaaagagattggaggccattcagaggccagccagtccaaggaactaggtaaattacagcactacacccaattcagagtgacttcttctcaatgaaattcttcccattatctataataaaaaaattaaagtgacttcagagtcctgcatcttacaaaattgtattcgagaggtgttctagattgatttcttttctttgttttgcatggagaaatagaaaaagaatgagttgttggcgtggttctaactttcaacttccagttggaccctgcacaataattcataaaagttagagtaaatttcacttcgggccaccttttgttacctatgtttcactttggaccaccctttaaacaatattttcactttggactgggtaaacttacctttatttcactttggaccacccaactctcttctcaagcatatgaatgatcttgattacgccgtctcctactcgtcaatgaactgccacagctatatgtaagactatttcttcgacatattacaagttggatgtagatggataaaagagtgagggtggtccaatgtgaaacaaaggtaaaaatacccggtccaaagtgaaaacattggtcctaaggtggtccaaagcgaaacatcggtaataaaaggtggcccaaagtaaaattaactctaaaagttaattacagactgaaaccaatttctaagttcaacaaaaaaataatacattgggtacttgaaagtacttggcactgaaaagattagctcccaaaaaaaaataattctacagtaagatttacactgtaccgtaaaatataaagtggaaaaatgacagattgatgcttttgttctacaaattaggatgtggtagtcccctaaaaaaattgaaacgtgataaataccactagatcatggatggagctacctaatctttgcatcaacatacaacttcccttattaggtgagatatccttttcagatatgtatgcccccttggtaggaaatccgcaaaccatgtaattagccaaaaaaaaagaagaaggagaagacataacagatggttcttttagaaggtagtagttccactgatcatttgattcagatcatgagaatcagtaggtaacacattttcaatagaaaatgactgaaaagttttggttcaaatagataaaccacgggaaacaccaaaggaacacaggctggttgttctccaatgataccatgatgaattttgcagcaaaacccagacgcttaaatctgagaaaatgcagaggttaacatggaaaatgactaacaaccaaaattatgagaaaaattgactaagttctaataatcacatgtaggattactatttggagtgtccagagaccaaattatggtttgcatttgagtattccatagcttgcaagaacttcatttttgcaggattgcagttccctagcttcagaagaataggtcacctagcctataggattacttagctttacttcaaagtaaaagctacttttgtgcacaatgattatctgggatgttgggcatgtgtggttgaggaagtagtacctgataccattttccagctttgcttttgtccataaagagagctgttcatacaaaagaatcacaacaaattcactacacatctcatacccaaaagatcattgctagctaaatacaggaaatatatttttattttaaattcctaagagacaattacagctcaagcaacatgttcttgtgtccttggttggcctccatgtgacagatgattaggttgaccttagtacaaccaaaccctcaactcagctcaactattccaatttccaaccaagaaaccagaaaacaaaatcctaaatagcacaggatccaactattattcctcatgctcttctcttaggttctcttaggatcaagtaaaacaaataaagattcagagaaaataaaataataacaataaaaaaatcatcaccctttatggtatttgattgacccagttggagcaatgagccaatgacactctgtcaaaactacatcgtgcaagccacactgcaaaatcatcctcgaccaaccacaatcaatgcctgcaatttgccggtgtcaatttagctgtcactctccagcaactgccctaccatgtatgatgctcctgtattctgtctgtatatatatatcatacagcaccattagccttttttaatccagatcaaggggctccattagtgcacctatacagagacccgaaaccaacagctcagaatttctcagtcttctcgttcacattgaaagcttgaagctttcagtcttctcttctgcagctctgcttagcttcccctgattatcccaaagcttcagttccatccaatcagcagctttgaactggtaaatgactgtctttctctttgcttcgattgatccaagacgtaagatgagatatttttgttcttgcaagctttgttttcctttttcttttacttcgctttgactgcatgattgtaaggggattggactctcctgcttatatttgggaagcatagagtgctttcctttcaattttatttgtgactgggtggttctcaccctggtttgtgttgattaatgatgattgcttgattggggttcgctgctacagtaaatcgggttttgctagaggatttggaagaacataggacgagtgtgattcttgatcactccactttgttgttgattatagttcttgtctgaatttcttgtcatataagttctgcaggaattttgttctatccagtcacttcttaattcagttcttgtttacctccttactatccatgaattctcatacccagttagaatttatatatgttgtttctgaatttatatatgcaaacattgtgctttgcagtttcttgatagcataacacgaggccaatcgatacgccatgttttctatgctcctgaaaattgcaatcagaaacaagcgtcatttgtatcagtagtaacatgcttattgtcatcttagcagatgcaattgacaaacctgaaggatcttttgtgatgttcctgacattaaaatgctaaggataggcttttctgttactcttctgactacatagcattccctgataagaactcttgttgaattttcacagagcaaggaagtgaagaacaaggaaagaaagatatggaagccttaaccaaagtcatggacaaggtcaaggaagtgaagagtaacccagaagtggtggagaagctggacaaggtcaaggaagacatcagcagccttgctcatgctttacatctgggaaaacatggtaaatctttcttttgagatgtcttatttcctaggataggataatcatatttctgacaactatatggttgcatgataagtaggcatttcattatttacgcgtattcccgaaaaaggaagcacatctcattgtcacaaatagaactatagaagcacttgcattgtgtatagtccgaacatccaaaacctgaatattaacttttcttacatcttttcccataattttacacatgatcaaaagataaggaacatgaatctgaggagaaggcaaaggaaggtgagactgcgaaaagggccgacgagggcgcctctgccagcaagtctgaagattcaggtgtggtagtacaagctgtggaagagattcaggccgttgtcacagctgtgcagcagcagctgcacacagaaggagctgcagctgaaactcccaatgaggctgctgctgctgaaacttcagcagaaggagagaagcctgaagaatcaaagagagatgtagagaaggatgatccgtcgaagcggctcgacttcaagggcttctttgccatgatatttgagaggtgctgcaaccctgggaacaagaagaaagattaagcttggaagaaaatgatgtggattttttttgtttttttgtttttgtgtgtgtgttcttggagactgaagaatgatgtgcatgggattgtgggatggtgtacagtttgcagtttgtgtgttttcttcagagttaattgtctgcttttggtgttttatccttttatgtgttgatggatgtatgtcaaagagtactttgtgaaattcttgttagccttgtgagcttgatcttacttatgtgaatgaaagaatttatttatttattttaaaaaagggcttcctgtgcttagaacaaaaatgcaattcctttggttagaatgatggtctgaattgaagctgtggattaacaaaacactgaaccatttccttatttattactcctctaaatgatgtgtagattgtgtgattgaatttcagtggcaactagtttacgccctgttccttttttacattatcatgggcgcacttcccaggtttcatttgtaacctcaaatattatcacaaaatcagataaatctatcatccattcatctattcagacaagaactggaagtgccaaagagaaaatcaaccaaatgaagctccagaggctgattaaatttaagagccacatggtgtttaccctttcatatttcatgatctctgcttccaaaatattacttacaaatagttgatgtattaagtagaaaatactgaaaagggatctctaattatggttaatactagtatatgtacaacccatgcagggtactctcagttgcaatatttgatcaaattgtataatacaggtagcacattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20807 - DNA, 1013 bp, Oryza sativa
attcctgcagcccccttacagtggaacagtaaggagtcaagggtatactaacaaagtggaaagttctacctgtcaatagtagcttccaagttttaaatgtgaacagctctggaactgttcttagaatcagagagcaattatagtgttttgaacactaaggaagtaaggatttctgatcagatactcagacctcaaacaaaagggcttcaaattgaggttatgtacgttactgagtttctggaatgttatccaagcaaacagtactacgaaaagaaacggtcatcgggttgaagaattaagcaccttatttcttgtttgcagagcaaattgataatttggggattctctgaatcgctgggattaaggaagctgaagttggagcacaaccattcaaacattagcattaatggcacactaaataatcaaaataaaaaaaatgatcttcaaatagaattcaaatgaatgcatactcattaaactcggttttattaaggaaaccatggccatctgcatccgaagcattgaaatgctcctctttccaccatgggaaccccagcgaattaacctctcctgcaaatcattaattaaaacacttactccaaattgtctcatggattcgcttccagccttattgaactcgttttgaactcctggacagataaaaaaaccaaaacaaaaattgccacattaccactcgattcgttgtgctgagcccggaagtccccgtaggagacaaccccgtcgccattcttgtcgtagagctccatctcccgagcggagcggtggagctggtcggctctggactgctcgaggttccacctggtgagctcgtcgagggaggcgaagccgtcgcgcggggcgaggtcgatcttggggaagagcgcgcggatgcggtcgccgaggttgaaccgctcgtcgtcgttgatgaagtcctcgtcctccctgaggaactcctcccattccctcatgtgctcgtccgcctcccctccgccgccgtcgccgtgcaggatgcg

SEQ ID NO: 20808 - DNA, 8677 bp, Oryza sativa
ccgtgtatttagagcttgtcttaacaaattacaattggagatagacattctcaaccagataatatcatatccctccaggttgctaaataagatttgcaaataggagattagatgacaaccaacaaagctgctgctatagtttcatggttgctgctcagtgctcacacacatgacagctgcattttaatacaaggtagaacttgccactttgcaagtaatcctgaattcctgatgtatgacacctaacagaattaagggtggtaaagggcccaacattttagcctagaaaattgggctgtgaaaggacccatgggccaagcccattaccacccgtaaacataatgctcactctgttccatattattagtcattttgggtttgttctaagtaaaacttcttcaagtttaatcaagcttatagaaaaatgcagcaacattttcagcacaaaacaaatatacttaaaagtatattcgatggtggatttaatgaaactagtttggtgttgtagatgttatgcttttctataaacttggtcaaacttgaagaaattgacttaggacaaactcaaaacgtcttataatatgaaaaggagggaataaaaaactgaaggaactaaaatttaacatgatcatgtttatgtagatgatataacacttcaaaatgaagtggttaatttggttcattgaacaagtgaatgctggcatcaaggcctttaatattattgttaataataataacactcgatccaagtggagagacgttccgaaagcattgctttaaggtcaagaaaaggcccagaaagccagctatcgctttagtgaatagtgacctgccacgaccatggggcatacacagcaaggggcctttctttgcgtgatcccaggtttgagccctggttggcagcctcatacctggaggtcttaccattgtgctatgagcatgttctcctcaaggccttcaataaagctatttatcgttggtcagggctcatgtaaatccttatagcatttattcttttcttgagttgtcccatatcataaaattggataatctcttgtgtgtctgttagaatgaactaatcaatcaattattactaacagaataaccctgctcacaaataaagctcaactcttgctccgcatcatagtactacaatggccttttgattaacaagtgaacaaagcagggaaatagtgggtttgggtgggataagctggtagggtctattcctagttggttagtcctaggatgggcctaggacaagattaagttgacctggactgcacttggttcaacaggtcaagttagttttggcttaggtcattgctcagatggacttgctttggttcctggctgtgtgattaaacatttatctctagatcgttacctagtggtagtaaatacacatttgtaatttaatcctttctagaaagcaattgatcttatacttttgtaatatcatattcttttaagcaaccatgttagatattggtacccattattcttggccttgaagtgttagcaaagttaagtctaatgtttttgtagctttaaaatctgcttcctccttcatatttcatttgaagaaaaaaatcatggcacgttaaccatattttcactatcttaaattcattgcaatgaacatgctaggttctagtaaactattaattagagaatctattcctcttcaagccagggctactccaagtaacactcctgggcaaggcatgttgctatggacttccaaacgcacataaatatattttgccttttctgtaaagttggcaatattatatcactatatgtttcgtggaaggaacagattcctatcattatttccttatttgtgtggattgtaggataacaccgcagttccttgagctgacattttaaattccttacatatcgtgccatacccagacagagagacaaggatggtgatggaaagctaaactttgaagaatattttcatgggctacatgaccatatacatggttatgattacgagaacgcagatatttcccatattgggaacaatacagtagctaaggagcggttttccaaacttgacaaagacagtgatgggtatggaagtggagctttaattaatgacttcctctgatataattatttactgaagtattttcattttatatttttaagataaactctttgcctatgtaggtttatttcagagcacgaactagaacctgttcttgataagctccatctttcagaacgttattatgctagacaacaagctgcccatgctatttcagaggtttgattctcattgttttcctggaatttctacattttttctattgttctttgatatcttgaaatctattttccctttgtcatgcatgtctacagctttctatagttttcctgaacatagcagtagatgaacttttagtctttaataggtttgacatgtcctgatttgatattgtcaaaacctaatacaggctgtaactatctaatctcagtatagtgggacataagaataccctattaaataggtgtataagttgcccgtccaccgcaaatcatttgcttttcattttatagtatcatccagaattcaataaatctagttttttatgcatagaaaaaatcacagataatctgagatttttttttattttgagccttcttatttaaaatttcaaaaacaacctattttgaaaaatacaccttttgtcacacgtggagggcaaatgttgctactccatgaatagtggagatatataaggtactgtaccgactcttttcatgccatatcaaccctgatttaccacatcagtatgactctatgagcggcatgaccaaatctttgccacaccaaggtttttaacccatgcttcagcattgtgctgccacactaatgagaatgaagaagctaaaggtttagatatgtaaataatgtttcggtagagttcaattgtcaaatatattaaaaagttaaaaaaaaactcgataatctgtcgtggttcctgtttgcacaaggttgtccaaaagtttgcctgtgaaaaatctcaatgtattatgtgctttcctctgatgcatgatgtgtctcttgttccccgaggatgacatgttcaattggctaatccaaaaattgcaggctgacaaagatcatgatggaagactaactttggatgagatgattgagaacccgtatgcattttatggcagcgtcttccttagcgacgacgaagactattttcatgatgaattccgctgaggtgtctgcaggtgacttgcatgcatctgatgcacaccataccgaaaattgttttgcagctagtattcattcaaatattctgtccacagattgttggtgttgcaagtatggtttgcggatcgatccaagatgctttcaccatcagactgaatgatctaggagctgctaaccacacaaaaagagaacttcagctgtttggtaccctagagttctttctatcaggtactcaggtggagcaccaagctggctaatgccagcgatattaggttacatacatgccaacttgcctgcctttatttagggtgagccgctaacctgacctgacatatgttgtgtattatctcatcagttttgtaaaatgcaatggatggagtctaggagagcaatcatagtagaatggacatgaccagaccagtgagctaattgtgcctttcttctttctttttttctgaagtgtgagctaaattatgccttccttgttgaaacataatgactggattgctgatggcgctccgaccgacagttttcctcggcgcatgagtgcgtcgtggacgtggaatgatggaattattgtagttgcgtcgatcacatggaaatgcattattcgggacagtctacccaacgtgtcgtgtcatgtcatgtccatcgtgtcgtgccatgtagtactaaggtcctgatcgatggcatatatgacatgctccgattccaggtgttcttgctcgaagtgttgggttcttttttgcataaatcgaattagagcattcctctggagacaccaaactaacacaagggattaagttaaagcaacctttgtattattaccattattgggttgcttgtgaaagctttaaactcagttgaaaggcacgtactcgtgcgtgtttgtgttggtcagtaggtgtggtgtgtgtagatgcgttttctatgtagcttgtagctgtgaattcttttggagtacttatatgacatccgacatttttttgtcgaaaaactttaaatgcatagttagaatgtaattgcatacttataatttgtatgtaactactataagatcaacaaaaacctggttgctggctaacgcaattttcgttcacccaagaggttgcgggctctcactctccagccggcatagcgatgtatagtggcggacccaggataaaaatatagctatggcgaagacaaacgagttgattcaaagcattttggccctatttagatcccacaccaaaatttttcaccctgtcacatcgaacgtttgaacacctgcacgatgtattaaatatagactaaaaaaataactaattgcacagattgcgtctaatttgcgagatgaatcttttaagcctaattgctccatgatttaacaatgtggtgctacggtaaatatttgctaatgacggattaattaggcttaataaattcgtctcgtggtttactgatggattctgtaattagtttttttattaatacctgagcatcccatgcgacaccctatataacacctgatatgacacgccaaaagtttacaccccggaatctgaacacccccttcattccaatcaaagaaaaaacgtaaaaatgcccacattgcagtcacgaaatacctcattgaagcgatggttcatctgggaagctgggggtgggggtattcgcgaagaaggttagctatcgcatgcgccacagcatgccaaagtggtaggtccgctcctggcgatgataaaaaaacacctctgggaagttgggggtgggggtattcgcgaagaaggttagctatggcatgcgccacagcatgtcatagtggtagttccacccatggcgatgtaaaaagaattgttcattcccttgcatgaatctccacgcgatctaacagtccacaaactgaatgttttgggaaaaaaatgtcaacagttttttagcacatcttctttaaaattaaattacactttgccatattaaagtttcacttcaaaccaccttaaaagtatctattttactttggactaggtattttcaacaaaaagttaaactttaaaccgatgaccaatatatcaatgagactaaccatctctggtgtccgtgtctcacttatatatgggccacttggacataaggtacaaagtgcaacactggcaacaatacgtagctactagtcccaagtgaaaaaatatttatgtagctagtccaaagtgaaagaaaaaacatttcaagagtggtacttcctccgtttcacaatgtaagtcattctagcattttccacattcatattaatgttaatgaatctagacatatacgtttcacaatgtaagtcattctatcattatccacattcatattgatgtaaatatgtctagattcattaacatcaatatgaatgtggaaaatgctagaatgacttacattgtaaaatggagggaggaaaaagtaaaactttagcaagaatatatatcccctaaatcataatttactctcttttcttacatcattgtgcactatttcttatgtattttggtatcagttttatgttttggaactaattactacccccgtttcaggttataagactttctagcactgtccatattcatatagatgttaatgaatctaggcacacatacatatatgtctagattcattaacatatatatgaatgtggataatgttagaaggtcttataatataaaacggaggaagtagttattaagtatatacattaaaggtttgttgtttgacaatgaaagtttcatcggatcttatctaaagtgtcaaatatttacgacctgagggaaaagagagagtaaggatctactctctccatttcacaatgtaagactttctagcattgcccacgttaataaagatatgaatgaatctaaatatttatatgaatatgggtaatgctagaaagtcttacattttgaaacggaggaagtagctagtttaattcgtttcgatcgagcttcaacattcgtaggggagagacgtacacacgaccggttccggcgatgacgacgctggcgtgcacatggagcgaagggcaaggcgtacgtacgtacgtgcgagaccggaccatacatatgcccacatgtgatgctagtcttaccccagctggctctcaccatgcagagctgctgccctgcagcttgcttgcttgctcttctctatcatcaaacagacacttggccaagtgtgaggtcaagtgtgtgtgcatgcagcactgtcaatgctgacacatagccgtacgtattttagtggctttctgaaggcattttactagtatatccgacttttagggtcagctgatactattgttcatgtatagtgtcttcaacaggactcaaccaattaatatcccttctcttcttttcgagagaattaatatgcccccctcccaacatacttcctccgtttcacaatgtaattcattttagtatttctcacatttatattgatgttaatgaatctataccacatttatattatgtctatatgtctaaatgcacggtgtaattttggctcagctttgtggcccagctgttgatgcacggggtaatcaatataaatgtggtatagattcattaacatcaatataaatgtgggaaatgctaaaatgaactacatcgtgaaacggagggagtacctctctttctctctcgctctattcacaagtgtattataaaataaagtgtaaacctagagtagctagtactcttttaattgtgtcgtgtaccacttagatccataatcttgtgaatcatatatttggagccgtaatcttgacttaatatatcatggtacatagggctaaaaactaaagcacgactgactggctacgacccctgacatggcaatccaccgtggcttcacatttgcaataagtcacctccatgctccctcgtgtggctatcaaactgaagaaaaggaaatgatcctatatttataatatctgctaacctaatgttttgatcgtatacatgagaatacaatatacaacatacttttcataatctagtcacggtggacgaatttattcatcatctgcctcgcataacatattacagcaggtgttcatttagcctaaaggtccctctgcgttagcaacatacgggtgcatcttaggatatgcttgtagacaaatatgtaagacacctccacaaataattttctgtagcgtgcactccaaatttaagaaataaaaaagttgtaataaagaaaacgatcgacattaattcatctttcaatgatatgtgtaactacatacgttaggattgagatcaaatacagttccactagggaccgcaagataacgattgcacaagatctaatcttggctatctatcttttctatggagggtttagatttaaagctacagtaaaaaccttttttttttcaacgatatctcgaatgatttaatcattggatttaaactggacatcctagtgtgattgcttaacttgcagtcgcactggctagagctgggactgcaggtgaaccggccggatcccatgcattgggttggggttggtcccaaagtcccaagtcccaaccgtccggcaaatgcatgcatgtacaacagtgcaactagccaagcacagtacgtcccacgtgtgcggcagcatgcatgcatatgcttatgcatgtgtgatcaataatgttttccattggccctggagctcagtacgatgtatacacgcgtatttatctcatgtcacagctgaagaatgcatctatactctccggttcgtaacttctttaattaatcttggatatgtaaccgaaatccgaatcaagaaataaagatgcatatctttactcccggttatctctaaagatgatagcgccacgtggctgacgatgtcatctttagtctttttttattgttttttatatattgatttctaaccaaactcaacaataaaatcatcaacattcacataaacatcacaaaattgtccacatccacattcataattcatatcacaaatttacatattaaaagacatcataaatcaacaaattcatagataaatcaacaaaatctaacaactaaatcaaccggggctggctcctgcacaggccgccgcccgctgcacgtaggcctgagcaggctgccccctcctccaggctgctgctgctgcaagaaaaagaaaaggagaggataagagagaggaaagagagagtcgagagaggagaaaagagaggaggaagttaaaaaatgaggatgaaatgtttgtgatccagaaggagaggataaatgcgagggattatatatgaagcattgaattttaatcctggttgataataccaatactaaccagggctaaagataataaggggctggacgttttttgaacctgtaggactaaaaatgatctttagtcctgattgataacactaaccgggactaaagattataaaagtgacgttgg

SEQ ID NO: 20809 - DNA, 7769 bp, Oryza sativa
  unsure (1)..(7769): unsure at all n locations
actccatctgtgtgaagcatgcagcgctgtcagctatagctagtagtagtaccatactaccattatgttttacgttcgtttgcttgctcgtgcatgcgacttgtgcacaacgtacgtactccactgaactgatcaacacacacctcagccgttctgcgcgcaggactactatatactgcgtgcatgtcagaggagcgcgttgtccagatcacatgcaagcgaaagtcgtcctccttctgcccccctcctcccggatcaggctcctttaccttcaaatacatttaactttatcacttatatatggacccgatgaaccctgaacctatctgtcagtaacaaaggtatggtgtctgtgaaggaagaggatctcaatcccctcctcccaccacgcatttacctgggtaacatatacgtaatcattatccaacaatctaatatgttatcctcgatcacacttataggctagatatctttatttatatatatgggtttgatcagtggtatatatgttactagctactccctccgtcccaaaatataagcaattttggactctgacatggtctccgaaatgttactttgactaataatatatataaaagtaagatgttttaaataaaaagagttacatattatgatagtttgtttaataataaatctagtaacatgaattttacatgattgattttttttctattaatagtcaaaattaaaaatgttttgactttactatgctaaaaatatttatattttgggatgaaggaaatagttattagtagaataggtgggggtcttttttttttcttgaatcgttaatttgggcatttcatactataattaatagaaaaaaaattatagttttgctacattattcttgctcggacatatagtctttgaaaatgcacagtgaaaaacattcacttccagcaaaatatgtgcgaagtcacctatatatgaatatattacgtatatatatgcaatatgccagtacatttacagcaggaatttggcgggacgaaggatttaccaccagtccggtagtaactgcacaagcatgcgtgcagtacatactgtacatggtctgttgccgacacgcccgggaatatcctggacatgttcctgcagtcaccgcgtgcacgtacgcttgcgtgtgtgtaccatatccccgctgggcggctggctagctctcctcccttcccctccccattccatcccacccccactactgtccctaggccggcgctcctcaccacgtttcttagaaagctaccgtgatatccacggtcactctatcggtatcctctactgtaacaattgtattatatcgggagacagtctgcatcactatgggtagcgcgggtggcggagtggccgactaggtttgtcctcattggtcatcgccatgaaaaatgaggagtcgaggttacacgggatagtgttgacggcagtggatgagtccattgattcggatgggggcggaagtttgatctgtttttaggcggttacaagatggtgtggagagagaaacgtcaaatttggaagtagcgatgacgtatctactagagcccatttttctccttcggtatgctattttcaagattgcgtgtgtgacagatgagctattgggaatgctcttatgtaaacgtagatgcaagccatgctttaagtgcgcatacatgtgtacctcttctatatacactaaagggaattagcattcatgataacgagtcataacccacatttatgatggctattggttactccctccgtctcaaaaaaaaaagcaaaccctgggtttccgtgtccaattttgactgtccgtcttatatgatttttttataattcatatttttattattgttagatgataaaatatgattaatattttatgcgtgacttgtctttttaatttttttcataaatttttcaaataagacggattgtcaaatgttggacacggaaaccagggtttgtctttttttagactgagggagtacataacagatcaatggtcaccgatgagaatacctcattcctatgacaagtcaacacccattaatgatgatagacaattgtgacgagtagtaattagcacacttcacatatgagtgcaccaccctgtcagatattagactgacctcaaacaagttgaagtagtgaatcatcatacatgtagaaaatcaacccaaaacatcttcattatcagcatcaagatgaccaattctatagtagtgatactactacctcagttttcaaatacatataagcttgtttaactttcaaacatactgtttgaccatttatttttattgaaaacactatgtaaatgttatttattttactatgacattattattattaaaggtattttatatacgatatatgttttacatttgtattttttcaataataggaatagtcaaatatatatatatttggaaacagataagggagtagtaattgtccaatttgcagctaattggcacgtgtgcatatatacgcatgatattggtaggatcgctaaatcacatcgctacaaatggggcctctatgcttaattatgggagtagatatagtactggctagctatagtaacagtggttggtaggtagctttgatatgtacgtataggacacacgacagacatttctcatcagtggaaaacagattatagtggggatgttggagaaccttctgcttaattattatgtacccattatgtcccttttcttttgtttaattctggatattttctgtggatatatccttatgttttttttttgttttcttgtgcagatctatatataatgccaaacaaataacaaagggttatatatatcaaacaattaatatatatgagttgagacgagattatggttccaaatggcaaataacatttcaggcttattcgctttgttcccaaattaaccttaccaaattttaacaatgttaatttttggtgttgccaaattttggtaaagttagatatatttagtttgatgcatcctaaaatttaatagcgtttttattagaggaaagttctgcaattgggtaagatcatgtttaggttgtcaccgtactgaaatttgataacaccaaatttttggtatgataggaagtgacaatggtgaatatgctcttcttttttccaaataatatttctcttaacaaccatatcatatatgcttggatatggttgtgacatcctggcccaattaggatgagacatgtgtggcccgtgagagttgtatgtgcatatttagtaccaccttgctactttagaaagggtgaaaccaatttataaggtattttccttccaaccgtatcactcccgggttaaccgttttatatgaaacgaggataaaaatgtaagtggggtggtatgcgtaagtgagccagccctgggctggctacgcggttctggagggagggctgttatgcagttgcacgtatggatatagtgccgggttctggagggagggctgttatgcagttgcacgtatggatatagtgtcggcactgtgtgtacagatgtgcactaagagggggcttgttcctgtaataccccgagttttgaatttctagagggagggctgttacaaacgctattatagccgagttttttatttccctcgcagttgcgtatggatatagtgccgactggagggagggctgttacaaacgctattatagcccgagttttgaatttctagagggagggctgttacaaacgctattatagccgagttttttatttccctcgcagttgcgtatggatatagtgccgactggagggagggctgttacaaacgctattatagccgaccctcgcagttgcgtatggatatagtgccggcactgtatgtacatacgtgcgctaagagggggcttgttcctgtaataccccgagttttgaattagtgtatttcaggaaatattaaaacaaatgcgcaaaagttcaacttttaaaccattgttggaataggcaatgaggaaatgtggatgcgtatagctcgtcgagtagtgcgaagtacactataagtttgcagtaatcagagtccaaacaaagttccgttgattgaatcgtaataccccgagttttgaattagtgtatttcaggaaatattaaaacaaatgcgcaaaagagttttgaattattgtatttcaggaaatattaaaacnagtgtgcaaaagttcaacctttaaaccattgttggaataggcaataaggaaacgtggatgcgtatagctcgttgagtagtacgaagtagactataagtttgcagtaatcagagtccaaacgaagtttcgtcgattgaatcgacgtggaccgtttgatctcctttctagtctctttatatacctacagataaaaaaaagaaaagaaaagttctagtctctttatatacctacatataaaaaaaagaaaataaaatggaaaaaaaaaggagagatcgagagcctctacaaccctagccgccaccgctactgcgcccttgtcgccgctgctattatccctgtcgccgccaccacagccgtggccggccatcgtcatccgtcgccaccggtgatccctttctgtttttttccttcccggtgagctcttgctgctgtcgacctgatctgttcctgctgtgtgctttggtccctgctgctactactaacgttcattgctactgctgctgctactgggtggtatgccactgttgcttctacaacgatcagaggggagaaggttcagagggcagaggaagaaggaggattaaagaagaaaaagagaaagagaagcaaagttggggattttctgggattccacaaattcacctcaaatttgattttctcctctataagggtaactcctcttaatccatggaagttcaattttcacgtgggaatcgattcgattgccggttgggtgtatttagttgttgtttatgggctaaaaatagtattttccaatctggtattaaaccattgtgattcaggttagttgtcctaaataaagtttgtagtcatcgtcgatatctttctaacggtgctggtttcactcgattctgataagaaacaaccaaaaaagtactgctgaccaggtccggaaaccaggacaacaattcattttcctttatatgggacttacataggcttaatctgatttttcacccacatgaaagttgtagagaattttgtttagatgtctaaagtgatatcggttgctactttttgttaggcgctttgtgaaatatgtatataacattgtataggtagtataggtagttttatgtaggtaccgtcccggttgacagataaattttggttttgatctttcatgatgttttgtacatgtatagatagtctcaaggattcctcaatagaggttttacttgtagctttactccacaggtgtggagagatctggtgtggagggggtttcgtcgggttgccgtcgaggttaaaggcaagtgtatgacgaacaaattatgtgtttcttggattgtttgctccacctatttattttcaatatatttctatgttatatgtgattgcatatgttcagattattgttcatgatatttatatttcaggtttatcttatgttcacaatgacgttattcttgtttcaatattctggattctggttctggttaaataactcaatttccatgcttgccatggatgtgcaatttagtttcaatttgcttttttgtttctagtttcaattattcatgttccatgtgagtcatggatatgctatctggttttatattcatgttcctataggtaattgttgatcaagcttactcggctttgccggcaaatgctaggatgtattcacagttgtccaggatgggaactactatttcaattcatgtctgttcgggatgggaactattaattttctttaacatggtgtttgaaaccgtgtttcttttcaaagaaagaaagttttatgttcaggctttattgccaatgatgtgtatatgtgttttctagttccatattgtacttgctaagtatttatgtactcactcttgtgtttatttggttttaagtacacattgagatcagtatgtatgggcggaaagtagcacccttatatacacatctatctacacactatcaaattatattgcttaggtccataatgacacttaaactatatcctggttttgtcttgtaatattcatttggatatctattagtttctttctatggattatatgaatagatagcactgtgggaataatattattattagtttatcttataactgcctatcatggatgtccgtatctataggagagactctgccgaaatttctaataattttaggagttagtagttttgagtgtattttggtgtggcactctgggtacgtggttacctagggtgttacaatggttgccattcttattcccataatcccgtctccattttggtaccctctaaaaacagttcagaataagagtattgttagataaaaaaaagtgaatattagggaagaaattaatatcaaataaatagaagaggtgtggctttgaacccagaccaattagcccatcaccttgtggagctagccggaaaacccctgggtgtttcttgagagtattgttagggatgagttgttaaaagattaattagtataagaaattagtacgtgtagaaacttttccttcttttaaatgggtaccgctagtagctatagcttccatttgatgtacgtagctattttttttttagaaaaaggcaaagcccatctttcattcaaagctataagagttcagaatacaaaagtaacataagataatcggctgggaaacaaccagctaggcgaacataagcatcatggctgctggctcagcccaaaaacaagccagggaaaattaccaaacatctggaaagctccctaccaagactaccaaacccagcaaagcaaatcacgaagtcacggcgctactacacttttcaggcatttgagcttgctatccttctgatgctggcaagtagtaagtcccgcgaggtatccaaagagcttcgagtcttcactagtgctagttttctccgctggagatgaaaagagacagctttgtaaggcaaatgggttgcattagagatcagtttattattaaacacccaatcatttctaatgagccaaatggcccaggcccctgctgcaaaaagagaaagtagaatcctattttcatcgcaactttgcatcttaagcttatcaaggagctcccctcttgttctgggtataccagcccacccaaacgcatctctaaagcaacaccacatgaacttcgaaattgggcaattaaacataaagtgattgacatcctccaactctccacatagtttacaataaggactgcccttccatttcatcttttttagttgggaagccgcttgaattctccctctcaacatgagccaaaagaagatttttattttcaagggtatgggagttctccacaaatcttgcataatgacatctctaacacccccaaaggctagctctctgtatagagattttgttttatagataccatatttggtcaacttccaacacatagtatcattatctgagttcagctgaatctcatccaataaagtatgtaaatcattccattctgtcatctctcttccccctaaattcctccttatgttaattgtccactctcaattaggacacatctggtaaacagtctttttcgtatcggcacaaatgctatagatgatagggaattgagtttttaaaggcacatctccca

SEQ ID NO: 20810 - DNA, 4049 bp, Oryza sativa
cctagctctaattgagtccattttctggtgcacactctcaggcataagatagactcccatcatatacaaagggatactactcacacaggaattaatcaatattgctttcccaccataggataggtgtccacatttccaagtggccaatcttttctctatcttattgggaggtatactaaaatcagcaactgtcaatctatcaatcgcaattggaataccaaggtatgtaatagagttctgtaaatttggtacgtttagccatttccttttaaaaccaaatcatccatgcatgctaaggcacatatctttttgaaacgtatatctgataagtaaaatattagaggcggacttttggacgtcatttaatttcatttctctaatcaattatatttaaggaggatttatttcaaatcgttatctgataattaacatgcatgtgccatgtacgttacttcccacataaatccaaattcatatttgtctcttcaaaaacatatacagtataaattaattcgatttttcttgcgcggcttgtgaataacttctctgaaatggctagctctctccctctcctacatgtgtgacctgttgtacgatatgacaaaacatatttatcacgctttattaattagcgatatatatgccggccgcgcgacgcatccaacagtgcacgagtgtggtacgaattaacgtacgtacgtacatgtagctcgtgtccgtaggcagggcaggcacgtactttcacgccacagagcttacacgtgctccctccgtaaaaaaaataataaaaaaaagacaacccctgggtttcttattttaaaaaattataaaaaaaaattaaaaagacaagtcaagtattaattatattttattatctaacaacaataaaaatactaattataaaaaaattttatataagacggagagtcaaacattggacacgaaaatccagggtttgtctttttttggacggagggagtacgcgttataaattcatcgtggacgttgcgtacttgctagaccaccggtcaaacatcacacctactactccctccgttccaaaatatctataaaagtaagatgtttttattctgatacggtcttcgagatgctactttaaccaacaatatttataaaagtaagatgttttaaataaaaagagttacatattatgatagtttatttaataataaatctagtaacatcaattttacatgattgatctttttttattttttttttgttattaatggtcaaagttaaaaatgtttgacttgtcactatgctaaaatgcttatattttaggacggatggagtagtaactaaaattgtcaaccaaaatgctctgcggaactcaattaataaataagtatttttttttcttttgtctatgaacaggaaaataatgaaagagattataacattttatcatgagagctagacgtataaaattagatatggcaaaaatacaaagtgagtgtagttaattgattagatatgtttcttgttgtgacctgttcaagtcttagaattggcatagtgctcatatttatggttaatcatcatttaaattgtagccaatgtatccttggcaacgagacatttatggtgactttcttaatattaagatatgttggctcagtcacatgtgactttgtcaattttaagatatgctagctcagtgtttcagatatgttataggggtaattagattgcgaatagacaaggccaaatcacgaaatcctattaaaagggcatccactcttaaagagaagaagaccaatagcaaattaatcctccgcctcgcaaatcctattaaaagcatactagcctattaaaggcatactagcgtaatgcttaatattgatgggtacgtatataagatttgaaccctagtagattctcgagaagaggaggctcgaacccagaccgaagacgttttattaatattacttatttataaaaatcattggcaccaagcttttttttttccagaatttaattatcatgtcctcgaagtggtgcggtcagagcaatatatcttaattattggaaaaagttttacctttagggcgggtttagtccccaactttttcttcaaacttttaatttttcatcacattaaaactttccatcatatcgttccaatttcaatgaaagttccaattttagcgttaactaaatacacccttaatctaaggtttggaatgtcaagctagctaggtccaatatattttaatttgctgcagagagcatgcattacgctatatatatgctcgttgtcatgtctttgtcacggcctaacatgcatatacattaattaggacgcctgtgtgaaggtctttgttttcgcgaaacaacagtataagcactgtggataaggaacaatgagttaatatagctcgtgcacgatcgtccctattaattggagaaggttaagtatacatcagttgatcctttttgttttgacgttctgtcgtacgttgacccaattggatatttggatcgatagagctactctatctgggttaataatactcgttttttaacaagagcacggtctatataaaaagtaactttgaccaatattttttattataatatgtataaaagtgttaataaatatatgattttattaaaatattttttaagactaatctatatatgtagtcaccatatttgaaagaaaaatattttaaaaataatttataatcaaatattctaaagtgtgataccatatttgtctaaaacgataagtattatcagctctgagggcggagggagaatatatattagtataaaaattagatctagtatatgcatgatcatccctttgtctttgcatatactagatcgcatctcttgactagtggtaaatttatttcccctgtactttggattatcaaggtactacctccattttaaaatgtaggcaaaatttgatacgagacacccaaaaatcgtgtaattggctgtgagacaccgcaaaatcgtgacgctgtttatggacactacgaaagttgtgaaattggttgtaggacactggaggcaatattttataatttccgagacaaaagaggtcagagaaatttctaaaagacctgattgcccctaggcgccgtagcttgtaaacccaactgggtctagtcgtcgtgtccatctcccccacccgatttccttattcctccccaatccctaaccctagttgatagtggcgacagcgccggcgccgacggcggcagatacgacgctggcaatggcggtgacggcggcgacctcaatggtgcaagcctggtcgaagcagatgcagcaaagctccatgtcgctcacctgtgcccaaatgatcaacacattttgcgaattcacaggagtttgctgttcttctcagacttgacctgtcattttgctgaattgcccatactctgccactgaaccctacatcagcagagcccatggtgtggccatccccacttaagttcatcggtgagcttgaaccagaagctaaggctctcctggaagcagctctgatggaagccaacagggagagggagaagaaaatcctgaatggcacaaagtactccctgccatcccctttgcctggtgatgacagtgccgatgacgatgcatgctcagaggtatttgagtgctgaacaatttcagtgttatcggttggattgggctcccataaacacattgtgtaatttagttttctgtgttgatcatttgggcacaggtgagcgacatggaactctgctgcatctgcttcgaccagacttgcaccattgaggttgtcgtcgtcgcccgccgtcctcaccgccagcgccggcgccgaattcgacgccgccgccaccgtcgactagggttagagattggggaggaatgggaagtcgggtgggggagatggacatgatgctgacttggtctggtctacaagctgcagcgtccaggggcaatatggtcttttagtaatttctctgacctcttttgtctcggaaattaaaaaatattggctctggtgtcctacagccaatttcacaactttcgtagtg

SEQ ID NO: 20811 - DNA, 1605 bp, Oryza sativa
taagccattctagcaatgtaagttattctagcatttcccacaatcatattgatgttaatgaatctagactgtctagattcattaacatcaatatgaatgtgagaaatgttagagtgacttacattgtgaaacggagggagtatgttgttgttgaaaaaaatattagcttcttcatcttaaaaaaagatagtattagtttccatatagatcaatgactcccatcatgctaataagagatgtcttttgatatctctatctctactattaaaaaaattgaagatgtttccaccagaattttagtacgtcatccatatttgagttgattatacgtcgtcattatcaaattcaacctgattctagaataactattatatactcctatcccaacctaacccctccccctccgccagcccaaactaaccgtcccacaccatcccgcacgcctccactgggcaccgtgcgcgcccctcccacgatcgacatcttttttttgtcgtcttccctttttttgttttctttttctccctttctttactcacggtaatcctgatcctctccatttccttccaatctcctatcttttctcctcctttttctctcctcataaatatttttatgcggcaagtttgttacttcgcaaatgctttccatctatagtaaaaaaacattttacaaattgaataatcaaatttcaatttttggtccatgaggtatatatatatatatatatatatatatatatatatatatatatatatatatatatatatatatatcaagctatatatatggaacttttgtaagcaatgaagaggcaagaagatcaaaagaaaatggttaaatatataccggcatatttgttttagtgttttctctcgtttcctgtgatttctccgataaaatctgtgaatcatgataagtaggatttttcaaaataaaaaggatattttgcgatgataatgctgcaaaaataatctctggaggatttcaaacaaagagcacatcattttaagtacatgaattatgctattcttctatataaattggagcagtcgtaagtaaactagataggtatcctgctcgttcccacgagaaaatttaagcgataaaatagtatatatgagttagaattttcttacttacatatatacctatacgattttctttcatgtgcttatatattttgcatcttgatcaattatccaaatgttataaatgattggattgtatggtgtggtttttggaagaagcgatgaactttacacccttgatgattaatctaaagagaaataattgaaatgatgtgacttcattgtagaaaagagaattaagaattacctgaaacataggatttagtgagaatgaaccttatagatacataggattaactaaacacatcagctagaaaccaacgtgaaacttattatgataatagtgagttgctaacataaaaccttttagaagaaaacaaacaagagaaagatcgatgatggtataatggttttcgttaaaaaaaagagagaagagtataagagtataacacgaacttcaggagattgaaggtaaatatatatacccaattttctttaccctgtcaacgtgagg

SEQ ID NO: 20812 - DNA, 657 bp, Oryza sativa
agtgcacgtaggagccttttattcccctcgttccgaccaccaacttctgctgcaatacatgagcttgttggctcaactgcgaaggagctcgtccaggaggcctagccctgtagatccttacctcccaatccgccgccacagagctaaatctaaagaactgtggtctcacgtggtactgcagcctagagaccctgaagcacgaggcgttctggcccgttttatcggagatgttgtccatatacgagcatgtcctcatttacaacaaagtttcgtgcatggattggcatgataccacatatgtatcatattggtatatgtagtaccaccctggtgtcacacatgtaccacttggtatagaaaaatgctatgcgtacgatgttgctgtacgatttcaatacgatcaaacaccacaccatccctgtggaagtgaaaccaattttcatgtggaaccaaaacgtaacactgtcagtaacgctaggagagaatcttttgatcgtacaagtatagtaaacataagactgtacgtataacgttgctccttggtatatataattatgttcggtatcgtattaaatctactcctatttgtaccttactccatctaagaattggattcagcacacctattctatattacaaaaaatttcaaattactag

SEQ ID NO: 20813 - DNA, 562 bp, Oryza sativa
gggctacaacactcgaaggggacatacgtgcacacgaccggtgccggacatgaccacactggcgtgctcgtggcgcgaaaggcactgtgtacgggcgaacaagccacaccggaccacacatagcgcccgcatgtataagctagtaactacccaccatgattctcaacatgcatatgtgtaacacctgcagatagatatgctagctctattaatacaatcaaacagactcttgtatatatgtgaggaccatattggaaacatgcatatctgaaaaagctgacatcatccacatcctataagtagtgagcccatagaaggcctaaaactataataatcatacatctatgagggcggagaggctaatgtatatgaatataagaaattagaccgacttatgcatgaacatccctttgtcttctcttatacagaatcgcatgcctcgactaccgacataattactccccctgacactggggattatcaaagtactacctcacatttataatgaaggcaaaatttgatacgagacacccaaaaatcgtgtaattggctgtgagacacc

SEQ ID NO: 20814 - DNA, 842 bp, Oryza sativa
ctgcagccccgtgggcacggctgttcgaatagtttaataacctctgcagaggggggtacactttacccacacgacattactaacccggatcatccagcccatgcagaacggccacgactagagaccttaaggctttcacgacaaggcatttcgaaagccgacacaggttcaccatatgccaacgagagggatcccagaccatactgtgccaggaaacccgggggtcctccccgacaccaccccgttgaatccacatgtctcttggcatcatggctcccccgattagctagttactcagccaggggtgtcccattccacccatgtggtcgtacttgtcttatgttcggatgaaattccaaggaaacggtccttaagtgcaagagcggggaaccgtacacccggtacgttccccggtccgcgaatttggaaattcatttaggttcgcaagcaccgacccaggtgtcgggttttccaagtgttttgtaaaacccaagttttacccaagatgtttctcagattttaagtttgaaggcgaccgtcgatattcgtgcagagtgcacgattaccgaggcgcaactaggtggttacaagggaacatggtataataattacaatggaggggtcaactgcaacaagttaggtaggtccgccaatctgccttgcagacgagacatgtagattaagtgcaatcctatcaatgcataatatttttcaagcaacatacttaagttcaaatataggctcaagatgttcaaaggtggcttgccttgctcgagatcttgagcttgatcctcgaaatcctcgcactgcgggtcttcgggctccgaaactacacgcgaaac

SEQ ID NO: 20815 - DNA, 655 bp, Oryza sativa
agatttcacagcacaaactaccttggttggaggcattgcattaaccaagattttggggtaacattgcatgcaataaacaatatatttctttcatcaataaaaatataaattcaatgattctttctgtattgtcagatgtacgcgctagctgggaggaattttgggaagctagccatcaacttgcacacttctcgggcccagaggtagtatatgatgtttcagaaagccacctggtgagtacaaatttgcagttcgtagattgtagaaactcttgtaaacaatagtacagaagtagtcccactgaaaaacctaaactttgcagatactgattcctgttcacctattcaatcattacgtgctgtacgtatttaaacatgagagcaagaagttatcggtgcttgattcactaaacacagaagatccactaggggaatcacgtttcaccaggcatgacaagataaagatcatggtgtcacagtgtgtaatggaatgcatgcgtcttgcatctccagggtggaacatggacatacttaattgggactttgagacagttgaaaatataccagagcagcagaacgggtgagtgactcctaaacaaacgaaatacaaccaacccaaagcttgtactgacactactttctcaaaaacatacagg

SEQ ID NO: 20816 - DNA, 333 bp, Oryza sativa
gcgatactgaagaatttggcctttttttcgaatcttgaaaacattcgcatgatcaggagtaaacacattgttggttgaaatttttaatcttttggtacaccaacctggagctccattagattttggaggagtacactgcaagcctccaattttgtgatcatattgttgggtatctgatacatgaagagcgtccgaaaatttgttagagtgtcaagtagtacgagttttatttttaaaatggttatgtactcaacgttacctgttggttgatccaattgactagcatcttttgtagcatgtgtggagtagtttgtgggtgtgtggtatcccatg

SEQ ID NO: 20817 - DNA, 4072 bp, Oryza sativa
gcttctctttttcaacggtggaagtatatcagcagtcaaatttccaccctcgtcctcacttggcacgtcatactcactgtcctcatcacctccaccaacatcttcgtttccatctttagtcaatacagtagaccttgatttatgcctagctgctcgcttcggagcttctctactattgtcaccatcatccaaagataactgatttttcatgtcctccaaaagcttattcatgactgtcattgccatcttaaatgtctgcacatctttattagcaatcttagccacctccacagtcttccttttcagcattacatgtatgtaactcctcgattgtgaagcatcgacatcatctttgtacccatgtagatgaggtggtatagtatcccgagcatccttcgtccatcttttcagtatatacctctctggaattcttgacaaaccatactgaacaagtacctaaagggacaaaccaatgcattacttcaaaaagccaaacactaccgaacatatagtacgacccaatgaaaataaatgtttagacagtagaagaaacaaatacccttaagatgtggtgcacagaatccccttatgctcaaacatcttgcaaacgcatgaaaattcctctctttccaaatcacaagacacctgatattccttcctaaggaataattcttgcgagttcatccgtacacttgcacggtgctttcgtcctcccaggttttaaccatgtaagatatactatcggttaactcctcagagaacaattggaaaacagccctagtatatacttgggatgcgtgaatctctatcggtgaccttgttttaatttcaaccttgtcctgcaccaagcgacaccaaatgttgattacacatatccataaaaagaggtcaacaaacctatcacagtggatacttacattactggtttggaattcctccgagtcctctttttgcagcttctcattgaaaaaccggtcgtacctcttaacaaagccattcatagagctagagggtgacacaaacatcttaaacacatggtttgcagactcacttctctgtgtagtagtcatcccagcaaagaacctatgggaaaaatatacaaatgcccatttacgccttatgtcccatatgtgacgcaagtaaacacttttttccagattataatctctaatcagtttgtgccaagccgcaacaaactcctcctctgttagtgtctgcgtaagaaccttatgaaatgctttcttgaatgtatgacacttggagtatatgttccccataaattcctttgctttcttcagtacatgcgacttgcacacacgatggattgtattgggaaatactgttctaatgcagctgccatggaaggacaattgtctgcaaaattaaggacaataataagcatccaatgaataacccatcatatacttaaaataagtaaagtataacgaattcattccaaattataaattcggccaaatactcacatacctgttaatattccaataggaaccttcccattcatgcactctttgaatgtattgaataaccatgtaaatgattcttcagtctcttctctaagcagggcacaaccaaagaaggtgctctgaaagtgattgtttacaccaacaaatggtgcaaagggcatattatacttgtttgttttgtaggtagtatcaaatgtgatgacatcaccaaaatgctcaaagttcaatctggacacagcatgagaccaaaatatgttcttcacacggcaagcctcgtcaacttgtatactataaaagaaattcttgctccttttttgcaaatccttcaagacatcaagtgttttttgcatgtcatcgctgctctcatcccgcctaattgcataagcaaccctatccatagcttttctcgtgaatggaaccatggaaggtccgccatgcatcccagacaacataccatacatatttgtaagactcatactactgtctaccatctcttcaataataccacgagtcccctcatctatttgattgtgcgactgataattcttagtaactcctacactttttttcataggatggttgtgcgcagaaacaacctttgttactgaccagccactaccagctccagacatatttatcttcatcattgctgggcacccaattcgaacggaaggcttcttggtttttgggttcctcccctgcataaaagatttcgaaattaacacatagtacgtcaagtctttatttaggtaaatttctgctactaagatattgttacataatgtatgtacctggtgagaacaacatatttgccgcattgttctctgctttttagtattcatgtgatctttgtccagtcgtatcccaaatcctttactaacagcataaacattataaaaattataggcatccctctcagtcttaaatctttgtcccagcatcggagtaagaatttgaggatcagcaggaggtatgacagcactgctatcaacattatctaccaccattctgaaaagaaaatgtacaatcagttttcagaaaataccaccaatatcctggctcaaaaaaaatcgtaaaaatccgtaacatgctgatacaaacctttccatcggtatcctagctccttctttttcatatgggtttccttctgtccaatccagtgaagggaccaaatttctgtattggagacactatatttaaaaatagcatatactactactaactgaaaatgtagtttacaaaaaacaacctaatttataatcagtacttactgcaaattttaaaaaaatatatgttgtactactaacaaaaaaatatggggagctttgttctgaactttgttagatgattgtatatactcattttttaaaatggaggggttctttctgatttatgttgaatgatagtatgtactgaatttttctatgggttacgtactgaatttttctagacgatagcatatactgcattttccacacgtatactaaatctttccatagtgattcgtagtctgaactttgatacgcaccagtatttactgaatttttgacatatatactgaatttttctatgggaggctatgtactgaactttgttatacgacagcatatagtatgttctaaattttctgtgcaacatactgaactcctctgcaatatacacatactgaacttttctatgtgatacatactgaactttcctagaagatagcatatactgaactttctcatgtgacacatactgaacatttctatgtagtatatactgctttaaagtgaatgctcagctgacacctagccatgcacataccttgtctctggaattccatgccctgaatcatgtgatccaacccgcgacggcacgtcctcctccattgctacacggcttcataacacaatcaagatgtgtcagtatctggctaccatttacagagttttaaattcacggaagctacgatccaaccttgactgaccaccatccggttgtgaatcatggacagattgactaataccatctactatgtccatggtagggttgcgctcgtccataagaatttccctgaattgatgatttagaattgctcaagttcacacggcgaaattcagagaaaaaaaaccagcggcacatactgaaataaatcactgaaacagaacaacataccttgatccatccgtaccatcagaaggtctgtggttcttcacttgtttatccatcctaaatcagcaccgccgcgcggcggcgtatcctcgagctggactacggaggtccaaaccaagttcctgcagccctgaacaaatgaagcagtatgtggtttgatgatataaataccattcctcaccgcccattacctgcgtacagaccgattcttcagggattagttatacacgagcagtcaattaattcaatttttaaaacaaaatgccatccacgatccactaatgggtagataccgcacgtccccttcactgctaacccgttatcaggtacaaatctcaaaggtaatcaacggtatgagggtagggagtatgtactcccgggagtacataatagccttcctatatatatatatatatatatatatatatata

SEQ ID NO: 20818 - DNA, 3405 bp, Oryza sativa
tttttacccacgggtaaacggacaaacgggcacaattgccatccctaatagagtcccatcggttagggtgtactccctccgtactcgtaaagaaattcgttttaaacagcgacacggtttccaaaacacaactttaactttttatttctataaaaatatttattgaaaagtgatatatttatacttttatgaaagtatttttcaagacaaatctatttatataatttttatattttcaacctcaacaacttgagagttattcatgatttatattcccaagatttgacttaaacattgtcctaaacgacttctttacgagtacggatggagtattagttcgtgaaataaaatttttttagtgtcacatcggacgtttgaccagatgtaggaaaggggttttcgtacatgaataaaaaaaactaatcataacttgtctggataccgcgagacgaatttattaagcttaattaatctgtcattaacatgtgtatagcacttatggctaatcatggactaattaggctcaaaagattcgtctcgcgatttccatgcaaattatgcaattagtttttttatttatattgctctatgcatgtgtctaaaattcgatttgacgtttttggcaaaaaattttggtagctaaataaaatttgaatttttaaacttgatttgaagttgattttaagatattctcgatatttttagcattggtttttaagccgctacaaacaaatatataaaagttttacctacaaattaaattttattctttaataaattgttttgggttattaggaaatatggataaccgatgagtctcttatattaagggagtactgtactaagcgggataggaacaaaaacggtctttcatattattactattttttatatgattataaatttaactactccaatacatcttaaaatacattgaaacgaaaatgatattatttttatattatttacaaaaacattattagcacgctcgggaatttctataccctttttgaccttttcacctaggagggaggcaggaagaattactaactgcagctttgaaaacattagtctgttctactactatttgtaccaatggacagaaaattttcaagtgtctaggcactttacatgtacggatgacacgcttgattaacaaaaggagctcgggtaatataacctactatgttacccatcgttctgctagagttttttttaatcaaaatacttaacgttctcacgatccaaagcatcccctcttactactctttactaatgcagtcacacattaatacagtcttaactctaattgtctcatttgtttgagaaaaatattaagatgtatttaagtatggtatatttgctaaaatgataacttattccgtccatagtaacatagtactacatatcatatagatacaaattagtactacaaatctgaatagatatgataatattgggttatgtttactataaattatatgctagtagaactcaacaacctgggtggaaatgccggcgccatgattaattcctggtggctaagacatggtgttaattatgcacctgtaattgcactctcacaccaaaaagctcgaaagggactccaggatatgaaatgaccatgatcttaagaggttatgttttgccctagccagaatttaatcatctttgtagacaacaatgacggcatctgcttgttggtttgatagccaattgtaatgttcttatatatatatatatatatatatatatatatatatatatatatatatatataatatagaactaccaattgtaaagtttgaatttttatctcctactacaaaagtgcagttgtcctccttccacccgtgtattgcccgcagcacgttcgttgtgcttgcgtaatcaccagttgaaatttaatttgagttaaattttgatgttttccgtcgtagtctaacttcctaaaaacatccatccattccgaacaggaaaatatccaaattacacctctaaattattgggtgaatacgaattaatcctctaaacccgaaaaccaaatatctttctcccttaactatcaataccagatgaaccccaataactttggaagcggttttggtactacgtggctgtctagtcagcaattcttttaataaaatgatggggcccacctgtcagatctctctcatctctatctcttccctgtctcacccatctctatcatatgtcaaggaggagccccgtgtacctacggaagccgaggacgagctgtgcattggtggcggcgacgacacatgtgcacaccgttgtggacggccttgggtgcggcatgtctcagcggcagtgacgacgacgtcagcgacaagctcacgaggcggtcatgcaggaggcgcgcgccagcagaggtcaaggaggagccacctccaccgcttgccgccttcgtcacttgccatctgaaccgattgacataaggggagggagaagagagagagggccgcctccaccgctcgccatcctcggctgtctcaagctccgctcgccgccatccttgactccccctccgtcgctcgccatatctgtcgacgggagatatccgtagaccgtattctgagaatgttggagtatgttggagtaaggatctatacgatatgacatcaagcacacaaaaaacaaggattatattggttcaggtccctcataaggtagtatccctaatccaatttatataggattatgaagaaccacaaagcttacaataagaacaatggaaccgacgagtaccgattagacctttgtcgagatcgactagcggctgggcttcgagtcctccaaattgctactgctatggctggtgttgcgattatgattcgatgatcccgtaccccctagaggtcttgtatttatatggagaactcgaagaggaccacacactggtggagaagtgctttttactaccggttcataaccctttgtagtcccggttttctatccgggactacgaatccgggactaaagatcgatatctttaatctcgggtgaaataaccgggagtaaaaatctatttttagtcccggttggtgttatcaaccgggactaaagattaagcatttttaggcccggttggtaacgccaaccggtagttaaacgatagagctaggctagctagatccagttgctccattattcttttcttttcttcattatttttaatatattgatttcactccatcctcatctcaaaatcccaaatcaatcatccccaaatcctcaaatcgatcatatccaaatacatcacaaaatcttaaaaaaaattacatcacaacttttacaaaatttatcactaacacatcacatattcacatcacacacaaatcaaatacatctcagatccgaatcacaaattctcaaaaaaaaaca

SEQ ID NO: 20819 - DNA, 4603 bp, Oryza sativa
aggccgaccggccctctgcctaccgccgtgccgccgcaaggccgccggccgcccgagcctccacgctgcccgggcctccgcgctgcagattaagaagtggggaggatgggagggaaaggaggagaggcgccgtcgggcctctgcgctgcagatcaagaagtggggaggattggggagggaaaggaggagaggaagagataaggtgtaagaagctagttagaggataggaggagccgggggttaaaggggagagaaaggaggagaggaagagataaggtgtaaagagttagaggataggaggagccgggagttaaaggagagaggagtgggaaggaggaggagacctcgatcctatccgcgcgcacacctccccgtgcatgtcgatcttttttcccggttggtgttaccaaccaggactacaaatagatctttagtcccgattggtaacaccaaccgggagtaaagagtatgtcgatcttttttcccggttggtaataccaaccgggactaaagatcaaaaagtacctctgagcttttaaaccgggactaaagatgtttttagtcccagtttttaatacaaccgggactattgtgaaatctggccgaccgaccaaagatggtttctccactagtgacacatgtacgagatttcaaagtccacatccatctaaacaagactctaacacctttcattcagaaggatggtttccttatacttcgaccaaattccttatgattatgataaccttctgtatacttgagggtataccatatttatatattgcgtaaccctatcaatataaggtatgccttattcataacccttaatatcctcgactccccctccgtcgctgtctcgatgacagagagagatggaggtcagggagggagaagagagagacagagagagctagagtagatagaggtagtagagaggtgaggggaaagagagagggtgagactcgagagactaacaggttgggctcgctgattttattttttaaaaaagagttgttgactcaattgtcacatagaaccaaaacaacttcatattaggttaggggatgattcgtttggtattaatagttgagaataaaagatatctagttttcagatttagggatgtaattagtactactcgtccaataattcataggataattcatacttttctcttctgaataagcctcaacggccgtacttctatcgaagtagaagtagtaccgagcaaagtccaataggatatttcccatgataccttttggatctgggtagagatatcatgtctttatagtactgatatatccttttctgaaccgaagataatactgatatctcttccatttagaaagcaaatatcttagctcgcgagtggatccatcatccatgtgtaaagctggagtagtttggaaattgacaatgcatgtcgctgtactgccgcatcaatgagaagatcagaaaacgctatccatgtgcattatactactcctacgtgctaacagggcgtcggcccgtttagaatccaaaatcttcgggtggaagcaaaggattgcgccataatcactttttatgccttacgcagatcttttccggacacacggtggtaatatcatactctattttctctactggtgtactccagataacaatgtgacaaggcgagattctactccatttctggccatcgtggttgtaacttgtagatggcaagcgtcctttcgggcctatggatggtcatttgctaattgcttacaattatcatctctctagtggctcagctaacacgtcgagtaagtacaatttgatccacatcattacaaaatcactatttaaaatatatcattactatttataaaacctattatatgatcactaaaattttacaaaatttaatccgagccattgctataacttgtcgtcgtgccttaggcctcgccagtgagccactggagagggttggcatcgaggatgaagaaagactgccgtatacagcatggggccagggcaactctccctgggcaccttcctagccatctggccaaacaacagtcgtatgtcatgagatatatatgtcaccaccaccacagagttcgcgaatgtctatggcatgaaagattgtgaaggtgtctgagacgctggtgcaggcgccgaagaagatgccgacgcgacgacggtcatggctagggcaaagatgagtggcgagacatcttttcgcctccatttggttagatttagtgtgcggtgctgctacactagctgagctctagccctgaactactacaaaggttcactttattttctaccactatttctcttttttataactctatataagttaaattccacgtgaaatttcgataggatgataaatgcatttcaatttaatctatatattttttctcattggagtaagttcaaagcatataagaacattccacacgtaagctcgagagaaaagaacaaacgagtcagcgacggcgatgttctggggagaaaagcgagcgacgagtcgtctgctcgtcgcgcggcgcggatgctcggccgcacgcacagcgcaggtacacacatgggggtggcgccgtggtcgctgccgtttcgattcgcattcgtggaattgtcgtgagctcgtggcggcagcggcggcgcagcgcgctttcggtcgcttgcgatccgttggtcggccgacgtggcggtcacgcgtaggccggtccggatggcatcggatgttctactagcagcctttttggcacagcaaaagcgaaatctttcgccgctttacagaacggcatctcggcgatttgcgctgcacagtgcacatacgttggtgctttgcgttcatgtgcttctttcgcttgcgtgagtggtgctagtagcagttatccagcctcttgctccgctggaaacatcggcagatctgccagtgccaagtactgggagaattagcagtctgaatgtctgatggcgaactcacagtcacagatgcaagaaaggatttgtccttaaggtgctttgcttgagaaaaatgctggacttgaagttcaccgattgcatcttagttgcttccaggcttagaagtacgtacaattcaactatatttagttaagaaaaatcaatttcagacccttctaagaaaaagtaaaacccctagtagctgtcaagtgcgaattaagtctaaaacgccactcctgcaccaagtctaatttactgtattccatttttgttgatctccctgctgttgcaccggcagagactgtacgctctattacggattgggtggcgaaatttgttgtcaagtcgagctgcttacggaaaccactagcaccctgcacccgacttgttccacaatcacccgctaacccaccaaatcgaccagaagagaccgcgaaacgataaccaatccaacgtttcgcgtgaaccaaaccatgttggaagtatgcggtcatctcatcttcaggtgctttaataattcctctgcacttcgagaaggcactgcgtgttgcgtattgcactgaacaatctttaaccgtggtcacaccgaaaattattggcgaccagaggagtctctttcgcccgggcagtctgctaccggttgatgtttcaatttcagtcgcgttgttttggttattgctaacctaaccggtgaccatccggggatcgaagtcgagctcaaataatttggttctggttctactcggacagcgacatcgctgttgccaggggcggacccaaggggtagtccagataggcctaggactaccctagaatttggcccagagaagacccagcattcagttttattggcccacgaaaaaagcctggcccatcaaacaaaaaaaaccctaatatattcttctctctcccgtgcaatctcccctccctttccgccactgctcccaagtcccaaacgaccgacggcgacgacggtcccgcgagccgcgactccggcgctcctgccgtcccgcgaggccgctactcgcgccgtcgttcctcccgccgcgtccagctggcgggcggcggcctcccggctcccgccaggcgcgcgcccagccgtggcagcggcgccgctgccttcacgcgccgcgccggcgcccacgcggcgccgcggccgcgcactctccacgactcccttcgcccctcgccgagtcaccagcgtgccccaggcctggccggctagcgcaccctctccggccggcggttccagcacccagccggcagccgcccaggcgccactgcctctccgctccggctctccgcctctctggactccggtgagtaattctaaacctactagctgattttgtcattactttttggccgtattagccatagatgtacataatgacaactatcatttaggcattgaacaatatcaacaaacatgtttagagaaattcttggaacgattagttatacatgaagtagaatcagctattttcctatttctgaaatagaggcgaaagaccgagcaaaccatactactagtgtactaccccttcaatttcatatgacaattttgcatggtttgatggttgttaggagattgagcgtgatatcttctctgatgtaagtgaggaagacataattcactctttcgggctgcagg

SEQ ID NO: 20820 - DNA, 13476 bp, Oryza sativa
agcaatcctccggcgccacacatacactgatgcctcgacacggttggcgatttccagtgcttggtactccgttgacaggtccaggcagtcgagaaggcactcaggagagaaatgatcagacgttatgtagcggtatatgatgtcacccaaagttgcccttccattctacatccaagatgaaggtaacaagctgagatcaactaaattacacatgaaatggcagatgaggttaggtcagggtagagaggcatggtacctttggtagggattctagatacgattcagggacctccatttcagctagagcattgctgttgatggccaaggcagccttcaagatttgattagcacagtcacgtttgtgctgcagttgcttcctcgctttgtcacgcaggcctccgggaggaacacgaggcaccggcaaccaccatttctcatcacggcggtggaaagctgctctgaaggaagctgagccatcacaatccggtgcgcatatcccttgttcaacgtaccagaactcagggtctctgaagctgtccaggatttcctgagaaatattgctctgagaaattactaaatgtccgtgttaaggttggattgtattgaattcaccgacgtgaaaaactcacaatgagcatatggtctagcttccgaagtgctggcagattgatgtataaatcagatcgtggtctgcttgtcatgacctgaaatgttgcaacaggaaaaaaattgtagcagtacattttttagtgaggaaaggcaaacttaatagaaaaactgtacagcatttgtcagttcgaaaattacacgaaatcaagaacacggaacacgtatttcactcatgtatatgcagcactaattacacgcactactgctcattgccaatggattcagtactaataggtggttagtaatcaatattctgcaatatttggcagccgcataacatgtactagagatttggtttggtttcactatttcagtacccacgaccaagggctgcttatcatcttcctacgttgtcctccgtttcatattataagtcgccttgatttttttaaaagtcaaaaattgtttaaaaaatattaacatttatagcatcaaattagttttattaaatttaacattaaatatattttaatagttttttattttatgttgaaaatattgatatgtttttctataaacttggttaaagataaagaagttcgacgtttcttttaaaaaaatcaaagcgacttgtaatataaaacggaggtggtattcaaattttcaaattgcgttgtttaattagatgtatgtaaaacatgttatgcgtgcatgggtttttctattgatcccatttaaccaaggatgatactccctccgtttcaaaatgtttgacaccgttgactttttagtacgtgtttaaccattcgtcttattcaaaaaatttaagtaattatttattcttttcatatcatttgattcattgctaaatatactttcatgtacacatatagttttacatatttcacaaaattttttgaataagacgaacggtcaaacatatgctaaaaagtcaacggtgtcaaatattttgaaacggagggagtatattgatatgggcatctgttgtcatgttagcatgtccttccatgacattacattcgtttggttacagtttaggactaagttcagatacggaaaacatgtttagttaacaggtttctcctttctgtggctacagttctcgcactaaatataacaaaagctgcgtatgtacacggggtacgtgcactgtttcagtatctacggcctacggctgtttatcgtcctgctctgctgtatattcaaattttctggttgcgtcgtttaattagctctgtatgtaaaacatagcatgcgtgcacggcctttttattgggtacagatgcgaaaatatacaacagttacagtgatacagtaacatttttgtctttcttctccatgaagctgaattcagataggtaaaaacagtttgctaacaacggttcgatcccattttctagtggtccttgtgcaactaaagtcaccattatgaacctttcccgtgcagtgccatggtatcaagttctatggaaagccagcagttgcacttgtacttatatagagcaaccgctttaatagcctccaatttcagaattgaaccaacaaatcctatcgccagacagcgcagaggtgttgaataatcaaattgaaataatgggagttaaccggacaagcaagacacttgatgaaccgttttgaatttgcagctcctgaattgagccagcctacacgggttgatctgtctgtgaccgtacgctttgagtagaaaaaatggcgcggtagccgctcagggcctggagtttactaaaagaaaattttttcggtgtttggatgtttgacaggacgttggaaggggttttcggacatgaatgaaaaaactaatttcataactcgtctggaaaccgcgagacgatttttttttgagcctaattaatccgctattagcatatgtgggttactgtatcatttatggctaatcatagactaattaagctcaaaagatttgtcttaccatttctttctaattgtgcaattagtttttttaaaattttatatttaatgctccatgcattgatatttttggaattttttttaaaaaaaactaaaccaggcctaagtgataattgcagccagatcgagctgctatgctagtgcgtacctcgagcctggttccgtcggggaacgattgccaggtggggaccagttcgacgatgtggtcgctgacgcagagcagccagcccatctcgcgccgccacatggccttcttctccggcgggagtggctccagcctccacagctgcccgaagatggtggctgcaagagacgcagtagaggtgcgttagtgctagtacactgtacacctaagtagagctccacattgatcaaacggaatcatgaggtggggagaattctcaccgcagaggttggtaatggcgttggcaatggcgagcgccgtgcacacgcccttgccgctcccggacatgtcctccccgagcagcagcttcgcgaacctctccttcatcatctccatctctgctcatcaccatgcacaagtatcatcagtacgctgcacaacctgaccaaggagaagaagagcgcgcgcattgctcggtagtgccggtacctgagctgggagctctgcgcttctgcgcgtgcggcttgctgctgtccaccacctccgcgccggggacgcggccgcacgccgccgtcttcctgggcggcgccgccagcgtcacgggccactcgtcggccgaggccgcgtcggagctggagctgctcccgtcggcggagtccgtgaacgccgcctcgctccgcgcctccctctcctcctccccgctccccatccgatcggtcccaaccacgcgcgcgtgacggggtctatctaactagttacacctctccgtacgtgcgcgcttgctttcgcgggcgcgggtgtagtacgcgcttcgctgctccgttcctcggccggcgcggccgagttcagctccgcgtgcgcgacgagacgcgcgcgggcggggcgtggcgtggtgatttgcgcggcgttttggcgtttcggtctcggtcgtggcgcggtgcggtgggcgaacggaaggctaggcgcttaaaaaagttgggcttggctggtcgatggggaagagtgaccgttgggttttgagttgtctgggaggccttggcgagtttactttttagaggcggagagagagaaggagagaggttttccctttgtttttcttttgatcggggagggtgggatggaaatggaatcatggaatggaacgggcggggcggcagcggcgcgcagtaacggttagcgagtgaggtggaaggcgtgcagataataaagaggctggatcggcgtgatggaaacgctccctccttgctgctcctgcggtgctgccgttctcgttctctcgccttccccttgttggcgactttccgttgcacgctttgtgtcgctataagcacagaaagaaagtaaggaaaaggtaatggatcaggaaaaggagtattgatcaatagcacgaccgatccgtccctaacaatcataattaaggtccagtttgcatagcttagattgtgagaagtgaaaatctagagaagctgacaagccattttctagattctacatctacagttttttaaaatcttggtgaaaatctggactgcttaggagagcttctgttatcttttcaaaatgtgtttatagctggcttagagcagatacaatagcaaactataagccagcttaaacacatatcgaggagataaaagaagagagagaaaagcaacgggctacagatttgtagctaggtgtatcatggactccaagacacaatgtatatatgacaggtgagaccatgtattaatagtctagtatatatttataggtaattattgtactcaatccgtcccaaaatataagaatctaagactggatgtactagtaaatgtctcatccggttataggttcttatattttgggacggatggagtatgaattagttattagggcaacaacaatatatatggctaaagtagtacatatagatgggacccacatatatggattttaactattgtaaccttcacaatgtatatagatagtaaatagcattaagaggagaaaaaaagtagagacacataatatattttatcctctatgggcagcccatatgtttgtgggtagcttttgttatttctttgttatgaactagttccataatgttactaggtggttgaatggaatactatattgcttatgtaccagtttaggactacattgtggatgcccttaagttgactataaataatttagagttagtagttggttatattgttaaacttgctcttatttgctcttactgtaggacactgtcaagttaaggtcatggagagcaagccgttaaatatggaaagaaaacacggtggcagccagtactgtttgaatgtcagccttgtttactccatgtgagagaaccccaacgttagactgtctccaacagccttcacccaaattcattcgtttgggtcacgcgggatgtccgggtcacgcacccaattctttcgttctccaacaatggacccaaacgagcgttgagcgccgcccgcttccctccccgccgagcaccgcgcctccctccctccccgccgcggacctgcctcgctacgccggtcgctccccgttgcgggcccgactcaccgtcatcgtccgagggctcgcctcgccgcgccggcgtctaaacccgactcgtctcgtcgtccgcttccgcgtccccgactcacgcgggagctcagccacaagtccggcagcgagaccgtgcagtggcgggctgatgcagcacccgcacgagaaggatgaccgcgagcacgcggtggcggcgagcggcgagcctggatgaggcggttgcggggcgggcggcaccgatttgggtcgaggagagagacggacgcatttttgcgttctcactcgactccgacgcaaattgcgtctccggtttgggtactctgttggcctccgattttttcatcggatgacccatatgtgggtttaggtaccgtgatgggcaaactgttggagacattcttagggacccaatgtcaaagggtgcatcaattttctactcctatcttcactcactgggcatccccacaaacacataaagaacgttccaagtccgacacaacacggtcccatacggagtactgtattctgctccgataagccaaaaaagcctgtgttgatactgtgcagcagacgctctgagggccaaactccgaaggaagctacgcttgtcgcggcgtgcctgtccgtccacgcttccccactgggctgcacacaactaacccagcatgccacgccacggctcgagacgagcgtccatgcacacggcaatggcaattttctccgtggcgcggcgtgcgtcgcgctcggctcgcttcggcacgggcagccaggcaggtctcttccagagtgcaatattttggcttggcgtcatgtgacatcgcgcggcacctgatcagacctcattgcagggtaagctgagacactcttcaactggtaagtgttgtcgtgtggaccagttaagaggggaagtcaaatgcatagttcagttggaaggtcgatgtgcacctttagatacagcatttggtgttttggtccttgtcagtgtttggctatttatgtgcctagtttagttagcgtgtaccggccgtgtcaccgttgccggtggccgacctccatttgatagcagctggtagatggtcaccagtcaccaccatgctggtagctggctataagccagctataaatatattttaaagagataaatgaagagagagaagagcagcgggctacagatctgtagccagctgtagtacggagtccaagatgtaacgtgtgtatgataggtatgatcagatattaatagtatagtaactaactattatatgaattggctattaatgatttggagttagtagttggctagactattaaacttgctcttacttcaagctggagctctacacacaagcaagttgatggcgtaataaaaaccaaaggacgactgaagacaatatctgtgttgctttagaaaactctgaattttccaacaaaaggatccatgtgggcgtgctagagagtgatgagagcacacgttggtccatgaggctatatggtggtgtattgaggaaaagcatgtcctcattaaaaacgcaacccaaacataccttatcggcctcacacgccgaatgtgacacgggcacagggcgtgcgtatggactgattctcttcacccgggcgcccgtcgtgcaagcgtgtaacaatggcgaatcgtgatacaacatcttcctgtgtgacattcgtaaatgcagttgcacaactcaagcttgtgcgtgtagaccattactttccactgggcgttgggcaagcacacggttacacggggacacatagatagaaggggaagcaaacagttcggtcctattggatcgggctattatttgcaggtcgtcgggggtaaggaataagtctcttctacctccctcaactcacgtctctggttgaatagtatccctcaatcgtaaaaccgggtgtaacccatcctaaactctaaaaaccgatgcaaatcaattcccctagttttggaggtggttttgtcccacgtggcattttctgactccattgactagttgagtcatcttgtggaacccacatgtcagtgacaagaataaaaataaaaaacggtggggcccattatcagtggccactgtagtcgcacacattccccatgcggctacacatcgccttcgcacgtcccccactccaatccgccgctgccgaccgatacgcccccccacccaccccacctgccctaggcgccgccgaagtcgacgctctcctccagcgtgggcgtgcgcctcgaggacaccgtgctcctactcccacgtcatcattgtttccaccctggtgcccaagattgttaggctccacctccccggcatccacctcgatgacgacgcaaaggccactgcttccttgcctctagacaccaccatcaagcctcccccctcttggggtcacccgccagccaccgccgccgccaccacgcaatgggggcaaagggggaggaggagggaggacgcgagatgaggagtggcgaagaagccttgtcggcgcactcaagccgggtcgtcacaggagatcgatgagggtgttggccgccgccatgccgaggagctactccccccacgcagacggccgatgatctcatcccacgcgcggctatcgtccgtctggcgagctcctcccccatgcaccattgccgccaccctgcctctattgatggaagtgaaaggagaggaagagatgagagagagggggggaggtgaggggaaaaatgggatgaggtggagaccactgacaagtgggttccatctgatgacttagtaagtcaactgccatgttggacgaaaccgcctttgaaaccacccaagagtcaatttgcaatggttttgggagttaggggacaggttatacccggttttatgatggtgggatgctattcaaccagggacatgagttgcgggaggtataatagacttattgctcagggtaaaggttgttgttggtccagtccagcccagatattttattgtacaatacatatagagtaatcaggttggcctacttgctttaagccttttgggctgcgactttgcggcaatagcccatcttaaacggaaccgggccatgcatgctccagtctagctgttagaggaaaaaaagttcactctagaaccctcgatttatcacctagtttgtaattcgtccctaaaccgcattaacaaataaaacgcatccctcaacttgtaaaaccggtgtaaaccaccttccctcatccccccagcattccaccgcacctccaattccccatctctctagtgcggtgactgatggggagagggccggtgatcggcaggagaggagctagtcaacggctggcgggaagggcagcgcgcttccgcggtggactacctgccaccctcggcctttcaccgcacctctgattgcccatctctccagcgcggcggcggccaacggggagaaggccgatggccaatgggaggggagctaggcggtagcgggcttccgtgatggaccacctcacccctacccccggcctccgctgcaccttcggttccccttctctacagtgcaacggttgttgagtagaaggtcaatattcgacaacagtggagttaggcagcggcggtcgagtgagcttggccctcataactccttgagcggccgacaagagaggagttgggtggcagcgggtgacgacggcggtggccgtgtctgatggctcctccatgactccatccacgagtgcagcctctgcctttctccaagtcagcgctgtccttctccccgccgcgcgccactcgcttcctcccgtcggttgccaccctctccaaattagtggtcgtccttctccccgccaccctctgatcgggcatagccctccccgtcgggcacccctctccatgttggatgtggctcatctctccgccgctcactaccctcttgttgaccaccgctcattgccctcccatcagttgccacttgaatgcttgagaatttgagagatggggaagagagaaagaagagttggcagctaacatgtgttcccacatcagtcaaaactggacgctatattgcccatggatctcgggtacacctgttttgtaagttgagtggcgtgttatatctggtattgcgattcaggattgaattttagactcgattgcaaattgaaggacctcaagtaaacttattcctttgtcaaattaacaatgtgtaatctaatctgaacttcagttccgtgggccagacctttttcttcgacgctagacctgactacataaaagcgtagcttaaaactaatcccaccaaaaaaagccgcatttccatgccgaaaagcttcgattcgccgctatgatgatgtactcctccggccaccaccaatcaaaccagtccactgattcagtgattctctcaacaccggtggaaacgtggaagtgtgctcgatgctcgatgccctccttttccgccatctttttatcccaagagcatattttccgtgtcgcccttgccttaagagcagcatccactcttgcgctgccttctcttgttccaccctcttctctcattggccgagcagagctttgtaactgaagctgcagttgggtggtaggagatgaaggattgggcgccggcgatcatcgcgtcggcgctgttcgcgctgctgtgcccgggaggcatcctgcagatgccgggcaggaaccggccggtggacttcatgaacatgaagaccagcttggcgtccatcgtggtccatgccgtcatctacggcctgctgctcatgctgttccttgtcatcttggaggctcatctctacatctgatccgagtgtgttactgtgatttcgttttcttgatgacactgctgtagtgctgtgttttttctgttctctagtttctttagataacttctggacctgagaggcgctgaggacgcctcgagcccttgatccttcacagccacaaggcttatggaatactaataaagaagcaatgatgctttatgcttaaacagttcaagcaggagtcgtatggctctagttgactcgttgtttcaattggctaaagctcggctcatcggatgttcttgaaatcgaagagaagaattatgttccgacagtgatttttttatcagtttacatgcaagaatatagtgtctgattcaagcggggaagaccgaagatagaacagcatagtgactttgtcactgtgaactcttgtgccactttgttcttgcttgattcatacccatcccgtggcttttaatagcaactagtataatttttgcagttttgaacaaggataactcagatttcacagtgtgcctagtgcagatgtataaaatgtacagcgtacctgccagtgttgccgtgttgggctaattaatgtctttcttttaaagatagcagtaacatgttcagaactaacaacatgtattacgattccaggcttccagcttccaggtacaacagcaaacaaagacatccaggattattcaactatacggacatactccaatacagctgccaatgaaacagcactgcagtactattaggtgacaagttagggtacaacacgcaatatacattggattgtttctgtccaggatgcaggtttgcattgctgtaagagtagcgactactttgccttgacgacggtcacagggcaagacgcattcgacagcacgtagttagtcacacttcccagcagaatcctgcaaaaacaatttaaaaatcaagcaaagtactggatcagaaattcagctttctgaaaatgatgctacaaggggatattgtatcgctgcccctgatgaatctctggttgctcaaacagaaaccagaccgaaagtttctagaaacatgtcaatgctataccgtcgtatcattcacacacctctggatctggccgaggccacggctgcccatgacgagcgattcgagattgagctcccccacagcctcgcacaccttctccctcggctcgccccagtacatcttcagcaccacggacagctgatacaaacaacatcaggcctctcgacctgaaaggcaagacaaagcatgctgccatgcatgcagcaccagcatatatagagccagcctacctccttctcccgggacacggcgttgagcatgtcgaacacctcttcgtccgaaggtatatcatagcgctgcctcaccgccgtctccatgagctcctcgagcgggatcagcgctgcgtgcgatcagtacagagacgacgcgacatgacatgacaattttcgatgggagatcaaggcattcaaaatttagaatgcaagaggtaaactcggtgcgtttctctcttagtattactattacgtacgtgatccggtgtgagaccagaggacgttcttggcctcgtcgcggccgtggtgccggatgtggaggaggacgagggtgtcgcccttgcggaggaggttgtcggccgcccactgcagcgccttcttgctgctcggcgagaagtccatggccacgccgatcctgcgctcgccgcccgcctccgtcatctcgatcccggagcaaacgacgacgacgacctctcagtttcctttggtccgcgatggtctatgcggcacgtgtgggtgtggctttgtgcgcgtccccccgggtttgcgctggaatttgttgtgttttcgatcggtgggcggtggtaggccgtgggacgctggatgtggtgcgacacgagagagattcggcggtgcgcgaggccgcgccgcgcgcgcgctgggtgtgcgtcgcgtacggcgtacgtacgtttcgccgtgccatgcgtcgtgccacatggccaaccatgcaggcgaaggcgccgggggatcagacgcgtggcgcgttggccgggcacgcagttcggacggttcagttggggacttcaaaggaaagaaagtctgattgtttctgaattctgatctcacccggattcaacccttaccgccgctatatatatataaagttataaacatagattttctttctcgtgtatacgtttcctataccgccgcatctgcttcatcgccatctccatctggtacgacgataatcgactttttctttggttattaaatgtttcgaatcatttatcagttcccgttaagatcaaaagttcttggtaattagtagcaagaacgtggtactagatacaccgactctcatatttcacttcctttttccctcaccatatatgtttcctaagattggaatattatgaacgcgagattgtcaaaacacattaatagaaaaatcatagaagtagaatatcatacttattagattcttatagaattttgaaatataagaaggcttccaaattgtcgtttaattgataaacagcatgcagattttaggaactaacaatacatgaagaagaaagcatgaaatacatgaagaagaaagcatgatatgagattctatgattattttcctctattttttctagaatagtccattccatagattttaaaggaattgatagaaatcaaaccctttttttcaaatgtctcattaggattattttacataggatattttttaaaaaaaaattatgtcttttatttgtttcaaatgagatcttagagtgctgaaatgttctcgctagcaccactttatccatgaaccggaaaattttcgacattacaaaaacctagttcttttctatttcagaaaaatacctgtttcaatatctaagtgaattgtaggctgtatttagatggtggaaaagttaggaagttgggagaaagttagtagtttatatgtgtagaaaagtttttaatgtgatatgatatgatggaaagttgggaatttagggaactaaacacggccgtaaactgatggtcatgagtcataactgtattcccccgtgagtgtttgttttatgctaccaaaatactactgatggagttatcaaagcaagattaggatttttattatgtagggagaataatagataaacaagttgatgatgcgtctaatttaagatcaattcatttatgtaccaggcaaaaaaaaaatgttgggtgttcttttcctcataaaccgctgtgtgaattactctgatgcattcaatatgcctatcttacgtatacatcttttatacttatacctggctggaaggattattaatatgtcatttaaggccctatttagtttctaaaaatatcacatcgaatatttagacacatgcaaggagtattaaatatagataaattaaaaaactaattgcacagttaggggagaaatcgcgagacga

SEQ ID NO: 20821 - DNA, 519 bp, Oryza sativa
tgctgctgtccaccacctccgcgccggggacgcggccgcacgccgccgtcttcctgggcggcgccgccagcgtcacgggccactcgtcggccgaggccgcgtcggagctggagctgctcccgtcggcggagtccgtgaacgccgcctcgctccgcgcctccctctcctcctccccgctccccatccgatcggtcccaaccacgcgcgcgtgacggggtctatctaactagttacacctctccgtacgtgcgcgcttgctttcgcgggcgcgggtgtagtacgcgcttcgctgctccgttcctcggccggcgcggccgagttcagctccgcgtgcgcgacgagacgcgcgcgggcggggcgtggcgtggtgatttgcgcggcgttttggcgtttcggtctcggtcgtggcgcggtgcggtgggcgaacggaaggctaggcgcttaaaaaagttgggcttggctggtcgatggggaagagtgaccgttgggttttgagttgtctgggaggccttggcgagt

SEQ ID NO: 20822 - DNA, 3059 bp, Oryza sativa
ttgtcaaaccgttgtcttagatcgttgtgttagtttgcttgtttaagtttggttgtgtgggtcttgcatgtgatttacatcagtggtgggatgtaagtgcatgcgtttgtttgcttttgagtgttaggaagttggtgagtttagtggtgtgagagtcttcagttttgtaataatgaaactcagttaagatcaataaaagttaaagtaattctctgccctaagtagttttccccggtttctcttcttgtgccctgcccatgccagatggtgctcactcgcagcaacgggaatggccccaatagtaacaataacaataacaatgaagggaacccaactcttgcccaagttcttgctcaacagacacagcttatgaacatgatgatgcagcaactccagaaccagcagaaccagggaaataaccatgcacctccccagaacaagttagcagaatttcttcgtgtgaggccgcctattttctctagtaccgctaatcctgttgaagctggtgattggctgcatgccatagagaagaagttggatttgcttcagtgcaccgatcaggagaaggtctcatttgcatcacaccagctgcatggccctgcctctgaatggtgggatcacttccgccttaataggattactgctgaacctatcacttggcttgagttcaccgctgctttccggaagacgcatataccatcgggagtggtgtctctcaagaagaaggaattcaggtcgcttacccagggatctcgctctgttaccgagtatctgcacgagttcaatcgtctggctcgttatgctccggaagatgtacgcactgatgaagagcgccaggagaagttcttggaatgacttaatgatgagctttcttatccactcatgactggggattatcctgatttccagaagttagtggataaggctattcgtcaggaggacaaatacaatcgcatggagcagaagaaacgccggattgctcatttcatgacgcaacaggggaataatcagaggccgcgtcttactttaggaccccagtccatgccacagggaggttcttcgtctgttgttcgtccgcagcgtcagttcttcaacaacaatgctggcaacaacatccgcaatcaagctccacgccctgttgcagctttgacacagcaacaacctgccaagaaggagcaaggcagcaagcccgtggtgtgtttcaactgtggagaaccaggacattacgctgacaagtgtccgaagccccgacgcgcgaaggttgtccctgcccagagcaactctaccgcaccagcatcaaaggcccgtgtcaatcatgttgctgctgcagaaactcaaggtgctccagatgtgattttgggtacgttccttgttaacttagtccctgcaacagtgctttttgattctggtgctacacattcattcttatctatgagttttgcgggaaatcatgggatggaagtagaagatcttagacgtcctttgatggttaataccccaagtaatcaagcactctctttgcaacatagccccttctatcagaatagaaattcaaggagtaccatttctggccaatcttatcctgttagaatccaaagaccttgatgtcatcctagggatggactggttagccagacataaaggtgtgatagactgtgctaacagaaaaataactctcaccagcaatgatggtcgagttgtaactgtgcatgcattgtctcctgagtttttaaggtcaagactgaaccaaataactttggaagagattcctatagttcgggagtatcccgatgtgttcccagatgatttacctggtatgccgcctaaaagggatatagagttcagaatagatttggtaccaggaacaactccgatccataagagaccttatagaatggcagccaatgaattagcagaagtcaagaggcaagtagacgatttgcttcagaaaggatacatcagaccgagttcatccccatggggagctccagtaatttttgtggaaaagaaagaccatacccagaggatgtgtgtggactatcgtgcactaaatgatatgactatcaagaataagtatccgctgcccagaattgatgatttgttcgatcagcttaaaggtgccaccgttttctccaagatagatcttcgatcagggtatcatcagttgagaatcaaagaggaagatatacctaagacagcttttaccactaggtatggattgtttgaatgtactgttatgtcttttggacttaccaatgcccccactttcttcatgaacttgatgaataaggtgtttatggaatacctagacaagttcgtggtagtctttattgatgacattcttatctactcccgaaccaaagaagagcatatagaacatcttcgccttgcactagaaaagctacgagaacatcaactgtatgctaagtttagtaagtgtgaattttggttgtctgaagtgaagttccttggtcacgtcatctcagcaggaggagttgccgtcgatcctagtaatgtggaatccgtaaccaactggaaacaaccaaagacagtttcagagattcgcagtttcctaggcctcgcgggatattatcggaggtttatagaaaatttttccaagattgctaagcccatgacacgattgcttcagaaagatgtgaagtacaagtggtcagaagaatgtgagcagagttttcaagagttgaagaatcgcttaatatcagctcctattttgattttacctgatccaaagaagggtttccaagtgtattgcgatgcatccaaactggggttaggttgtgttctgatgcaagatgggaaggtggttgcctatgcatctcgtcagttacgtccgcatgagaagaactaccctactcatgatcttgaattagctgcagtagttcatgcgttgaaaatttggcgtcattatctttttggtactcgtacagaggtgtataccgatcacaagagtttaaagtatatctttactcagccggatttgaacatgagacaacggagatggttggaattaattaaggactatgacatgggaattcatt

SEQ ID NO: 20823 - DNA, 1938 bp, Oryza sativa
tctcaaggaaagattttggtgggcaagtatgaagcgtgaaattgcagaatacgtagcagtatgtgatgtttgtcagcgagtcaaggcagaacatcaaaaacccgccggtttgttgcagcctttgaagattcctgaatggaaatgggaggaaatcggtatggatttcatcactggtttacccagaacgtcatcaggtcatgactctatttgggtgatagtcgacagacttaccaaagtggctcatttcatcccagtaaagacaacatattctggaagtcggttggcggaattgtatatggcaaggattgtgtgtttgcatggcgtccctaagaaaatagtgtctgatcgaggcagtcagtttacttcaaaattttggaagaagcttcaggaagagatgggttctaagctgaactttagtactgcttatcatccacagacagacggacaaaccgaaagggtgaatcagattttggaagatatgttgagagcttgtgctttagacttcggtggaagttgggataagaatctaccttatgcggaattttcgtacaacaacagttatcaagctagtcttcagatggctccttacgaagcactgtatggtcggaagtgccgcactccgcttttgtgggatcaaacgggagaacgtcaggttttcgggacggatatcttgagggaagcagaagaaaaggtgaaaatcattcaagaaagattgcgtgtggcccagtctcgccataagagttatgccgacaatcgtcgtagagatctaagttttgacgcaggagattatgtgtaccttcgtgtcacgcctcttcgaggggttcatcgttttcataccaaaggaaaattggcaccgcgttttgtgggaccttataagattatcagtagaagaggagaggttgcttatcagttggagttacctcaatctttggcaggagtccataatgtgttccatgtgtcgcagttgaaaaagtgtttaagggtacctaccgaagaagctaatcttgaacatatagaagtccaagaggatctgacctatgttgagagaccaatccatatcttggaaatagatgagagaagaaccagaaatcgagttatccgtttttgcaaagtccaatggagtaatcactcggaagaagaatcaacttgggaacgagaagatgaattgaagtcagctcatccgcatctgatcgccagtgcttccgaatctcgaggacgagattctgtttaaggggggtaggtttgtcacatcctaaaaattcaaaagatataaattgttgtttaaatggaattattagaatttattttaaaaagctttgaagagaagatctaattttaattaataaattccaatataaaatggggccagataaaattttattaaatactttgcttaattctataattcctagatttttctgggatttatttgagctaaggaagtatttttaataaatggaattgcatttcatgaataatttaaattgaaaaaggttttaaaaagtcttcttttggctttgggccgaaagtcggcccaaaacccttccctctctcctcggcccaagccggcccagtccgcagccgcccgcgcgcgcgcgtccgctcgctgacaggtggggcccgcctgtcaggtcgtcgtcttcctcgcgatggccgccgcccgaaaccctagcgccgcgccgccgccgtttccttccaaatacggtcgatcctttccttctccggccgaattgatagaggggaaatgatcctcgggatctcctctaccttttcccctttggaaatatcggctaatcggcttggaaagtgtttgattcgaagtcgaatcggatcggcttttctctctccgagcccgacctttccatctcgtcgccggtcgccgtgggccttcgccgccgcctcctagcccctttaaaaggacccccggagtcgccgcta

SEQ ID NO: 20824 - DNA, 2143 bp, Oryza sativa
aaatagaggttatcttattttgtgctagggtcgatttatagatggttcgtacacaccgtccgccgctagaaaataaacagaggacaatttttctttctcctagctactcccagcattcagaatctttttttgctgttggaatcacgcgaaagatggataaatatacaggagggatagccgaggatatcggcggtgcccatatccagtgcatctgatcggcggcgagatgcacgagagtgtgatggcgagcgctgtgaatcactgtgaggactgaggagagctgaaaagcatagtgcgggcggcgaaaagaggaggattcgggcggcgccgcgacagaaatatctcgttgtgtatatctcaacttctgaagacggaaggtggcggtgcccaagtgccaccggttaattagctgctgcttcactgaaagctccgtttcgaatccaggtgacgggcgccatcgaccaatgatttgtgactagattctcaaaaaataaaaaagatttgcgactagattcaggtaaagttgagtgagtgaaaggccggcctccttatttggcttattcgagaaataaatgaaacggtatatttacaaccgaaaaataatttataaataaaagttttatatacgtactcttagcgatctaaaaataaaggcagaaaaataaattttagtgaaaaaatttcaaaaatcaactttaaatttgagtgaaaatttaaattttggtcctaagtataagtataaatgaaaagatggtattcgtttccctaaaatatggccttcggtggtatccacgtagagctttacgttaactctgcttaatgattagagtaagattaaaaggtgatagcgttgtcaaccataaaaattctaggcaaaacaggtgtcgaacgggatcaaattcacagttggcgcgggggctgtgtacaccaacacgagatttttcgtgaagcaaaaactcgtggatggtcaatttcttctctcccatcacatgacacggtcttctctacttcattgctgacccaagagaccgtctcatatgcttcatttcttctcctcttctcttccccttcgtccccgacaaagcaccacaactccgcaagttttctcttttcttttttccccttctctctttcgcctactccttgttcaatcgattcttcccagctacgcgactcttcctcgctttctcgcttctctctctgcgccactgtggatcaagaaacagctttaaaatccaatcttttttaggcacctgatgcctcgtcggtagcagtatattttcaattcgttatttttttagagcttagaatctactggcagcttggatttttcttgggtggttgctcccagtgatcggccgcattgcttgcgtggtggcacaccgtcagctttggagtaacctgtaactgcaagagtgagtatttagtgctcgctttcggcgattcttgtttgcttgctcccttctctgctcttgtccggatttggtatagaagcaatttcgagtgattcttttcctttttttctcgaattgctttttttttttggtaggtttgtttggcgtgagcaatggtgaacgacggcgagcaggcgttgacgatcgctcccgccgccgccgcggattctagcgcggagccggcccgccacgtcggcggcggcggaggaggaggaggcgggcttgcggaggagagctcggatgaggataaggggagccagcgcttctccgacgcggaggaccactcatggcggtcgcactcgcgccagggctccgttgccctcgaggacttcatctcgacgtgcgcgtccgtccgctccggcgccggggacgcggacgcggacggcggcggcaggaggaagtcgtgcgtgtcggagtgctcgctgggcgacgtggacctcgaggccgggctggccgagatcagcaaggccagcccggacacggccgagaggaattgccgcatctgccacctcggcctcgagagcgccgccgccgagtccggctccggcatgttcctcggctgctcctgcaaggacgacctctcctgcgcccataagcagtgcgccgagacctggttcaagatcaggggaaacaggtaatatctctcagctgctgctaattccacacttcacttctgatgggctgcagga

SEQ ID NO: 20825 - DNA, 1491 bp, Oryza sativa
gtatgattaaccagtaggatctaggaaaagcttaggaaccccaacatggtgtagaacatttcagatggaggataaagttagattcctttcggtctgctttttcttgcagattcttgtgtaactctcatgatctccgaaagtggaagcgctgacccttttcttggcatgccttcgttgtggtgatctagactctatagggagtgctatggtgtcacattcctaaaagaatgtacttagatacttctacacgaacattatggccaatagtagttaagttacctgacggtcatttcattaagagatcacgagctatgtttatctgacatcgaattccaaggaactagactattagaattctcactggtatacatactaattaatcttaactattaaaaaaatgaagtgagaaaaaaagaagaagatggagggtcctcatacaagaatatatgagtaagatatagtaagctgaagattgtttcttatcctatccttgctcttcaaatcatttgatgagcatgtaccatgtagaaccaatatgaatggaaaataaatttgcatcaagctatcatctttaagcaattaaatgattggtgtttttcagtacaacattcccaagagaaatataacagatagtcccttgaggcaagcatccagatggatgggctattttctccctatacatatgttcactgttttactaacaccagtatttcctttattatgcattttatagttatagttactttttttagatagtgaaaatgttttacatccctagcctctagttactatgggatgactgttggtaaatgctaggaccagagctctgaattaaggtgtatttcacagccttttgtgtattactgttgcttaaatggaagggaatataatattgaaagtgggaacctgtttttgtgctagtatatcgtaccaacatagttacttgggttttatcacctcaattgaggtgaggattagagtcaggataagataaatacatgcttgatatttctgaccaaattacaagcatctgtgctattgatcagtgttgagatgtaactgcacttgtgcccttccacttcatgttgtgctttgatagtggttcaagtgaaatattaattgttaaagcattcataatgttgttactctctttgtattgtagaggcataaaagaatgtgttagcattattctccttatgatctgtaatataactacataagcataactccattttctgcttttgcaattggaatctagaaaattaaaatgctccatgttcctttacttgtcttaggatctgcgaaatctgtggctcaactgcatgcaatgtggtaggtatcggtgatgccgagttcatcgagcagtggaatgaatcaagtaacaccgcggcttcgcaaatgcctgccagtgaacctcggaggttttggcaaggccaccggtttctcaacttccttcttgcttgcatggtgtttgcttttgttatatcttgg

SEQ ID NO: 20826 - DNA, 1730 bp, Oryza sativa
tgtgaattatgttgatcatcagatcatcggtggtggaattgaaagcaaagaaaagaaatatctcatgcttcgttaacattagaatggtttgaacaagtttttgttatgtgcatacacatattctgtgtgttatctgtgtattacatttttgtcacaattcgagcggtacgggccagtttggtttgaggcctaaattaggcttgccaattttttggcaacctcaacaataattgtgtatgtttggattgaagccaaattttggcatgcctatataacataggccatttcaatagctaaattagtttaatttggcttcaatccaaacacatgttggccttaccaaaaattggcatgccaaaacttgcgtgtccatgcacttggccgtctggtcagctatcctgatctcttacccgcccggatcaatctgggtggttcaaatatataaagcacatccctggatttaatatccaccatgttaaatctgaagtttataagtcaaattaggaacaaaatagtttatctaaatgttattaatataattgtggatttagatttatggagctaagaatagctcattcgaagaaatcttggacttggagctatttcaaacaggtaatagcatgcaactgagatatgttgattgcagaacgatacgagataagcttgcttagaatacaactattcacatgagttttttggacgaaaggcgtcatgttaactacagccacttgacgaatttggtttgcccaaggaaggcacggagaagtggagaacccaggagaaatcagttcgaagattttttggggacagaagattttatactagtttaaatgaccaagatttgtgttggagtaaccgcagcggtcagcacgttggttggggtgcaggagagtaacgtgcaggtcgcaggaattctgggaggacgacgcaatcagccgagcaacatacaggaatgcagtcgactcaattgttggcgccttctgtaaaacgtaatgacagattctcaaatccatatgtctgctaacatgaactcctagttagggccccattttaaacgtagtagaaaattctccctattccaaccgaaattgaatttgtgaaacggctataagatcctacgattttattatgttctaaacaggggattgctgtgctatccctacaatcattcaaggtgtatgcagagacattgccattgccagcgatagcagagacatcagtctgctcagagcaagtttaatggtatagccagctattggctccaaatcatctatagtcaatttaatagccaattcatataatagttagagcaagttttgtaataggagtggttgccacatctaattttatccatgtaagatcagaggtgatatatacaatacatcacacctacactacctctagcatactaacccaaatgattttattttatttgtatgccatatccactctttctttcatcttttttttaggtttgtgtggaggttacatgacgggtgcctcattttctatttcctcacttatttcttccacctcatcatccaatcttatgcggcatgtttagggggggggggggggtggtggcaacacatctagctgtagcgcccgttccgtcgtggcgcctagcgggaaaatgtaattcctaaaaaccctaatttcgaaatctgtttccttgcttattgtctagtgtccgtgccaattccggatctcaaatccccgatagatcgtca

SEQ ID NO: 20827 - DNA, 784 bp, Oryza sativa
cccttcgttctccctcctcgttccatctcctccccttagactcgggtagtagcacgagtagcctccccgtagctagctggcgccgccccgaccgttgctgccgctcgccgtgtgctcgccgccatcgccgcccgtgctccgtagcacccgctcgttgccggcctcgctcggcgtagctccgcccaatccgacgctagcaacgaactcccggagtcgcgtagatgctctagctcgcccgaatcggtctcccgtcgtgccgtcgccgtttcccccttctctcgccaccggttgccgccaccacaatccgccgccgtcgagcatcccccggcaaatccgagtcgttggctcgtctcccctcatcccgtgcaaccttccggtgtgctcgctttcgcctgtatcgccgtggttcgccccgccgttcgcagccaccgtccgccgtccgttccggccggcgtcttcttcaacctcccgccggtccgcgtggcagccacataggcgccacgtcggcgccagctcggctaagaccgggtcgagctgacccggccagctgctccctccgttcccccccgtgcgcatggtccgcggtgagccatgaggctgcgcgtgggcccgccgtatccgcgtcctcctcgaaccgcgcgcatgcgccgcgcctcccctccccaaaccctagcacgccccgcgtgcacctcgctcacggtgagccgagtcgccgacaagcgggtcccacccgggaccacgcgggatggacccggcccaccggctctctctctgggctgcagga

SEQ ID NO: 20828 - DNA, 5349 bp, Oryza sativa
ttaaaagtcgttggccggggccaaccttgaccaattcaaaagactgataccttgcacatactccgaccgggcgagacgcactgtctcatccgtgtcgtttgagaagatctcacttagttgtttcagaaaagagtttaaataaaatcaattgcaaaaacaacagcctttccttgaagcctgcattaaacacttatttcccatggcttgctgagtacttctgtactcatccttgccctatataaataatccccccagttgctgaagaagatgaagcggatcccgctgacgaggagttcttccaggagcaagccggctacgatgagttttagggtttcagcctagttcctaagtcgcgcctgtgatgtatggtccaagtcttggcttccgtttcccttttgtaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagtcccgctcggggctagttcggggcgtgacaagagatggtatcagagcccaggcttggccctagggcgaaacccgacgtttaggacgaccctaaggatactaagttcaaaactacttgcgaaaagctaaggcttttttttttggtttctttattttcaatagtttgttgctaaaatggttactgatcttttctccctctttcaaaattgtagatggtagtgaacgccagcttcagttcccacggttttggtgagggtcaccacgtcgctcagcttcgtgacctcgcccgcttccttggcttttcgtgtcccgagtacacggggtactccgtggaccatgttccccctcgctgtgagctctctgtgtacctttaccctcgtggaggtatacacggagctggtcttcgcccacaccacttcactgtggctaggcccactctccagatcgcgtaccaggacctctcctggactgcgcttcgtcgcttcgcccacgactacagccaccgtctcgggggctctgccttccggcagcttccacgccttccttctggccacgcagacgccaggtacccttgtccgtacaacgagtctcagctagtgctgactcgcatggttgagctttcggaggctcaggccactcagcacgacctactcctcgaggcttaccgctcccttgcccgccgctacgccgctctggaggcccgtctggccgaggagggagtcacctcagttgacactgtctcttgggactcaggccgcctctgccacgccagccacctatcctcccacagctctcgcggctctgcccgcactcccagtggcccgcgctcccccagcttgcgtgcgccgtactcaccagtgtactccccctacccacacccagttagcccctcctacacccccggacacactcccgttgcttcctcccgccgtggcccacgctttatccgcactgcgcggaagcgtgttgttggttcttccaccgtgttccgcttcgactacccagctcccccaccgccagcggcccgtgctgctgacggctctcgacaggttccgctggtcccttcgcgtcagccgatcgacgtttcttcgactgaggagccgactacaggaggcagccaggcagacgaggagtaaaggaggcagtcttcagcagccgtccgtgtgttaggcccttttgttccaccgccaactcctttggagtcatggcgaggtagtgcatgcgtgcgtttgatgtgggtgttgtttggtagtctggttctcctaggtggtgtgcgtacagtcaagctcggcgtagctctgtgacttgtccacacccgttgtatcaggtgtttttatgatttgaaaaatccagtttatgcctagtgcgtgctatctgagttgttatttactttgctccttgccctcctaagtgcttatctgattcttacctcgccctctcctgggagtttagatggctagccgcccccgccgtgctgctcgtgcaccagcccgctttggttttgaggaaggtagagttgagccaggagcaaatcatgagtcagctaatgagcaatctcaccacagcaaccgttcgcaccgtactgcttcccgcaatgcagaagttgagcaaccccgccgcagcaaccgctcgcatcacacagcttcccgtaatgcagagatggaacagtctcaccgctctcaccacgctgccggtcacaattctggagaggaacgcatcccttccccgcctcatgtggaaaacaacatgcaacacttgatggcagttcagacacagatcttgcaaggattagccgcggccatagccggctttcagcataatgcgtatggaaatggccaccctcacatgggcaacaatagatccaaactgacagacttcctgaggtctcgaccgccagagttctctcagaccgtcgagcccgttgaggctgacgattggctgaaggatgttgatagaaaactcaacttagtgcagtgtactcctgttgagaagacgctctacgcctctcaccagctaagaggacctgctgcagattggtgggagaattactacaatgcacaccctgaacccactaacattgcttgtgatgagtttgctacggctttccgtgcagctcatgtgcctgaaagcaccattgatatgaagaaagaggaatttaacaggcttaagcaaggcaacaacagtgtcaatgagtacctaagtcagttcaacaagttggctcggtatgcccctgaggaagtggacacagacaagaagaagatcaggaagttcttgaagggaatcgcagttggaatgagactccagttgcttgctcatgacttccccacttttcaacatatgatcaacaaggcacttctacttgaggatgccagaaaagaggctaccgaagaatacaagaaacgcaagtctaaccatcaggggaatttttcccgaggcgcaccacgccctcgctatggtcaacccatgcaatatcaccaattggtcactcaggctaaccgccagccaggctacgcccctcgtccttagatgaaccgtccggcacctcagccacagcagcatgccccaagtggcaacactgcgccaaacagtgttacctctttcaagtcaccgctaggactatcagcagttcagtgtttctggtgcaaccagatgggtcactatgccagacagtgccctcagaatcctaccaacaccaactcagggcatgctaatggtagcactgccagaactcctactctagcggcagctcagtctcgtcctagctctcaggcaagtggacaaggttctcgtgcttccaacaactttggtcgaggccgggtgaaccacattcaagccgagaccgctcaggatgctccagacgttgtgatgggtatgttctctgtcaactccgtacccgcaatagttctgttcgattcaggagctttccattctttcatatcacaagcttttgtgaaaagaaatggttggaaaacccaaaatttacgtgtaccaatgatagtacattcccctggaaggaatataagggcaactcaaatatgcccggaagttaaccttagaattgaggaagttgacttcctagccaaaccgatagtcctagactcgcaaagcttggacatcatcctagggatggattggttggctaagcacaaaggacagatagattgtgccgaaaggtccatcaccttgcaaggacctggaggaaagcaagtccgctttacctctaacacccctaccgcaagtcggtctatcctaacctgtttacaagtcacctccttggagtcggtgcccatagtctgcgattatcccgacgtatttccagaagaattagcgagtatgccaccagaccgagagattgagttcgccatagaactggcaccaggcaccgcaccaattgcaaaaagaccctaccgaatggcagctaatgagttagcagaagtcaaaagacaaatcgaagaattggagagtaaaggttatgtgcgacctagctcatccccttggggagccccagtgctcctggttaagaaaaaagatggctctgagagaatggtaatcgactatagagccctgaatgaagtaactataaagaacaagtacccgttgccacgaattgacgatttgttcgatcaacttaaaggagcaagagttttctctaaaattgacttgagatcaggttaccacaaattaaaaatcagatatgaagatatcccgaagaccgctttctcaatacgttatggtctatatgagttcacagtgatgtccttcggactcaccaatgctccagcgttcttcatgaacttaatgaacaaaatcttcatggaatacctagaccagtttgtcgtggtattcatcgatgacatcctgatatactccaagaatgaggaagaacatgctgaacacctgaggctgataatgggaaagctcaaggatcatcaactattcgctaagttctcgaaatgcgaattctggttggaccgagtagcatttctgggacacgtgatctcctccaacggtgtcgaagtagatcccagcaaggttgaagctgtacttgcttggaacccgcccaagaatgtgtcagagatccgcagcttccttggcttagctggatattatcgaagattcattgagggattctctaagctagccagacatatgactgagctgttaatgaaggaaaagaaatttgaatggtcagcagcctgtgaagacggctttcaagaaatgaagaataggttgaccactgccccagttctcaccttgccagatatccgaaaagattttgagatcttctgtgatgcatcaagacaaggcttaggatgtgtcctaatgcaagaacgaaaggttgtggcctacgcatccaggcagctcaggcctcatgaagtcaactatctcacccatgatctcgagttggcagccgtggttcatgctcttaagatctggaggcactatttaatcgggaacagatgtgaagtatacacctgacggagggtggggctcctcaccgggagaccgcgcaggcccccctttgccggttcggccgggggtgctaagtgagtttcttcgccctcgatctgaggaacgtcagcgagagaggaaatgcgcaagacacgggcgacgtaaacaggttcgggccgctgagaagcgtaacaccctactcctgtgttctggtggatctgtgcgtgaaggaatacaaagaggccgagagcgaaagagagttcaggctctagaaaccattcgccagagtcccccctcccctcctctcttctccctctttttttctaggcctggg

SEQ ID NO: 20829 - DNA, 1818 bp, Oryza sativa
gccccagccctcggggccgaaacgggagcggtccgacccctcggggagacagagggaggggtggccacgtcatcctcgggcccgacccccccgagggggtcaggccacgtgggtgaccgcggctacccaagcctctagtcacgatacccccggccccatgtcaccgacagtagcccctggcgttacgccagggtgatcgcccccctcgagggaagcgctcgggcgtgacgccactccttaggcccggtgacaggtggggccggtccctacaggcgggcagaaactcagcggtcgcaaatcgcgcgcatcggcaagggaaaaccgatcgacagtaatgagcggcctctttaagaccgctacattactcgagcagcgcgcgaatcgggacgagccggttcatttcgcctggagacatgatgatggcgcttttcacggttggcgagcgtagttaacgcgcgcacgatctgccccatctcaaccgccacggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgctgaggaagggattcgtttctttcctctcgccactcttcccttgccttcgccacttgtgctctaactcttcgtttcctgtgccctaccctcgccgcactcgctcgttctcaagctcctcctccgccagcgtcatggcacggggctccgcaccgctcgatggtagcgtgctgccgccttcccgcatcgtgagcgagaggcaggccgggctgccgcaccgattcatgccggaatctgccaccggccgagaggtggtcgcgctgggcgagggacgcccggcgccacactacccggggcggtccgtcttcttcctctctttcgcaatggcggggctggtcccgccattctctatttttttcatggatattctggagttttatgatctccagatggcgcacctcacgcccaacgcgataatgacgttggccatcttcgcacacctgtgcgagatgtttatcggggtgcgcccatctctccggctgttccggtggttcttcaccgtacagccggtgtcgccgccgacggtagtcagtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcagggctccagctggcgggcgacggtagatctgggagacggctacgacgccgttcttgaccgcctggcgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgtcacaccctgtagttcccctcctaagccaaaaattgaatttataaaggaccctaagaaaaaccggtgcaaagcaagagtaaacccctgaagatcaatgcaaataataatcggatttggcatgtggaatttttcttgagttctacatgtcgaaactcactaacaggatttttagtggaattttcagagccctagaaataattttaaccaattaaaaatcaccaaagtgcaattttaattccaggaaaaaatcctttttctttttctttttctttttttctctttttcctcct

SEQ ID NO: 20830 - DNA, 9899 bp, Oryza sativa
  unsure (1)..(9899): unsure at all n locations
ggctcaccaagtccggcagcggagggacttatctgccaggttccaggagtcgctcagagggacctggtgacgagcaggaggacgccttcgactccaccgaccgcaggagccgttccgagcattaggctcgttttcccattagtttatcgattgtctagtttctgcttgttagtttccgtgtttaggttgcttgtttggggtcagtcgacggtcgatatcatgtgcctatgatatggctgtcccaataaggatttttgcttgctgtttaaagtgttttaattcagatcagaacagttgcagtttaatttctatataataaagcttagttcctgagtatctgtttttctccgtttccccgtctgctctccctccagatggtctacaccaggactggcaaccgcacggcaggcgagggcagcaacggcgaagaacgcgctgatggtgtgcaccccaacagcgattccggcaatggtccgccaccccttcccgagaatccgacactggcccaagttatggcacatcagactcagatgatggcagccatgatgcagcagatgcagcagcagcaccagcagatgcaccagaggatgatgcagcacgccgaacaacagcaccagcagtttggtccccctccccctcaatccaagctgctagagtttctacgcgtcaggccacccaccttctccagcaccaccaaccccatggaggcgaatgactggctccatgccatagagaagaagctgaatctcctgcagtgcaacgatcaggagaaggtcgctttcgccacacaccagcttcagggtcctgcgtcagcttggtgggacaatcacatggccacccgcccgccaggcgctgaagtcacttgggcggagttttgccgtagtttcaggaaggcacaggtgccagacggggttgtagcgcaaaagaagagggaattccgggtgctccatcagggcaacaggacagtgacagagtaccttcatgagttcaatcgcctcgcgcgatatgcaccggaggatgtccgcactgacgccgagaaacagaaaagtttatggcaggcctggatgacgagctgacccaaccaactgatatctggggactacgctgattttgaaaggctggttgacaaggccatccgtcaggaggatcagcgcaccaaaatggacaggaagagaaaggcggcgcagttcggtccnaaccaaggtagtcagcaccgaccgcgtttcactcccggacagcagggtggacctaccaccatgatcgtccgtcagcaccgcccgttccactctagcaacttccaccagggcgctagcggcagtccgaaccaccagggaggccagcccaaccgtggtgcagctccacgcccaccaatggcaccagcacagccagccccgtccgcgcaagccaagaaggagactggcacaaaaccggggtcctgtttcaactgtggcgagcttggccactttgccgacaaatgcccgaagcccaggcgtgccggaccaaggtttatccaggctcgtgtcaaccacgcgtctgcggaggaggcacaagcagcaccggaggtcgtactggatacgttccctgttaactcaatccctgcaacagtactttttgattctggggcaacgcattcgttcatttcaaagaagtttgtcgggatgcatgggttaataagagaggaacttagcacacccatgcgggttcataccccggggaatagttccacttcggtacaattcagcccttctatcacaatagaaattcaaagatcaccatttctagccaacctcattcttctcgaatccaaagacctagatgtcattcttgggatggattggctaaccaagtttaagggagccatcgattgtgcgagtcgcacagtcaccttgaccaacgagaagggagaaacggtagtgtacaaatcaccagactcaccaaagcaaggggtctctttgaatcagatcgagacggaaatcccagtggacaccgtggagaaaagcttgaggaaattggaagatatacccatcgtctgtgagtatccagaagtgtttcctgaagacctcactaccatgccacccaagagagagattgaattccggattgatttagcaccgggaaccgcagcaatttacaagagaccgtacaggatggcggccaacgaactagcagaggtcaagaagcaggtcgatgagcaactacagaaaggatacatccgaccgagtacttcgccttggggtgctccggtcatttttgtggagaaaaaggataagacgaagaggatgtgcgtcgattaccgcgcactcaatgaggtcacgatcaagaataaatatcctttaccgcggattgatgatttgtttgatcaactgaagggagctaaggtgttctccaagatagacctgcgatcaggctatcaccagttaaggatccgggaagaggatatcccaaagacggccttcaccactcggtacgggttatatgagtgcacggttatgtctttcggactcaccaacgcacccgcattcttcatgaatctaatgaacaaagtgttcatggagtttctggacaagtttgttgtggtattcatcgacgatatacttatctactcaaagtctgaagaagaacatgagcagcatctccgtctggtactcgagaagttgaaggagcaccagttatacgccaagttcagcaagtgtgatttctggttgacggaagtcaaatttctgggtcatgttattacagctcagggtgtggccgtcgacccatccaacgtggagtcggttaccaaatggaccccaccgaagaccgtgtcgcagattcgaagttttcttggacttgcgggatattaccgccgattcatcgaaaacttctccagaatcgcccgacccatgactcagttgcttaagaaggatgagaagtttaaatggacagctgagtgcgataaaagttttgaggagctcaagaagaaattagtatctgcaccagttttgattctgcccgaccagatgaaagacttccaagtctattgcgatgcatcccgccacggacttggatgtgtcctaatgcaagagggcagggtggttgcgtatgcctcacgacagttacgtccacacgaagggaattatccaactcatgacttggaattggcagcggtggttcatgctttgaagatctggaggcactatctgatcggcaaccgctgcgaggtatacacggatcataagagtctgaaatacattttcacccaaccggatctaaatctccgacaacgaagatggttggaactaatcaaagactatgacatgagcattcactatcacctgggcaaagccaatgtagtggcagacgcattaagccggaaaagttactgcactgccctatgcatcgagggcatgtgtgaggaattgcggcaggagtttgagcacctcaacgtgggaattgttgaacacgggttcgtagccgctctggaagcacggcctacgctcgtcgatcaagttagagccgctcaagtaaatgatcctgaaatagcagagctgaaaaaaaacatgagagtcggaaaggcttcggatttccttgaggatgagcatggcacaattctgatgggagaaagatngtgtgtacctgacgaacaggaacttgaaagatctgatactcaccgaggctcatcaaacccagtactccattcacccaggcagcaccaaaatgtaccaagacctaaagaaaaaattttggtgggtcagcatgagaagggagataggcgaattcgtcgcactttgcgatgtttgccagcgagtgaaggcagagcatcaaaggccagcaggcttactccaacctcttcaaatcccggaatggaaatgggaggaaattggaatggactttataacaggactgccccggacatcatcgggtcacgattcaatctgggtagtcgtggatcgactcaccaaggtggctcactttataccagtacataccacctatacgggaaagaaattggcataattgtacctcgcaaggatcatgtgtttacatggagtacccaaaaagatagtatctgaccgaggtagccagttcacctcaaaattttggcagaaactgcaggaagaattggggacccgtttaaatttcagtaccgcctaccatccgcagacagatggtcagaccgagcgagtcaatcaaattttggaagacatgttgagagcttgcgctcttgactttagtggagcttgggacagatgtttgccatatgcggaattctcgtacaacaacagctaccaagccagtctacaaatggcaccatttgaagctttatacggccggaagtgccgcacacccctcttctgggatcagacaggcgagcgtcaactgttcggaacagaggtattagcggaagcagaagagaaagtcagaatcatcagggaaaggttgaggattgcccagtctcgacagaagagctacgcagataaccgtcgaagggagctcacttttgaggcaggagattacgtgtatcttcgcgtcactccgctccggggagtacaccgctttcagacaaaaggcaagttggcaccacgcttcgtgggaccatacaagatcctggaacgaaggggggaagttgcttatcagttagaacttccatccaacatgatcggcatccatgacgtgttccatgtgtcccaattaaagaagtgcttaagggtacctgaagaacaggctgattcggaacacattgatatccaggaggatttgacatatgtggagaagccggttcgtatacttgacaccagtgaaagaagaaccagaaacaaggtcaccagattttgccgagttcagtggagtcaccattcagaagaggaagcaacctgggaaagggaagatgagttgaaagctacccacccgcacctcttcgccagctcctccgaatctcggggtcgagattccgtttaaggggggtaggtttgtcacaccctgtagttcccctcctaagccaaaaattgaatttataaaggaccctaagaaaaaccggtgcaaagcaagagtaaacccctgaagatcaatgcaaataataatcggatttggcatgtggaatttttcttgagttctacatgtcgaaactcactaacaggatttttagtggaattttcagagccctagaaataattttaaccaattaaaaatcaccaaagtgcaattttaattccaggaaaaaaatcctttttctttttctttttcttttttttctctttttcctcctttctttcggatgggccgctggcccatctcctcctttcctccccctcctccctgctgggccggccgcaggccgaggcccagccggccgcccgcctccctccctcccggggtcgccgacaggtggggcccacctgtcggacccgtctcccacctcccgcctctcccgctcgcgccgccccgccgaaaccgccgccgccgcacccacttcctccgctttccccgcgcccacgccacgtcgccgcgcccatgccacgtcgccgccctttccccgcgtctcccggccgcgccagcgcacgagaggggcgggattcgattttgaatccccccccaccttctctctctcctcccccacgtcgccggcgaaatcggagcgcctcccggccacgtccgcctccccctccgcctataaaatgctccccatgccctcctctctcgttttccgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccgcaagacctttcccggccgctgctctacgtcgccggaataccaccgaaaccccatttccctcgcgtcgtcggtgagttctctctcccctccgactccggccggcgtggatggtcgccgtgggggttttcctccgccctaattcctctcctctatttccctaggtgtcgccgtcgctcgtccgtacctcggcatcgccggtcttcgccgcctccctcgtttttctccgccggccattgccgcccctccggtgaggtctccctccccttcctttccttctttttttttccccgtgcgccgccgccctcttcgcgcgctcgccgtcgctttcggtcgtcgccgctcgcgccgccgcccgccgcccgcgccgccgctcgccgtcgctggcggtcgcatgcccgcgccgccgccttgccatggccgcccggccggcttgatgccgggcctggccggtacatcggctcgtggagccggagccgtggggcccgcttgccagccgtgcccccccttgagccgctgccgagtgggcccgtgtaccagcgcccttcccctctctctccccgtgccgctgaccggtgggccccgcttgtcggcgccgcgccaccccgtgctggcgtcagccctggaatatattgcgcaataattaattaaggactttttctttattagtaaaaacacagtgaatcttctaaaattcataactaattcatccgagctccgtttaagcccattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtacttcgagatagtcgccgaggttcctccagcagcagagcaaggcaagtcatgcttgtcacttgatcatgttgatcctatattgcaaatatcctaatgttttctttcaaatactgcatttgttttgcaattatactatgggatggttacctattgttacagccatgtttttggataccatgctcctttgttagcttgggttataacatgattagactttggactaggaattgcttagccatgcttagttcaactagcacacaatggggagatctcttttaaaacctagactataggtttataggttaatgttggatcggtaccaccgctctggtgttggttaaataaaatgaataatcatggtgggctgtgggtgcatggttttgctagtcgcgcccatggcaattaaggaccggttcgcgggaaaccctggaagaacgtatcgtacttaccacaagccagcgtgggcaacggctgggcttgtagtgtagcttttctctagctgacgcatccaggcaagggtgggcgtgatggagcggggcgggccctgcgacggcctctatcgcttccggattcacctaggcacgagaggggactgcccgttgcccgctggggacgggggtgaaacctgaggtgtggtgtgcttggctagagggggttatgcgaagggtcctgtcacggcctctttccgatatgtcgtggtggcatgtcggcgcacggaaacgtgtcgtggggctgtgtcttgtgggtatagttgtacacctctgatcagagtaaaactattcgaatagccgtgcccgcggttatgggcggtcaaccagattcaccgtgattagtctcaccttagtttagtctaatgaatttggatagtttaggtggatggttgggcctgttgcaacgaggtgtggcgttggacagtggatgaataatactgcttaattttacaactgttttcgcattcaacccttgtttataaatgccagtatttatgcaaatgaacctgtttagctgttccttgttgaatccctgcatcatacccccattctggtatgacttgctgagtacagtgggtagtactgtcttgctctatttctccccaatcccagagtttgagtttgtgtcaaatggcgggttctccgaggagtaggcttcgtccgtgccgtcgaggatgcctgtggagtggtgttcccgctgcagtcaagtccaggcttagcctcagttatcttttgttttccgctgcatttatgtaagacttttataatgtttgtaagacgtggatctgtatgtcaacattgtcgtttgtgtaccccggccggtcctggacgggggttttaatgcacattctgcttggaatcctattcgggaatttctgggcgtgacaagttggtatcagagccgaccttgaccgtaggacaagccaaatggaaacctaagagccctctgaatccttttcatttgcataagttctttgcaattggattttattccgggaaaatttgggatctgctcttgtggttcaagggaaaaatcttgtcgcccgtttaaatgggatttgccaaaacgagtcagtctagggttttagtaaaaatttttttaagatttattcgtcagtcagttgggatttgatgggtgaaatgtattaggtcctagctcaggaacatgggttgcaaggtatttatgctttatttgtaattacaagtatgtatctaaattccccattattttacctctatgtaagtccgtcttatttattcgctctcatgcaaaatgatttatgcataaaattttgctcttattcgattctcttatttgagtcctttattgctttatttaaatttggatttgagcatgcattgatcctactcctttgtcttctttagatggccggtcacccacccaaccaccatggagagggcatgattgacttcgtggcagagttggcacgcatgacactggtggtaggctaccccaacgcgccggagtacacgacgattccaccgctcagtggcgagcttcctcaccgtgtccgcttggaggtccatggctacgtggggacttgccttgctaacatggtggttgaggcgtcaggaggcacagcagaccacgcatgtcaggaggcagcctacctgatgatggccagactccgggagcgccacaactacatcttccacgacacggcgtaccgcttccaccctcgtcgagcccacggcgacgatgtcagttcgttccgtccgacagctggcgagaacgacaccaccttcggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttgaagggtcttcccgcgccaggaggagtccggatccgcactacgccccgcaagaggacgactgcacccgtgcgcatccagctcgcgcccaggaacccacctccgcccgcagctcccgcagcacctccagttccgcccgcagttcctgcagctccagctccagctccagctcccgcgtccgctctctccttcgctccagcatcagccgccaggggtccaggcagtggtactggaggttggttgtctgctactcccagtggcagcagctccagtggctcacagtccggcagcggagggacttatctgccaggttccaggagtcgctcagagggacctggtgacgagcaggaggacgccttcgactccaccgaccgcaggagccgttccgagcattaggctcgttttcccattagtttatcgattgtctagtttctgcttgttagtttccgtgtttaggttgcttgtttggggtcagtcgacggtcgatatcatgtgcctatgatatggctgtcccaataaggatttttgcttgctgtttaaagtgttttaattcagatcagaacagttgcagtttaatttctatataataaagcttagttcctgagtatctgtttttctccgtttcccgtctgctctccctccagatggtctacaccaggactggcaaccgcacggcaggcgagggcagcaacggcgaagaacgcgctgatggtgtgcaccccaacagcgattccggcaatggtccgccaccccttcccgagaatccgacactggccaagttatggcacatcagactcag

SEQ ID NO: 20831 - DNA, 20325 bp, Oryza sativa
ccgtgcccgcggttatgggcggtcaaccagattcaccgtgattagtctcaccttagtttagtctaatgaatttggatagtttaggtggatggttgggcctgttgcaacgaggtgtggcgttggacagtggatgaataatactgcttaattttacaactgttttcgcattcaacccttgtttataaatgccagtatttatgcaaatgaacctgtttagctgttccttgttgaatctctgcatcatacccccattccggtatgacttgctgagtacagtgggtagtactcagtcttgctctatttctccccaatcccagagtttgagtttgtgtcagatggcgggttctccgaggagtaggcttcgtccgtgccgtcgaggatgcctgtggaatggtgttcccgctgcagtcaagtctaggcttagcctcagttatcttttgttttccgctgcatttatgtaagacttttataatgtttgtaagacgtggatctgtatgtcaacattgtcgtttgtgtaccccggccggtcctggacgggggttttaatgcacattctgcttggaatcctattcgggaatttctgggcgtgacagaccctaaggacttcaggatggtggtccaacgggtgctgaatctcagctccgtggaggcatccctcatcccccaaggggtcctcctcctctgctgcgatccagagcgcgccaagatcctggccatcatgcaggtggtcggggcgtcgggggagcgggccccccgaggccacgatggcgtgggcgggagcagcaggggggaacaatctacctcgggagggggtcgtgcttctgggccccgcgacgggggcccggggggcatccgtcctgccgacactcggggaaagaggaagcaggagggtacccctcccccatctcctccccgagggggcggggcggtgcgtgccagcagcaggcgtccggagggtgccgtgccgactccgcagcccgagggggagcgaaaaaagaaacggctccgcaagatgggggggatcgtgccatgccgggggaacctcatctcgcccccgaggtggtcgtttagccaacctccccgcaggttcgtccccgcgcccaccgcggccgtattcattctcccatctcccaaggcgagttttcactcacccatttctttttgtcttctggtttttcttctgcctcagcgagatcccgtcgcgccccccccccccccccgatattccaagtccggccagtctgaggccgaggagacggcgactgcagaggctcggaggcgggaagctgaccggcgagaagccgcggaccgcctccgggaagccgaggaggctgcccaggaggccgtccgggctcgccaggctgaggaggccactcgggaggaggccagactccgccgggccggggagtccatccgggaggcagaggcggcgcgcgcacgcgaggcggcctgccaaacccccgacccgaggcgacgatgacttccgaggccacccacgacgaggccgcgggcgcgccgctcggtcccgacccctcgggcgacgcttgggacgagccagcttcgggggacacccccgagtccggcacgtcgatcggcgggccgagccgcgcggcacccacaccgaggcggctttcccctctgtcttccgctgccccaccgagcgcggagcccctcctgcaggccttggccgccgcgaacgtcacggtgctggacgggttaagtgcccagatggaggccctgcaggcggagcgggcggagctcgacgcggcgtgggcgcgcgtcgaggaggggcggcgctcggtggaggccatggtggaggcgggccgcatggcacaccgccggcacgcttcacagctcgaggcccgtcgtagggacctggcggagatcgccagggaggtggaggaggagcgagagactgccctcatcgccaccgccgtgctcgacgaggcgcgggacgacctccgcctccaatacgggagccgggcggcggagctagaggagaagctcgacgccgtccggggagttcttgacgccgccgttgcccgggaacggcgggcggcggagaacgaggcggcgttccggcagcgcgaagaggcccttgaggctcgcgccacggcgctggaggagcacgcccgcgcgctggacacgaaggagcgcgacctggcggaccgcgaagccgccgtcgccactcgggaggcaacactggcggcgcacgaggccgcctgcgccgaagaggagtccacactccgcctccgcgaggacgcgctcaccgagcgggggcgagctctcgaggaggccgaggccgcggcgcagcggctggcggacagcctgtccctccgcgaggcagcgcgggaggagcaggcgcgccgcaatctggaaggcgcccgtgccgagagggccgcactggatcagcgggccgctgagctcgaggcgcgggcgaaggagctggacgcgagagcgcacagcggcggggcggccgcgggccacggcgacctagccgcccgcctcgcagccgccgaacacaccatcgctgagctgcagggcgcgctggactcgtccgccggggaggtcgaggcccttcgcttggcgagcgaggtagggcccggcatgcttcgggacgccgtctcccgtctagaccgcgccgggcggcaggagggcctctggggcgggcggcacgcgaagtacgccgccaaccaggggggcctcgcccagcgcctctcagaaatgaccggggccctcgagcggctccccgaggagctcgaggagacgatcaagtcatcctcgagggacctcgctcggggggcggtggagctcgtactggcaagctaccaggccagggaccctgacttctctccgtgggcagcgctggaagagttccctcccgaaaccgaggacggcgcgcgtgcgcaggtccgggacgccgccgaccacatcgtccacagcttcgagggtacggcccctcggctcgcgttcgcgctcgactccgacgaggagggcggtgacgatggtgcggacgacagcgacgacgaggccggcgacccgggcgcgtcggagtgagccctcaggcccccgccaatcttaataacttttccttcttcttccgaggccttcgggcccccttcttgtatagactgacttaatctgcaatcaagtaaagaggaaatttctgcgtcagttctgtttgttgtgtgtatgagacgaggatggtctgtgccgcggtccttctatgtcttggcttgaacaagggctcgtgcccaggtcccagcctcaaacggcgcgggtcggggctagtgcctggggagatcctcgtgtcgagactggccaggccgggagcgtggtgaccgagggttatggatgacccgattgtgggcatttgccgattcccccccggagttcaccacgccccggggcacggctcggttctgggccccatttggcgattttagccggcccgggccaccgagggcagggtcgagcacgagcgtgctaatttaagccaagattcttcaaaaggaaacgatggcacagacacagtcctcaggaaatcgaaaatgcttttattgaaatacggaagagaaaaaaggtaagtatatgcatgtggtagcccccggccaaccctgcacgcccgggggggtgcggggttggcccgagcccgagacatgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcattgatggtagcgccgcaggctctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtggggaggggaggcgaagcagagcttgatgcccatgtcttcgcagtagtcaccgaagagctcactagtgaactgggtgccgttatccgtaatgatacagttaggcaccccaaaccgagcagtgatgcccctgatgaatttaagcgcggagtgcttatcgatcttgacgaccggataagtctcgggccacttagtgaacttgtcgacagcgacatacagatattcgaacccgcccggggcccgcctgaacggacccaggatatcgagcccccagacagcaaacggccacgaaagaggtatggtctgcagggcctgggccggctgatgggtttgcctggcgtggaactggcacgacctgcaccgtcagaccaggtcgaccgcatcgttgagagccgtcggctaatagaaaccctggcgaaaggccttgccaaccaaggtgcgtgaggcggagtgggctccgcactcgccttcatggacatcggcgagaagctcgacgccttgttcccgaggaatgcacttcaggaggactccgttaaccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagtgctcccctcgggtcccgaggcctggactccgacgggcctcgggggccattcaggcgcgtccgtctcccctagggggtcgggtcgggccgacggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcaccggcgccctgaagagacagggagccgtcgaactgcatcacccagtaggcggtgtgaggcagctgcggggggcccgagctggcctcgggggcggagacgggctcgggagctggggtccactccgccacaaagtcggcgagggcctggctcttgatcgcgtggcgtgattcaaagcgcaaatcgaattcagagagttcgattgcccatctcaccacccgtccagtaccctctcggttatgcaagatttggtcgagggggtaagacgtaaccaccgtgacccgatgcgcctggaaataatggcgcaacttccttgaagccatcagaatagcgtaaagcatcttctgggcctgagggtatcgggtcttggcgtcccggagggcctcgctaacgaagtagacgggccgctgcacctttcggcggggccgatcctcttcgccaggggccacatctccaggacgctcttcgtccgagaggccacgcggggcgcactcggcttctgtgccaacgacctcggggtcggagggcgacaggcgcggccttcccgcagtggccccggggccatcctgggggtcgggggcgcctggcaccgtcggacaagcaggcggagggccagctccggccgtcgggggccttaggccgccattcggctcgggggcctctgctccctgctctctcccgggtcgagtcgaagcagggtggggatgcgcggagtgagggttgtcctcgtcgcgctccacggccaatgccgcgctgaccacctgcggggttgccgccaggtagagtagcaacggctcatctggctccggggcgaccaggactaggggagaactgaggtacgccttcaactgagtgaaggcccgctcagcctcctccgtccaggtaaacggcctggagcgtttgaggagcttaaataggggtagtgccttctctcccagcctcgatatgaaccgacttagggcggccatgcagccggtgacgcactgcacatccctaagcttgctggggggcgcatccactctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcacccagcggtggagtcgacaatctgatctatgcgtggcaaggggtaagggtccttaggacatgccttgttaaggtcggtgtagtcgatgcacatccgaagcttgccgttcgccttgggaacgacgaccgggtcgccagccactccagatggatgacctcacggatgaatccggcctccagaagtcgcgccacctcctcgcggatgaaggcttgacgttccggggcctgccggcgcactatctgccggaccggccttgcgccgggccgcacggcgagacggtgctcaatcacctccctggggaccccgggcatgtccgccggtctccaggcgaagacgtcggcgtttgcccacaggaaggagacgagcgcgtcttcctatttgtcatccagaagaccaccgattcgtgtggtcttggacgggccgtcgcccagggcaacctccttgaccgagacctcgtcgcacgtgaccatccgctgccttggggcggccgggacggaagtggcgagcctctcgtcgccacccgcgggcttggacgccgcggcgaggtggtccgcgcgctgctccatacaggcaagcgcgacttttaggtcgccatggacggtgatggggccaccggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggttgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatttgtcctccctgggcaacgcacggcgggtggtcggtctggtcgaaggtgagggcaacctccgaccaccgcgcccgccgcgtcgcctcatgggtaggggccacggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgccggttgccggcgggagccgccggggtcttgccctcacggcgctcctgcctcttctcctcctcccacttcctcgtccgctcagccaaacttttgaccgcgcggcagtccacgaggtcgtggagggaggtgttgtgcacggtacaccacttgccggttgggcgctcccacctgggagcaccggcctccttctttttgtcgctcgcaggcctcccctttcggggggcccgcgaagcgccctcgacggcgaggacatgaccctcgtcgtcggaacgggccgaccccttcttcctcctcccgtcccgccgccctgaccgagcggcggatccgggggcggccggagctgccacaccagaaccggaggagttccaggtccaggcctcctccttgcgagccacacggtccgcgagctcaaaaagttgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactgctggcacaaatcctcccaagagtggaccgacgcgggtggcaagttcattagccaaccccgcgcctgacccttcagggccatggggaagtaattcgccatgaccctgtcgtcacccccggcagcctcgatcccggtcgtgtagatctggagaaactcggcggggttgacgcttccgtcgtatttttcggtgatggtgggccggaatcttgggggccaacggacgttccgaaggctcgccacaaaggctcgacagccagcaccgccaaccggggacacggggggccggcccccgtgcccgaaccgaagtggcgctccggacgaggaagcgccctccgttgcgtgggcggcgcgacgagcgtcgcgccggcgctcgatattgaggcgggcatccggccccccacgcacatcttcttgggtcggaggcgttgacgagggaatggcggacgaacggcgggtaacggccgccgctcgccgcgccctccgcctcgacgacatggagccggctgcggcagcgccagaggcctcggtggcggaggaccgcccgccggcgcctaggcgccgctgcgccgtcatgaccaagtcggccacgtcatccagctaacgtcgggctggagtctctggatcggggacgacgggcgggtgacgcaagagcgcgcccgcagcctggagcgcgccctggggcgtgccgccatcgccgtagacgaggcggcgacgcgccctgtctcgccgtcctcccccgtcgcccgcgggcggcgaagtcgcggatcgtccgacctccccgagcgcctccccccgcccaggatttcggcgagagggggacggtggggtgcgagcccgacggcgcgggttctgctccccatcgtcaccgctagcgttcggagagaggctgtgcgccactgcccgttcggccattgggctgagcgggcgaagcttggcgcacacgaaagaggacgagggcttagaaagacccgcgcgccccctactggcgcgccagatgatggagcgtggggctcctcaccgggagaccgcgcaggcccccctttgccggttcggccgggggcgctaagtgagtttctttgccctcgatctgaggaacgtcagcgagagaggaaatgcgcaagacacgggcgacgtagacaggttcgggccgctaagaagcgtaacaccctactcctgtgttctagtggatctgtgcatgaaggaatacagagaggccgagagcgaaagagagttcaggctctagaaaccattcgccagagtcccccctcccctcctctcttctccctctttttttctaggcctgggcctcctttttatctggtcaggggtcaccacatgggcctctagctgcctaagaagggaaacatgctttttacaatgagggctagtctacagccggaagtgacctctgacaagcagagcgcacgtctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagtgacgagagccaggaagctctcatcattccgacgggacggggcgaggcgtgtgacaggccgcctgttgccacctaacccgcgatctgaccggtctgtgaccggtcacacaccgtgaccagtcgcggaccggataagcgtgcgctgcgccgcattaaatgcggcgtggcgcgctcgtccaatcctgctataaatgcggttaggtgagccccgctgtgctcacctaacccacacgcgtggcgccaaaaccacagggggtcggggcgccccagcactcggggccgaaacgggggcgccccagccctcggggccgaaacgggagcggtccgacccctcggggagatagagggaggggtggccacgtcatcctcgggcccgacccccccgagggggtcaggccacgtgggtgaccgcggcttcccaagcctctagtcacaatacccccggccccatgtcaccgacaacaccgatcacaaaagtcttaagtatatgttcacacagaccgagttatatatgaggcagagaagatggttggaactaatcaaggattacgatcttggaattcattaccatcccggtaaagctaatgcggtcgcggatgcgctaagtcgcaagacctattgcaatgaagctcaaatatggccagaccacggtcgcctgtgcagagaattggagaagttaaggctaaccgtggtacagtcaggtgtccctgccagcttgacagtgcagcctaccctagaatcgcaaatccgggaagctcagaaagatgatgaagggataaaagaattaataaaaagaatacaggagaaggaggacaccgatttctccatagacgatcaaggcacagtttggtgcggtccacgcatctgtgtaccggccaagaaggagttaagagatctcattctaaaggaagctcatgagtccgcctactccattcatccaggaagtacgaagatgtaccaggatatcaaggcatacttctagtggactggaatgaagcgagaggtcgcagaatacgtagccctgtgtgacatttgccaaagagtcaaggcagagcatcagaggccagctggtctgctgcaacccctaccgattcccgagtggaaatgggaagagatcggaatggatttcatcaccggtttgccaagaacccctagcgggtacgactccatctgggtaatcgtggatcgactcacgaaatcagctcatttcgtgccagtgaaaaccacctttgatggaaagaaactagcagaactctacatgacccatgtcgtatgtagatttggctgtcccaagaagattgtgtcagaccgaggcactcagttcacctcaaggttctggaagcagttgcatgaagctcttggaacagatctaaatttcagtacagcttaccatccgcagaccgatggtcagacagaaagagtaaaccaaatcctagaagacatgctacgtgcgtgtgccctggattttgaaggcacttgggatcgttgtttgccgtatgctgagttctcatacaacaacagttatcaggccagcattcagatgtcgcgaaatgaggcaatgttcggaagaaagtgccgcactcccttgtgctggaatgaggttggcgaagcactggtattcggtcctgacatactcaagacagcagaagaacaagttaagctgatccgagaacgtttaaagacagctcagaaccgtcagaagaattacgctgacaatcggaggtgtgaccttgaattcgaaaaaggagaccacgtgtacctgcaggtatcacctctccgtggtatgaggaggtttgggatgtccggcaagttagcaccccgctacatcggcccctaccccataaccgccggatgtggcgaagtggcttatcagcttgagttacctgaaggtctcgcagatgtgcacaacgtgttccacgtatcccagttaaagaaatgtcttcgagttccagaagaacaagttccccttggtaatatcgagctggaaaagaatctgacctacaaggaaagaccgatcaaggttcttgaagaggctgaacgtcagactcgaaggaagactatcaagttctacaaggtccaatggaccaatcattctgaagatgaggcaacctgggaacgagaagatcttctccgcgccgagtttccggagctgctcccttaggtgctgaatctcggggtcgagattcttgttaggggggttggtctgtagcgcccgttccgtcgtggcgcctagcgggaaaatgtaattcctaaaaaccctaatttcgaaatatgtttccttgcttattgtctagtgtccgtgccaattccggatctcaaatccccgatcgatcgtcaagttcaatcctgaatccaaatccttcccaaatcaaatccctccgcaaaagtctatttcacctccctcaggttcgatgggccgaattcctctcggcccatctccctctccctccccatccctctctctctctctctctccctctccccccgctctgcccgtgcgctgcgcccgcgtgcgcgtgagccgcgccgagtcgagcgcccttcgccctcgctgccgtttcctgtcgacgccgcccaaatcgccgcgccgcccgttgcttcccgcgcgcgcgcgcgccatggtggccgaccggccagtcgccgccgccgtcagcgcctgcccgcgcctgccgcccgtgccgttgctccgctccaaaccgcccggccgtcatcgccgtcgtcatcgacttggccccgcctctcctcgcgcgtgcttccaagggacggaggcagagcttccccccctctgccgcatcgccgtctctccctcctccttttcccccaaagtggcaagggggcaaccccctttctctcccccccccccttttcccttttcccttttccctcccgccggcgtcatcctcccccccccggttgccgtttgggccgcgactgccgagcactggctcgctcccttgaccgcccaaggtcggtttccaaaccgacattgccgtcctataaacccaggcgccctcccttccttttttcccctcccaatcttccccgtttttcacccacgccattgccgtccctctcgccgaccgccgccgtcgcgtgtgccggaggagccggtgcgcgctaggacgcggaaggggactccgggcgctcgtcttcttcctcttccccggcctgaggccggagagatcactcccgtgccgtcggcctctcgtcactgcgccccatcacccccgcacggtagtgcctccctccgttctccctcctcgttccatctcctccccttagactcgggtagtagcacgagtagcctccccgtagctagctagcgccgccccgaccgttgctgccgctcgccgtgtgctcgccgccgtcgccgcccgtgctccgtagcacccgttcgtcgccggcctcgctcggcgtagctccgccatatccgacgctagcaacagactcccggagtcgcgtagatgctctagctcgcccgaatcggtctcccgtcgcgccgtcgccgtttcccccttctctcgccgccggttgccgctaccacaatccgccgccgtcgagcatcccccggcaaatccgagccgttggctcgtctcccctcatcccgtgcaaccttccggtgtgctcgctttcgcctgtatcgccgtggttcgccccgccgttcgcagccaccgtccgccgtccgttccggccggcgtcttcttcaacctcccgccggtccgcgtggcaaccacataggcaagccacctttgaacatcttgagcctatatttgaacttaagtatgttgcttgaaaaatattatgcattgataggattgcacttaatctacatgtcccgtctgcaaggcagattggcggacctacctaacttgttgcagttgacccctccattgtaattattataccatgttcccttgtaaccacctagttacgcctcggtaatcgtgcactctgcacgaatatcgacggtcgccttcaaacttaaaatctgataaacatcttgggtaaaacttaggttttacaaaacacttggaaaacccgacacctgggtcggtgcttgcgaacctaaatgaatttccaaattcgcagaccggggaacgtaccgggtgtacggttccccgctcttgcacttaaggaccgtttccttagaatttcatccgaacataagacaagtacgaccacatgggtggaatgggacacccctggctgagtaactagctaatcgggggagccatgatgccaagagacatgtggattcaacggggtggtgtcggggaggacccccgggtttcctggcacagtatggtctgggacccctctcgttggcatatggtgaacctgtgtcggctttcgaaatgccttgtcgtgaaagccttaaggtctctagtcgtggccgttctgcatgggctggatgatccgggttagtaatgtcgtgtgggtaaagtgtacccccctctgcagaggttattaaactattcgaacagccgtgcccacggtcatgggcggatgtgaggtgattcctagcgtagttttgtttgactactgctttgtgaaatttgctgatgtggtttgggttcgatgtttggaaaacctgcggctgatgggatcagccaggcccgggtggccgtttaaaagccgttggccgggtgccaaccttgaccaattcaaaagactgataccttgcacatactccgaccgggcgagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtacttctgtactcatccttgccctatataaataatccccccccagttgctgaagaagatgaagcggatcccgctgacgaggagttcttccaggagcaagccggctacgatgagttttagggtttcagcctagttcccaagtcgcgcctgtgatgtctggtccaagtcttggcttccgtttcccttttgtaatgtagttgtgagctcgggatctgtccgcagcccaacatgaccgtactcctactctataataaagagacctctgttgctgtgatattctgtcttcctgtgataccagcactgtttcctgggactggtatcaattaacaggttaatttggagcgtcacgggctagtcccgctcggggctagttcggggcgtgacactagcattatagtacttgctcttacctataaacatgtattacataattaatgtctggtcacacctgccatacacacatgcatcttgaagtccgtgctgcagctggctataaatctgtaacccgctgctcttctctctctttaaaatatgtttatagctggcttatagtgctattgtacctgctctgatcagccacacgttgatttacaatacaagacgacgtgcatgtcattcagcagctcagcgcactcggggcataagcctgaatactgaggtggtgttcttttcttctgaagatgaagatgaagttttttacgtaaaacgatgtggtataaacgtatgattaattgagttttaattattataaacttaaaaatatagattaatatgatattttagagccactttcatataaaaagtttatatacgaaacaccgtttagtagtttgaaagcgtcaaacaggaatcttaacggagcctcagctgctgcatatggagggacgcggtcggggaggagctgcaacagcgaggccatcgatgagcgcgtgctccatcgtgcacggaacgccacatttgcgtgcgcttatttatcccgtcgtcgcacgcatcgcgggtcgcactcgcaccatgcggcagagcgcgcttttgcttttgtatcgccttcgcccgtgaggcacacacaagtcatccctcgtgagtgtcacatcctaaaaattcaaaagatataaattgttgtttaaatggaattattagaatttattttaaaaagctttgaagagaagatctaattttaattaataaattccaatataaaatggggccagataaaattttattaaatactttgcttaattctataattcctagatttttctgggatttatttgagctaaggaagtatttttaataaatggaattgcatttcatgaataatttaaattgaaaaaggttttaaaaagtcttcttttggctttgggccgaaagtcggcccaaaacccttccctctctcctcggcccaagccggcccagtccgcagccgcccgcgcgcgcgcgtccgctcgctgacaggtggggcccgcctgtcaggtcgtcgtcttcctcgcgacggccgccgcccgaaaccctagcaccgcgccgccgccgtttccttccaaatccggtcgatcctttccttctccggccgaattgatagaggggaaatgatcctcgggatctcctctaccttttcccctttggaaatatcggctaaatcggcttggaaagtgtttgattcgaagtcgaatcggatcggcttttctctctccgagcccgacctttccatctcgtcgccggtcgccgtgggccttcgccgccgcctcctagcccctttaaaaggacccccggagtcgccgctacccgtcgccaccctcgccttcgcctctcgtcgccggtagagctctagcgccgtgtgacctagcgccgccgtcgccgccgtcgctccagctgtgcgccgccgccgttccggtcatcgccgtcgctcgggaagaccgccgtcgtggtcgccaagtcgccgctgtcctcgtccgccccttcgccgtcgccgaagatcgccggagcaccatcgccgccgtcaacccgaagaccgccgccgtttcttcgtcgtcgccgtcgccgtcgccgtccgttggtcttccgccgctcctttggtcaccggtgagttcgccgcgtcgcgctctacgtcttggtgccctccgttcgtgccgaagcgccgctgttcgccggcgagcatgcacgcccgagccgccgagccgccgccgccggtggtgacgtcatcgccgacgtcatcgtcgccctctcccgtgagccggtcgtggaccgttcgatctcggccgtccgttttggatcaagtcgatctcggccatccgttcgcgtgaaccgtcgccgtgcgcccggtccaccgcgaaaccctagccgctgacgcaataaatccctttttccttttcaaaaataattcattattgcgtcataattcaattgaaatccatataagtgttttaatccgatttaatcttcaaaaattcataactaattcatcttagctcggatttagttggttcaagtctctaaatttttccaaaattgagatctacatgttaaaaatatccacatgtactgttcatgcttgtttttgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcccgtttaaagctatcatttctattcaactattgcatttattttcgaatgtcattgggtggaattaacctattgtttgctaaagcccttttgttcttgattactttattccttgataccttgggttattataacttgactagttgagctttatatattggttcagctagatattagatataattgcttagccctgcttagaaacattagcacactattgggataacttaagatttactattatttaatgatggcttaatgataggtcacgatggtcaatcgtgattggttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgtcttgtttataagggggtgattatgatccaggaaaggtgcgctgtaatggattgtgttgtgcaaggggtattgtcacaactcctttccgaggtaccgtggtggtattgaggcacatggtgacatgatgtggggttgtgtcttgtgggtacagtggtacacctctgttcagagtaaaactattcgaatagccgtgcccgcggttatgggcgggtctaacaatgtctttcgtgattagtctcacacatctcatcataataaaagatgctataattggtaataatttgattagctcctggtttggaatggtatattcctggtttggagataggactgtgcagccgggatggttgttcagaatggttgggcctatataacagggtatgttgtatagcgttggattaatattgtttaattattacttaactattttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttttacagtgatgccgatggtgtggaggattaggtgtagccccggtcaagctgcctgtggaatggagtcgtatgcgccgtttatctttctttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagctccttgaccctaggttatgccaaatggttacccatagaagccctctaaaaatattggaaaagtagaactgttctcctccccttctcttttaattaaaccaaactaatggcacatgcatttcctaatattttttttagtggttctcgttcaaaatttattctagcgttattagtactgtacatctattactgtactaatggctcattttaccagcaaaagttttacaatattgtttagtttaatcttgctgcaatgaaataaatttatcatgttgattttataactttcttttatttcttttgaaaccggttgttcaaaagtacaaaatttgtgaccttgtttccaactgtttcaacttatcctgcaagtttggcttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccataggatttgggactgcccctttttatgcccaaattcctcatgatcgtcacgaagaaaagtgccgagtcaaagtcaccttgaacagtaatagtgaagatatcccctcagtgatgttcgaagccggaggaagaaactacatccatacatgtcaggaggtggcaaggatcgccataggagagctccgcgatcgctacagtgatcagttggccgacactgagtatcgctaccatcctcgccaaccccagggaagtgaccgtggcagctaccttgagactgagggaattgagaatgatgctaccacaaggcatttggttgagatgctgtgggctatggatgaaacccgtgcggagactgtgttagcggctcaagatcgtgaagatcggaatcgtggtaagatttgcaagttagaggacaaggtggatcgtttggagaaggaactagccgtattgaagggagaagcaccaccgcagaaggccagggttcatctcaccgcgaggaagagagctctatttgtccctcgctaccaa

SEQ ID NO: 20832 - DNA, 2594 bp, Oryza sativa
ttgtttaattattacttaactgttttattaaattctggaatggttattaaaggctgtttatgcaaatggaaccctattatgccatcctttgttatcctgtgcacttgcatatttgctgcgtgacttgctgagtatgtcatatactcaccttgcaatcattcatcagaggaagagttttacagtgatgccgatggtgtggaggattaggtgtagccccggtcaagctgcctgtggaatggagtcgtttgcgccgtttatctttctttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagtgagcccccggtggactttcgcaacaacggtgccaagtggcaccccgcatcacaagctcaaatcccacatgaaaatgaccaatcggcgatagatatatgagtatatccatgccaagattaagctaagttcatcaatgtgacaatatatatacagcgggagaagctatgcttctcaaatcaacctgaaagtgttcattccataacctaagaaattgagggaagagaactagagattcgatacaagggtgcaaaactgtaatggcagcctgagaaaagtcgctgggagacttgagagttgagactctgattcctttgcagtccatagcaatgctggtgctatggcacctggctctgtctcattcatccgtgaacatattgccatggcggacagacaaaatgcaggggcagaggcacctgagaagccagtcatcatacagaggaaaccaagcattctttgtctcctagcagattcccctgtcaatgtgaaagacaactagacaagccgcctgatgaaaagcagctgatcatgtgccattgggagtggcatctgagagtgtgtggttgatgtcctcgccatgttttccgttcatctgcacacgttgccgctggataatcggaaataggtacgttaggggaaatatcaaaatggttgctgcatataagttgctaggtactatgtagaagataaaaggcttgtggttatgttgcaattgaactacaatgaaatgtagatatgtttcattgttggatgaaaattttatgacaaaataacttctaagtttgggaagttcatttggagattaaaatagaacatagagtagctgattaatgctctatgatacccgatcagtagaatcgacagtgtttccatttaacaatttatggaactcttccttcatcttgcaatccttctctagtttatggagctcttcctttgttctgccatctttatctttcgctgtaactgggagcaaagatgatccatttgtgcgatctggcatttctgtagaattgccactaacgattgttacagaatgaaccacatggataatactgcataattaaaggaagctaaaagagggtacctggtagcttattgtcaataaagaatacaaccaaattgacagtatacctgacgaaaaagaatgcaccaaagtcagatgccactacaaggcaatcatattacagaaatgaaactttatcctaccaagcaacaacaacatccacgctgtagtgttttcgagaagcaattataagaagactctgaattatagccatcagccaagcaagaatcttaatcaacctaacaaaacaggaacaaccaatgagattagaagatcagatgtcagagtactgagttagcatgcaacttgaaccaaatttatgacatattacaggcaaaaaatgaccagggaaagagacaaataagcgtgtgtgcgcatatgcattctatattttaataccttttggatccatatttatgatatgtacgcacgaaaacaagtgtaaagatcatgtgagatgaaaaaatcagatcgccacaaccaaaaagcactccacgaggaactgcaaaggaaaaaaaaaggaaattcagatgattttccacccatctggacaaaagattcaacccaacaaatgatgaaaggcttacagttgatcaggagcacttcaagtacattatggggcggtggaagagtggccatttttgagccctgcaaaatgcaaagataaatgacttcagtaagcctttaacaaagtatgacagtatgtagttcacgagtatgctttagctatgatgagaaattaaggttacctcccgacagtgataatttggacctgggagctgagtggaatagaaagtaataatccgcaaaaattgtgaagcctagaggaaagaaaagaaaaacatcattgttacatcatgattataatggttgcagagataagttaaaagacatgggacagccacttacaactaaaaaggccagcaccctgcgccagagtagaacagtgtagaaacgtttgctatgataaataaaagggtgaaaactccactgcaaaaccataaagattgtcagtaattacactactttatgatcaagcattacatgcaagtagcttaaacaaaccaaattctg

SEQ ID NO: 20833 - DNA, 2954 bp, Oryza sativa
gtgcaacaaatagcttcgaaaaacattttttgttcttacagatcatgcagacaagaccttactaaaaggaccaaactaccatactgtagtacatattggaggtggcaataatttatcggagagcaattgattaacccatggtcataaggtacaaaatcacactaagctaaattatcaaattactttttcactttcataaatcaatctggatagccactattttcaaatttatttctcactgcagctctttcaaattgtgttgtttacttgtcaatatcagcagggctgtcattgccatttacactacaagatttctggctaacttattcaagatataagaagaaagggtcattacaaaacatacatcattaattatcaaatatgtatgaactatgcaatagatgatcatatgcagtgaagcaaaatagccacctaccaacaggaaggaaatgaagatgaatgtgaacacgctctcactaacatatcctttgtcctgtccaagttcctaaaaacaaagagaagtgccaccagtggcaggaacaaatcagtaccattgttctttgacagatatgagattaatttttaccaggtcacataccggaagagccatgaatcccaagtcctggagcagtggcccaggtcgatgcaagtaatgtactcctcgagcagccagtccatgaatgtactaattataggtaaaaggattgcatgaatttccaatatcatccattaatgaacagataatattatgtaagaagtaaatcttgagaagatgatgaagaacaataaaagttggacattttattttatttttccacgctctcaaaaagagaacctgtagaaaatacaaggagaagaaagattttatttaggcgccaaccggcatttcgcattgcaacctatcaagccatatgggaaatcaaatctcacgctttcccaacagttagtttcattctttctccatcgtgtacagaaaaggactgtagatcttactgcgctctaaaatgtttactcatctaaggaagtaaatcaattataataacacaaacatggagaaaaaaagttatatgaaatcaccacagttgagtcagatttctagggaatggagcatgtctgacagggagcagtatcacaaatggaaccaactatgtcaaaggattgggtgcgcgattttattaaatatcaagaggataggttgcacctaagttcaaatgaattcatctcctatatctcaactcaaaatagaaaataatgcaagtcctattatcccaaaatgttaattgcagtattatttctgaggtcaacttatgatatttaattattatcttctcataatagagcatatcctgttacagtacaagcgaatatatctgatgacaggcccatgaatatccaattcatttccagaatggcattaataatcatctttagttcaataaaccaacctacaagttgtttgcatgagcatgattacagtttcgaggagactacatgcaggacaagaaacatcacagtaactgcataataagcgcgctgattttatgaaaagaatttcagaaataaataaatacttgcaaaatctagacaaacataagaggcaatttatctaacatattttacaagagggaccaatagcaagctaattgtctcaaactctctaagcagggaacttttgaagaagacacaaggcaacaatttctccccatgatatgacatctatcatggtatattgcttttgaccttggctccagctcaaccaagattgccagtgcttgaactgctttctgtgaatttgcagtagttgctcatccaagtatccaacatttctcaacaagctctggatttttttttctactctgaggacatatcacataaacagattgaatcatacttccatccccaatactcccctcttgattaacaacaaactaaattcacctaaactgtgcagacatatagttttcatgcaaatgttcaatcagccacacccttgctcgaggtgaggtataatttaccacacttagttcatacaactaaaccctctgggcagtgttgacacagaattcgtaccggtccccaaatccaactctaaaattagcatagattgtacgatgcagagctagctaaaattgccgttcaaaaggggtcgaccacgtgctatatcaaaatttttgaaacacacagaaaatagcagtcaagaattacaaagcacgccacaaatatggcaattatgcacacggagccacggaggataaaaaaaatcaaaggaaataaactgaagtttacctgaaacaccaatccggcaaggagcaagcgccacttctcgaaaagaagctgcagctccaccgctatctccgcacacaccttcctccatagctgcacaaaggcgggtaaaaaaaaatcacaaaccatagctagaacatcccaaccccatgtgccaacgaatccacaccttggtagcctcccgagcgatgtaaaccgccatggccgcaactcccgctcctcgcccgccgcctacaggtacaccctggagggctcacacccatgctccgatccgcgcatcactgctgggatcacggcatctcgtcgcagccaggacctcgccacctcctcgggaccgccgcgagatcgccgcccgccgagcggaggaggatccccccaagcagctagctccggggcctccaagagggggggggagcggcgagcggcgcgaatgcaattttccggcgacgaggcgagtgagggtgggggtggtcaggctcaggccgccgcggaggagagtcacgcggcgacggcgtcgacggtttgaatccgggagggggagggtgggttcgaggaacaaaagggtcagcggagtgggcgttttggtaaaatgcggtgggtttaagtaactgaccgcattaagcggagtagttgcgcttctctttcctttctttttccccctgggctgcagg

SEQ ID NO: 20834 - DNA, 14959 bp, Oryza sativa
tcctgcagcccccctgtttttagaggattgcgctattttttttggttaccagtgcttccaatgttccaagaatccaagttccagctcatctagggttccattcatggaattaaatgtagtagtatcatattatagaaaattgatactagatcgatatatgtctcacgaaatactagtgaacgggaaattcaagaaaatgtgaggaacattcgtcttaatttttgtacttcctctgtttacaaatctttgatgtttttcgcaatatttgatactccctacgttccataataaggcacaaccacttttagtagatgttatataatataaggcatgcatgcaagcatgcaattaactatggcatcttctccattaaattattacttttttaaatcttccactctcatattatctgatcatattggatgtatgcattatatttattaggatgattcaaactacaagatgataataattattttttggtctttatgttaagagtggttgtgccttatattttggaatagagggagtatagtttttgatgaatttgttcatcaaattcgtgttaaaataactttgtaaaatctaataggtttataacattacgataataccctccaaaataaatcgagaaattattaatagtcatagtttgaaaaggtaatttgaaacaaaacagtgcattagtttttacaaccaattaccatagaaataccaaaacattattatttctgataggtaggaacagacacatccattacgtagggtgagatgactagaccaaccacgacctgtgacaccaacacctccagaaacatgccctagtatagcgtatagccaccgacccgacatcagcccattagatcaattaggtactaccttccgtcctaaaatatagttatttctagcacaatactttgtcttaaaataaagctatttttctacctatcttctcctctcaaccaatcacaaccattctttttcacttaatttctcttttcaaccaatcacccacatttttcaatcattctcacctactttcttaatacccgtgccaatcttaaaaatgcttacattttgggacggagtaatatttcatacacgaggtatcgatcatcatatgatctttgtgtatatgattgcttgtcttcatttctaactcgctcaatcttttttaatgcatcatcaagtggggtgattacgattcatgtgctacatgccgtgcacgagcacagctacgcatttgctttctgcggtttgccaatatcattgtagaagttctttggtgtttaaatgtattgattataatctgtttttatgcgattataatataaatataatatattttacagcaaaaataatataccctacaagatgtctttgccaatgatctccgtcgtcccatgtgcgccatacagttgtatgattgtatctgccactcggcaacaatggagccgcaaagagcttttggaagaagtttgcaatgtcctaatgacgtatttatcaatgttcaattagacttggctacggcagccaaccagagcctaacccggtttactcaaacttggcctgcacaaattatttagtttggcatattttactgttagtatcaattaacattatagggacatttaagtatttaactgatatatacgtctacattctggtggtgctggggaattcttttttttcatataaatcttcagtatttgtgattgaagatagcacgtgtacttgtttattccatgtattgaccgttgtccgctgtgatatcaacaaatgtacgtaccccgatactgtacaaaacaattaatgtgtactctcctatgtagcacaccacaaattctttattgaaaacgaagcatagaacattatatagaggccggccggtgccatccttctctcgaaggatcaaactttgctaatccatcgttccatcttctgtgctaggttggcaccaagctagcgtacgctgtctatccgcggaataaccatccggtcatgcaaattccaccttccttgtaataccattccaagtcaaagctcggagaatacgaaagggaaccaagccaagtcttattttgtcattccgatacctattttccccatgtgaaattcgaatgttctcaacatgactcgaaactttgatactactacctgttaactgctttctcatgcagatcccagcgatccggatcggggttcataaaaaaaccgacacagctggagatggaaacatggagaaccaaacaaccccaagtgacgcgaacgtggtggtgatcacacgctgctacgggacaagccgatgacaagtgcacgtctgcgcccagcaactttgacatgtgccgttggccaagccaaatttaatactccgtatcatacacatctgtaccgaatcatctgcgtagcagtatcatggcgtatcatgcacacacgtggcggataagctggcttggacggctaaagttgtacgcgtccagagcgaggaggtgatgaaaattagaggagaaaggttgcagtcgcggcgaagcaagatggacaagcagacgccacaggggcacggcgagaagccgcggtatttgcccagatgggcgcctgttttgttcgaacccgacaggtgctttcagccggaaaggcgaggcatcatcatccgcgtcgaagacgcgtagcgatcggtagagccatcaacacacgcacgctgcggtctcgatcatgattcgcactttcacagcggttcgtttctggcgttttttttttctttttttgcgagcacgatcacgatctcagctagctagttttacatccaaaactagtactgtcgtgtacaaggaataaaatggaacggttttggggcaaaaatccttcttttccccaaggagagggagagttttgcacataataagccttcctctccgaacgaacatcaacatgagagggattgaaactgacacaagatatccagtttgcatcaggtttgatgaggatggagggcatttgtgttccttaaatgtaaggttgtcaggaaatgctggcgaattttgaatatggagcaaattcggttggatctccttgaaaatggggagttttgaaccaacagttcaagagaacaaactgaaaagataaaggtacaagaacatatgaaagtgaaactatccaccgcagttgtttcgcctacatcgttagtccttatcagacgctgtatatcgaagagaaccttgtagtgctctgtacacatatcaacagacaatagcaactatcaacaggcgacaatcacccagtcgtcattattacttcgaggatcaggatcagtaaatcaacttgttgataaatagtccccaaaatagacgctcgtggatagcgagatgacgagagatttgacaccgtgacgaacagatgattccaaatgttcactgtcatatcctgttgtgtcgcccaactctgtcaaagaatattcaggtgtgatcagttgaactaactcagatttttagttgtgtcaaaaaaaaaagaacttagattttagtaggctgcgagggcccaaagcaaaacaaatactatgactgcttaatgatgggcctaaagccatcagtggtcatggcccaaatatggattcatgcagcacaaacgggctttagaagcgaatagtcctgacatagcctcctcaccactgggccagaaaatcagagactcgagcacaacgcccgaccttcccggaggcggacctatccatatcggaaagcatgcgtgcatccactcgaataacgtaaggctagattgcactccaagtttttatcgtgtgacttgggccccggaccagcctgccgggctgccggccgccggcggcgggcgacggaaggaataatcagcttcgggcacatagggtgcggtgcggatgcgtgcatgcacgtatccactgaaccgagccgcagccgcgcgcgcagtgggccgtcactccatcgatcgcgtggcctaccggcagcacgacccggcggcacatgcaataggatgaggagaagattgctcgcaaaccaggatcatccgatgaagtgattagccccggaccaaatcagatcaaagaggattgctgacgcgagcatgtagtagtgtagtactactcctctgttgactatagcatcgggtgatcgatggaacaccgtatctgattctgctgcactatgctgatcagctgatgcggtccacacgttggcacgttgctgtatattctgggaagcatggcgtgttctacgccaacacgacgacaagtggctgactttgtgtagtactccctacgcatttcaacggatgacaccattgattttttttatccaccttcgaccattcatcttattcaaaacttttgtataaatataaaaacatttatgtcatgcttaaaaaatatttaatgataaatcaagtcacgataaaataaatgataatagtgtatatttttttaaataaaacaaatgattggtaaaaagtcaacgacgtctaaattatgtatgcaacacagcagccaaggagacacaagagagtcaaataaagctttggcatccgccaccaggacttctctaaactggtgacaggtgggaaatcaagatactccctccgggttgataatacttgtcgttttggacaggggcacagtcttcaaaaagtaactttgacaactattttctattataatatatataaaaatatcaacaaacatatgattttattgaagtacttttaaagattaatctacaaatatggttttcatatttttaagataattattttagaaattatttgtaatcaaagattttaaagtttgactttacccttgtctaaaacgactaatattatcagctcggatggagtatataattacctatgaaaatacttcctccataaaaaaaaactcaaccttctaaagcattcgcttacaattagaggagggccgccaaggctagagaagataagataattggacacaggttaattccagcaccaaatctatcaggcctgtaagctcctatcgcagggctggaccatggtcccaactcccaaacgaaagaaacagaaaggctcacgaattaaaaaccggattgtctcactagattctggttgtgtgcattgctgacctgttgtcaataccggtcccctcgcagtgagaaactaccaacaccaataatccatcgctccgtgcatcctggcctcctggggaaagagccgatggcccaaggtgatggacaaatttaaatgcaagtccgacagaaaacagctggtgcaactgtactctcgtactcgtacacatgcacatactcctacctaggagccaccttttccgctttgtctacgttcaggcgctcgtctcggctctcttggcgggcagcctcaaacgctccaaagttttttcacgtggttaacaaaataacgctccaagctagtatttgactttgtgagcaatgaaaaatgaaaaagacttggtaggtaagcacaaaggctccatttgtgttccgcagacgtaattcggcttttgttaattgccatggtagtcagtctgccaggcctccagcaatcagccatgagagcgtgacataagcgcagaacataatcaagtttaaatataaccgattacagttgactaaacacattggagagaattcttctattcccgcctctgccatttcaactttcttcacaatcacaaatattccaggtccgggtcttgtctcccaggctacggatagtaccgccaaaacattttgaattctccagtacacagagtgcccctaggatctccagtacaactccatcaaatactagcctcgtagcctgttgattcaaaaatatgtttttctactacttgagtcgtacacctgcattacgacgctccgctgctggatttgatctggagaacggagagagcaatcagaggatgcaaatgacgcaaccagcgcgacaacgagccgagaccaatcgatagagagaaagtggccgtggcaccgcccaactgctggctctcggcaacctgacggccacatgggcgccggttgcaccagctcagacgcaacgcaaaacccaacctttccaccgatcacgacagcctaacaatatgtgctcgcctagctagcctcctcgtgcacattcatcagtcatgacaccaagatccatcctactagtactatactgcctaccgtacggtgcagcaaagcaagggtacaaaggcgccttcgaacaggggattaggagggggattagtattagtagtagtatcagctttgctgtaaaggcatcgttaagaaaatccggatttcccaacaaggcgccgggcaaggttctcttttaaatttgaacagaacccgaggtttcgttcgacggcaaggtggtacaaaccgaaaacaaaaggacttggcacgccacacgagataatagctttacaaattgaccggtcagaggcctgcccggccacggccacacgacacgccgcaacaaaagacgacaggaaacagccagctgccgaaacggaatccacccaaaactctggccaaacgcccggcttggcaaggttatctgtatcctaatccacacgattatataccgagtgcccgagcctaaacgatatttttcacatgatcctatcaaattttagagagtatatccagatactgcgatcgctatgaaactatcaaatattatttaaaataaaataaattgaaaataatgggaataaatatactaagtttacataaaaaacaattaaatatattaaaatcaatattactagccacctagtcggacgttgcgcgactttagatacccattttaaaccccctatataagaaaactcttatactggaaatgttataataggttggtttgttttgaattttgatcattaagcgtcattgatggattacctaagttgataagcatatggcctcaactatatgttcaaaattttattacacaattgatgttgtaatgtacaattccatgttcaatataaactcaaaacaatcctatatcccatctatctattcacatgcgaaaacatatttgtgctgcttgtagccaatatgctccttcctccgtttcatattataaaactttctagcattgctcacattcatatagatgtcaatgaatctaaatacctatatatgtctagattcattgacatatatatgaatgtgggcaatgctagaaagtcttgtagtatgagacggggggagtactgtttaagtaaatataacaatgactataaatcatcttttactaattcaggaaaataataataggaaaatattactttaacacttattcctttagctaggaagttcttcaaaccgcctccatcctgtaccagtgttatatcaagttcatattatattatactacctctgtcccaaaataagtgcagtcgtggatatccgtgcccaacgtttgaccgtccgtcttatttaaaaaatttgaaaatatttagtcacacataaagtactattcatgttttatcatctaatagcaataaaaatactaatcataaaaaattttcaaataagacgaatggtcaaacgttaaacgtgaatagtgcaaaacagcacttattttgggacggagagagtatatgcatagcacagagctcatcatcttcccttttgaaggagataaagccgaaagtagttaagatttagaacattaatatgtcacatataatctgagatgaattggattatacttgacttctattaggactgtccttaagacacccatcaaggaaaaaaacattttttatataatgattaaaaacccatattgtgaatgaagcatttaactatacacattccaactatttagaaaggcggagtatttatgcttagaaattctgaaggttggcatgcaggtcatgtagtcatcagatagaattcagtgacaggggaaacaaccatttttaatcagcatattgcagccatggtaccatcagagtattttgactgatgtttgagattactgctgatatgaaaccaaatgaacctagctaaaaattaactgttttaatctgaacaacttcaaaatttgttgcaactgcaatgacaaaattacatgatattttatctgagctttccttggttatattatgagtatcatgagacatccaataggtgtggttaaacatatgaacaatttgagcaagctagctgtgaggaaatgtaaaagaaaatgcagagacaatgatttggtaccgtagctaatgtttgcctgatttcagaatatatgtatggattgaaaagctactgaatcaattgcaaataaaatcacatatctggttatttcggaagaggatctttgacagctctcgtcattgatggagacaaagaatcaacgaaccagcgtacctcagcttctagcttcttgggtccagttatatcaaggaatcaagatcgtggaattcactcaactttttggcaatcaacaggaacatctctagtttgctatatgccctagagctcaccggcgaggcggtgcgtctcctcggagatgtggtagaagccggcgccccatttcatggcggcgagcgggccgggcggcctcctgccgcagcgggattcggtggctagaccgatctgtgggtggaggacggggacgaggtagtggagacagaggcggcattggtagaggggaagaggaggaggaagtggtggcaggcagaggcggatgaggaacttgcgccaacgacgtggatatggagggggcgagtgggcgcggtggaggaggagggtggaagtggaggtggaggaggcgacggcaatggggaggcggcgatggaagcgaggagatgggcaggcggcggaggcagcggtggataattttttttctttttctttttcggaccttttcacctgctcggtgatttttcttttttatacggcacgacggcttctcctattcgcgacgcctcggctggaccatggaccgttggccactggagcattctaccatggtccagattttttttttcactcaactttactacttcacatctgatggctggtgttgaattcattgtgcatccaacggtcattattaaattgataacgtggcgcaatgaggtgacgaaacactttacttttttcactactttagatatgctctaattcatgacatattactctgatcctacagtaatataataatataaattttaaataagatgaacaatcaataatatgataatataaattttaaataaaacgaaagtacataagtacatagaaacccattgttacgtttaaaatgtgacagatgtaccttaactttgtggcttggtgctgtgacgggggacccaaggggaaattcacaacacaagccgtgatctcgtgatgctgtgttattaatctcgcaaccaatttggcaagaattatcggagttgcgagttcgcaagttgcagcacaagcgtcgccgtcggtaggtaatgacaggaagctgaagatgcaagatcccgggccccaaccagggcagattcttcggtggcagatgaccagttgattatgattggaactaaaaatagaccaaagaaataagacaccaccatgttaagcaactaggacgtcatatgttagacttgtcaagatacatcgaacaggttgagtaccacaaccacccgttttacctctgtacttcctactactccacatccatccaactacagaaactgtcgcccaacccaaatcagaatcccatatacatagccagagcaatatgctatgcaccaaaaaaaaaaaaaagtggaaggggaagcactgatgcacaattacacgaataaactgtatactcatgtgagttcctgactcttgaagcaacatatttcaaaaagatgcaagagagactgatgagacaaaggcaacacagcaaacgcagtgttaaaggaaatctgaagctcttattatttctttcttacaacttttcaaacatctgatgatttcttccaatcatcatacgactagagctaactggcatagagctaactagcatagtactccctccgtcccacaataagattttgagagtttttgcttacaacgtttgaccactcgtcttatttaattttttttcgcaaatataaaaaacaaaaagttatgcttaaagtactatagataataaaataaataataatttcaaaatttttttaataaaacgagtgatcaaatatttgcaaatgaaaacttaaaatctcttatattatgggacggatggagttccattcaattctccaaaagaacacttattattggatatatcaccgtcaataccctgaacaacctacggaagccatgtatttctcatctgttgatctgcatccatcacccaccttccaaaataaccaatatatcaccatacaaaagaacacctaacactgatgctactgccaatgccattcctaattctagcctaacacctacctagcactaataatagtagcagtaataattcttaaatatgatccattaaactgggattagaacagacgaacgaagcaaatctgcgcctcagtatgtccattcctggggaagattcacctcgcgcgcagcggcaagcgtaggcggcgccgcggtggccgcgtggaggtggtgctgcacccgcttctgggtggtgagcattgcattgctccgactgaccagagcgtctgtgagaaatgaatcaggaaactgtcaggagtactactcattggtgaaccgtaacataaaaattgtaggcgtggagtgaacttaccgtggtcgagaacgaaaccgccgggaaagcaaggacgggcaccaagatcgtcgacgttgaggttgagggcctgcacgacgcgcgcgggcagaagcacggtggagcagcctgaaggcaagcagagccgcagaattttagcccaaaatacggcgcgactcacgcaaaaaagggcaggtaaaggaagaggttcggaggaggtgcgcacttggctttttcttgggctcggcgggggcgccggcctggcgggggatgaacacgccggtgcccgtgcgttccgttttgccgccgggagggctgaggaacacggcgcgcatgccggccgcggacgacgcctgctggtgggccttctgcagcggtggccagccggaggagttcagaccaagcggcgcgccgacgccgacgccggcgcggtgcgttccccacgccgccgctgctgccgcggcgagctgctgctcccgttgctgcttcaacagctgcctctgcttcaggaggtggaactggaaacaggcggagacgaacagaacatcagaacagtcacaaaatcaaacagaaaggcatggaacagttgatttatggcgaaagaacttacatgagcgacttgaacctggcgttgggtgagcatgttgttgttgggcgcgaactggaaggcaccggcggtcttctgggcttgcaccggcggagacgggtttctcgcaggtgggacgaagcggccatggccggcatgcgcatggggcttctggggcaccgggatgctgttcatgcgcaggcgagcaacctgcccggcagcctcggagagaacgtcccaagggtccgtcggcggctgctccagcggcgacgacggcggcgagctgaactgcgacgcaccgccgttggggctatcctccccggaagccgccaacccgcacagcgtcgactgcggcgaccccgccatcacctccacctgtcacaaacaaaagaacacgatcagatttcgctacaacgaaggcgcaaacacaaagcatgtcgaacaaggccaaacgagacaccaaccaaccttggaacccgttccctttccaccctcgccggcgaggaggtcggccatgcgtcgcgcgaggccatccaacccgtcctcctcgtcgctctcgctcttggccgcaaccgccgccttctcctccacggtgaagaaatcatcgtccaagaactcgtcggggagccacaactccgcctcggcggcgccaggggtgcacacctccgccatttggcccacgaaaacacaaccccttccgtccgcgcggctgctgcaagcgtggacggaacacccactccccacacgaggaggaggggtaatataggacggcggtggtgttggccaggaattgccgcgcggggaagaaacaataataggcagcggcacgtacagggccaggagaggtgatggctgatggctcccctccccgcctccctcctccagcactagtacgctccaacctcctgtcctcctcgtctgtgtgagcgatgggggggacccaggaaggcaaaacgcgaagtatcagatgatgagatgagatatattatcccccggaaagcggatggacggaggaggggaagcggcgtgggggtgggatggaggggagaatgtccaaggacggctggggattttatcgagcggctgtggttacggaggtcaaagcggtcctcatctctgcttgtgttgggtggctttataaagtgagccggaaggagtgtaattagtgggtctgatttttatttttacggattaaccgcacaacggcacaagtacggctcaggcataggcatagcttatctcagttccatgataaacttaaagtctgtatgtaaaactataatattttaaattataaatttcacatgacatggaaacaaaatgattatccaaatgttatctacgtaatcatagatttaaatttgtaaagctaaaaatattcaactgtaacaaaaaaaattggatccagagctatatccaagagggcctacatctgccgtaaactttaaatgccaaatgaattgtttacggttaaaaaaaaagacttggagttaggactatttgggaagcaaattttggccttgtttagttcctaaattttcttttttcaaaacatcacatcgaatctttagacacatgtatagaatattaaatataaataaaaaagaaaaactaattgcacagtttgaatggaaatcgcgagacgaatcttttaagcatacttaatccatgattagccataagtgctacagtaacccacatgtggtaataaaagattaattaggcttaataaattcgtctcgcgattttcagtcgagttataaaattagttttttttcattcgtatccgaaaaccccttccaatatctgatcaaacattccatatgacatctagaaattttcttttcgcgaactaaacagggccaaatgagtaaccgagtgtctggaataaggtagtcagtgtatgtgattaggactagcgtttgaaaccaccaaagataatagtaatgtgttttcctcctgagaattggtcctttttttttctgaaaaatgcatctaacttattgttgctatttttcctttggtattaagacaacacactccccccaccaaaatggtagtagtagttcaacaaatgttgacaaaaaaaccacatgataacaacaaaaaaggtttgaagttcacatcaacatctgatggtaatgtactacaccagtcctactccttgtggtacgatcggtttcttgttttccatttttgcgaggggggtgccaacctactcgataatccgggagagtactggcgagataggcgtggtacgaattaaattggtcgatgtggcgtaaagcacgatcgtcacgagactttcaccgggccgcagttctcgtagggcttcatgttcgtgtttgcaaccgcattcaattcgtgacctggttctgcacattaatgcgcgagtttcgcgccttgtaccgtctgtcctggtatgtacgctacagcagccaaacacgtcacgtatgaaaatactgcgcaacccaaagaaccggagcccagccgtatacccggctagcgacgcgttacaactgtacaagaggtactaacctggatgacatgaaactatgaaagtgaaacgcagccgaacattcgccggtggatttgcggtttcagggggccactccgtaggtgtgtgtggtgtggcccagccgagcagttgatggtcaccgctaagattgagcgtggaaacgaactacggcactgctggggtggggggcccaatgcagcagccaaaatgcgtgccatctatgatgcacatgttatacaatgtactccgtaccccacgtacacatactcctatatactccctccgtcccagaaaaagacaaccattggtttcggtgtccaacatttaccggtcatttttatttaaaaaaaattatgaaaaaaattaaaaagccaagtcacgtataaaatattaatcatgttttatcatctaacaacaataaaaatacaaattataaaaaattttcatataaaacagacagttaaagttggacaagtttgactttttttacgagggagggagtacgtatctctactttacaatgacattgattgtcgtacgagtaccgacagctggaatacgtggttcgaaacatacgtgccctggctttcctgggcatcaggccggtcgaggggaattccacaccgagctcgctgcccggtgggccccgctcccagggcagcaactcccgcggtttttgcaaccggcgaggcgcaccgcgcaccagccaagccacctcgcgcccacctcgcggacgcctcggccctaaaccaccacgttccgttcacctcctttatcgccgctaatctggcctcgtccgcgtgccttttcttttttttttatttttttgccttagcgggatcgcattgtttggcgggcagacgaaaatagcgtgaggcgctagcatttcgcgggagaaagaaacgtggaagcgaggatccgagaacgctggtcgctccccatgctttcgcatgcatcgtgcgtttgtgctccggctgaatggagacataggggaaaacaaaacgtggtcgacgtgcaaggcgccaaggccggcaggcgcggccgacgtgcgtacaacctaaaagagcggagtttcgagtttaagagggtgtttggaaactaggggctaaactttagtccctctcttt

SEQ ID NO: 20835 - DNA, 5662 bp, Oryza sativa
  unsure (1)..(5662): unsure at all n locations
ggaaaaatacatttcatatgtactaaaaggcacaaaatggaggagaacggggcttgccagccggccagcttatactgtcgatacggtctggtggtagtatattttgaaatgtccgtgcgcattggattcgtttttagctatgcgaggaaggcgcgcctttttgacagccattgccgttgttaccggtaccggcgcaagtgcagtgccgcacgttggcccacgttgtttggcagctcgtgccgtccccgcgccactgctccaggaatgggcagccttgcgccagcagtttgcaacgcagcgctagctttgaatcgcgcagctgagtgcgtaacgctgaggaaagaaatgaaagcgaaggggattgtggtgggtgatggcatttgtctccaagcaagcccgcaggctcccactgcgcggggcaaggcaagcaggcagcggcaggcaaggcactcggcaagcaagccccttcccttccccgggctttgctctgccagccggtttgtgcagaaaagttagcgcgcacacatgaagaaagcactgtctttaccctgcatgcaactgacaaaatgtggcagaagcattactactgtcccatcgtaccagagaaaaaaaaatgattagcccgttcacaatgcacttgtttgagatatgagaaaaaattgaaatgagagtaccggacatcaaacgagataagccattaacataatattaatcattttaaattttaaaataaattcatataatttttaaagtaaattttaatagattttttccgttcatgaagcgtgtgcgtttcttccctccggcttctctcgaacacttcaaatggcattcaatcccaacctgttggctataagatttctctccacatctgcacctcgtgtgcccctaggaagcccctcgcactaccgcataagagcaagtttaggccatatttagttcgcaccaaactttccacaaactctcaacttttcatcacattacatcacatctaaaactttcctactcacataaactctcaactttccccaaacttctccccaatttcagaaactaaacacggcctaaggcttacatactacactattaataactggtctcacatgtcatacacacacttcgttttggagttcgtgctacagctggctacaaatctatagcccgctgcttctctctctcctcatttatcttattaaaatatgtttgcagctaggttataacctgctattgtacctgctctaaatacgacttccccaaccgcccctcaagccatgtgacgtgttccctcctcccatacacgagtgtatggccgggtttagttcccaactttttcttcaaattttcaactttttcatcacatcaaaactttcatacacacataaatttccaacttttttctttaaacttctaaatttagcgtggaactaaacacaccctttatctctctccgccgagtcgtttcgttcctcacgcatagcccatccatccctcgcaggtgatgacttagggcacccacaatgtggatgaaaagtgggtagtaagaccccttactacctactttaccattgtgaatatggatagtagagcagataataactataccaggcaatagcactactacctggtaacaagcataaaaaaatattaaacttttttttctcactcactctctctcttttttatcccatcattgctttacatgtaggtcatatcttactacccacatattgtatattgtgtgaggtagaaacaactatgagtatgtttagatttatttggaatgacaaatggaaaaagtgttggtggcaaaagttttgacgttgcaaaaatactagttggtgtttagatgcatactaaacttttgctattctagcacttttcggtggagagagagagagataaatagtggtcccaaagcacgttttggcacaatttgctactatggactagcaaatggcaaatgataaattgtcaacttttactagtagtgttagatccaaaatggcaaaaagtgctctaaaatggtaaaattttggaggatctaaaccgggcctataacctagttttgtgagtcccatcttactacccacttgataaatatttattgattatgcccttgggggagggtggaaagaagtacggctaccaggaacataccagtagggaggaggacacatcaacaatgttgcagcctcaccaggagagggtattagggctttttccttgttcttataaataggtcgtttttgtcaaattcgatctcaccaaaggcctatttgtaagaaagaataattgcattttaacattataaaaagaccctcgacgtacatatttttgacgccgatcccttttgtgttagcaacttaccaccatgtatcagcatcgagagatgatctatttttatttttttatatacgcattttcaaaataaaattttaaaacaactaaattataaaatagtcatgcaggatatttcggttggttccgttgccacaattcatccatcttactagtttatactcctcacttatatatatatatatatatgtatatatgtatatatctatatatgtatatatgtatatatgtatatatatatatatatgtatatatgtatatatatatatgtatatatgtatatatatatatatatgtatatatgtatatatatatatatatgtatatatgtatatatatatatgtatatatgtatatatgtatatatatatatgtatatatgtatatatatatatgtatatatgtatatatatatatatatatatatatatatatatatatatatatatatatatatatatatatatatagatctatactcctagggagtacgtactccctctcccatccaccgttcatttgatcgatcagatatgtactccctccctcatcataacgggtttggctcggtggatccgattagtttttctaattaaaagaccggactgcttattccgtaatttggggtttgctcccaacaggccaaacagattatcccgaaaattggggttttggggggcggcgcggcgacggaactgcgcgacgacggaccagcgattcagctttcggggttttgggggtcagcgcggcgacggaccagcgattcagcggcgactgtgtggctggcggcggtacagagatagcagtttgttccttcctccagtgatgactcctccccttcctccagcgatggatcctctctcaacaacatgtgttcctgaagcagaagtaatcgatctagagtcggctgaatgcaggagcggggcaacaatggcaaaatcgatgggccatagcagtggatttcatccaaagcagcaggttagtattcgtttatttttgtacggcaagatcaagacacgttgcctaaaattttcttctttgccgcagggtcacaggaaaattagtttgtcaccacagtccaaggtatgccacctgaaattgaatacatgtatgcctgtagagagggattaggtgtagttcggttcatgtactctctcagtttcagatgctaatttttccccttttagtgcatatgatggttttttgggtggatgaagttaatgctgttttagcccccacccccataaagaaaaatgtagatggtagtacgtactgaattttcaacggtatatactcattttttctttggaggggaactttttggaatctgctagacggtattaagtattgatttttggtgtggcagggttcttactgaactctctggtaagcaatagtatatactgaatttttatgtggggagctttattctctactttattggacgatagcatatactgcattttccacatctatactgaatctttccacagtgattcatagactgaactttgatacgcaccagtatttactgaatttttcatagatatactgaatttttctatgggaggctttgtactgagctttgttatacgacagcatatagtatgtactgaattttgtatgtggtacatactgaacttttctagaagatagcatatactgcatttttccacatatatacagaggcttttccatagtggtttacatactggaccttgttacgaagaagtatatactgcacttttacatagagaggtatatgctgattttttacatacagtaatattctctaaactttgcatatactgactnttctttcagtgcacatgatttttttttaattaagagggtacacataggtagaatttgctacgcagtattttgtacttcatctttccatacatatatgagtgtatgctgttttttttaaaaaatagaagtatatgttgaaattttaaatacactggtccatgtagtattgtctatttatgaaatgaaaaactaattatctgcaggctttgaaggtttctggcacaaggggcagcctaaataagactgctgcacgggtggtatccaggtatcggcaaagcagagttttaaatagacagaagaaagacaacactacctttggtatcaactgcaggtgtcagcccaaatgcgtagtgaatatcattaaagaattcgatgataggaagaaggagttgattggtgaagttgggtttgatggacttttggatatcaagcttactaaggtaaacaggcagtttggtgcatggctactgagcaaagttgatccgaaatcatgcgctattgttaaagatgtcaaccaggagttgccattcggtcctaatgatgtgaatgcagtttttggcttgccatgctcaggtcaacctattatcccttgctctcaagatgaattggatgggaagaaacaaatattgtgcgaaatatttgagataccaaacttttcacacctgaaaatatcactcttagagagaatcctaaagaagcagtatggttatcccatgacaatagatgaaaagagggttttcatggcggcttttgtgctttatgtcacaacgaagcttttggcaccgcaatcctgcgcaaacttcatatctcctaggtatattatggctgtttctgatgttgacaatataaaacagtacaactggtcccaattcgttgtagatgaggtgaagaaagcagcagaatcaatgcccacctgctttccgaataaggctcaactatccattaacgggtgtatcatctttctaatggttagcatttaaaactgacttgttaatgcagcatacaatcaacacacatattgtcattgtgaatcatttttgcaggtaaaatatttgagaaatctccagttccggaaggttgggatcacatgtgttaaaacatgtcacatttctcagtttgaggatgatcaaattgctaggatgattcaacaagatgtagttagtaaacataacccaggattccccttccctcgttatgggaaactccaggtatgtacgataccctggctgtaatatgcctatttctggctgcaaaatttagctaatttccgatatacatgctgttcagttgatgaaggaaccaagagaaaacaaccccatgtgccagagctatctcccctaaacttatgctccggttcgaagatcccatctagagccattgatggcggtaaaaatttaataaaattcctggaatcacacttctcttcgttagacgtacgtggaactgtcgggtcacaggtatgtcaaccatccgtatgctatgttacttg

SEQ ID NO: 20836 - DNA, 2524 bp, Oryza sativa
atacctcctcttcaatcctgaatctggtactgtgtctataatcatttctccatcaatcaaagtcatctcatgtagtcccttggattggaaaagaaataaggttaactttttgcaaaacgaaatgcagtacgaccttttctccagaacaataatgggatcttacttcattaagattcctatggggaaagcgcatttgaactcttctgaagcaaaaattccgatcaatcaagaaacagccatccctcattataagcatcatatatcgggttccatcagctttccatgtagcaaagtagtatcgctgtctgagtagttgcaaattctcactgcggagcgtaaaaaggaatttagaacaagaacatagttagagtgggaatcaaatgaatactaaataaggaccatttgaaacaaaatagtttcatacgagaaaaaggacgctacaaaaaaaaacctctaaatcaaaaccgggcatttctttcctcccctgaaagaacaataattttcttcagcatagcaggcgcgatctcatagtttcaaggcttaactgataaaaaaagagtcgcatttaagttttaatatgtgtacataaaaaaatttgggacaagttacatgaaaagatctgaagaaattaatgacataaaagaaaggctttctgcaatcagaaatctgttgttcatatgtgaaatggagctttctaagagaaggggttgggtgcatatttccaacccatcaagtgcacaaattttacctaccaaccttatattagaggcagagatttaaatttttcataaactactttctacagttttgctttctgcaaagccccaaagaacatcagaaatcaaaacgcacagataacatgtaagagataatggacttaacacagatactaataagttactagtattacaaacaatgcatgaagtccagattactgttagccacctgttaagagagacaggatgtgatccaggaaactgtgcatgccctctcacctgtaacaaaacaaatgctattatagcagcgtgtaagaaacacaagttgtggttggcaacatatgcagaaactattaaagttacagaacataagtaccagttgaaaatagcacaagcattataacagctaaaaaggagactagatgaacagacaacataatttgtatgtgcacatatggatgttcaattgaccatataaaatttatacttacagggggcatttccagcaagcgataacatacgacacgcagagcatcttgctgatcatatggtacagcatctcctagcacatcatcattagtgataactttatcttccacctcattctgcaagatacaagggctcaaaagcaagaaaatagctttgaatattccaagcaagtttgcttcatgacaattaaaaaaaacaatatgagccaggagatatagtaaattacatccaaagtaaagtccaaaaatccaatcaaataataaagtaggtcgtatgaactcaaaactctacctttatgtccataaatgaaaaacctttcgagaattacaaggaatcaggcacttaattctctaccaaattacttggaagtaatttcagatttgaatatctgaaaatgcttacatgtactggtgcaagatcaccattctcatcatcatcatcttgcttggcttcaccatttaaatcaagatcggatgaccttttccattctggtgttgaagggcatgttatcatatgctcaggaacctcatgataaaatgaatacagtgcttcaatgtagtccctcttatatataccaggcggtctcctttttgcaaatatgtttatcgcctagaatgaaaatgaggtcaagaagaacagtagaactaagtcaaacaaacaacattgagaatctagttggcatacctcagcgacgcaggatacttgtgttcgcataaggtaatggataatcatgaaaccagtacgattatgaccatgggtacagtgaacaagaatatatttaggattctttgactgcttctgtcggtcaagaaacatcatcacctgaaataacagaaaaaaatcattccataaatatacattgaatgctgtctgtacatatggttgctaactacatacatctgaatctattgttctatggtacaaaataataaagaaaatcattggttgcagatgaggaaataagtcattaaaaataatgtaacagaaaatatatatataatggtttatatacttcaacgcgtatatcattgaatttggtgagcccaaattgttgttgcagaaaaacctagatcatttaaccactatacaccattcccatgaactgatgatccaaagaaatatgcatacaggtaacaggatctttgataatgaaagatgccaaagtgcaaacaccttttaagttacaaagtaggtataaactaccgtgcgaagaaataagtactccctctgatgcaaactgtaattcgttatatgtattgaccagtggcggagccaccttaaaactgtggggttgcatcatacaccttgatcatgtgaaa

SEQ ID NO: 20837 - DNA, 5298 bp, Oryza sativa
gttacatgcaaagccaaaatctgcagttcataaccatttaataactaacttgtcatggcacctttaacatgtgcagaccaaaacatcataataggtatatattgacacattgcacaacttaatcaatatcacatgaagttaaaaacatgtagctcctaattaaaaggtaaaactactttttaggccttggttcagttaatcccttcccaagaggattggaggggattaattccacatctttcaaatctcaatcccctccaatcacttcctcatggggattaactgaacatgcccttagagaataagctcaaacacttgaggaacaaaaagaaaacagctcacaagaaacaaattgcaaacacaatgggataggaaaacaaatgaaatactttaaaaatgtgaaagaattaagcaacagactcctacttggacaaataaacaccagaatcaaatatactgctgatacaaaacatgtagccaaatataggtgttacctcatagacaaaccaattaacagattcattatcaggtacagcatctcttcccttgcatggaatctaaaacagaaatgtgttaacataggaaaggcccttttgatttcaaggatgcagataagcttaagttctctcaccttgacatgcttaataccttgccttgtccattctgcaggtgagtaatatcgagtagtatttgtcaaatcaatcaccaaacctatctgaaaagggataggaaaaaatcggtatagttctgttagcaaaagggggctgactaggaatgtacgcatacgagataatccgtaccatgccaataatatgaacatttcgaacaagaggaggagcagtaagtgcacatgtttcacaaaagaatttcagaattgcaatcttttatttatacaataatatcaattgaaaacagcatcatcttcgcaattaacaaaagggaaataagtacgtagtacaactacaaactataaaaataatcaacaagtcaatacttacttcacgaccagcttttctttgtttattaactacttgtttggaagaatatcttttcccaggaggcaccaagtcattgaatgtttcatcaagaggaaccttggaaggtatgattttgtctattggctcaccaaatgctggacaattcatccaacctgaagtaacatagacaaaagcaagaatagtcaaaatccattttgcgcatgctcatagctagaaattgccatataaagttgataacagttagaaacattttccaacatttcataccatcaggtgcctcttttattcgacctctaccagctctgttataaggtgcataatcgttcctaatctgctgagaatgtaatcttgagccttcatcttgttgctctctctttaattttttgcgtctctcttcacgctcctgcaacaatggcaagattaacataaaaaggtggcatgcaagtttgcatgcttgccattaagaaaaactgaaacagacaatcaccactttccaatcctcaaaatagattatctgaagcatgaccaaaacaaaaggcagaaaatttggatgctatgcaaacaaaggaagcgacataccagtaaaactaggaaaaggaacatatgtaaaccaacattaacaacttccaagttgtttcccatcatctaacgatattaactaagagaacttgctgaagataaaatgtacagtttgcatttcagtaataaataatcagctatcattaggaaccttctagatggaaccaaaaggtaaatgcaggatgagtgtcatgtagtacccttcgcattgtagcaacagcagactcaacatgctcctcctgtgcaaaatcaacctcgacctgttgttcataaggctgttcatcttcctcaggcaatggtgaggcatttaaatccattgagaaggtcattcaacatccactacttcatatatcctcaataacgttttgagatttgcacctaagaacaagtatatacttagatgatcacacatggagaaacaaatattatcaaaatctcaaaatcattaaaagtgagcggaaggcattaacacgattattgaaaagacagcacaagtttcaacctatacaagcttaaggaaagaggactgagggacagcttcattgacaagcattccacacccccaaagaaacaaaccacatcctttataatacaaactactgacgaaaatcttgcatcacataggcactaataacagtgttggttgcaaagttgcaaacagtgtagcctagtatctattcctgtataaagcatgcgatgtcctatgcactgcagattttaaaaagaacaactcttacagctatgctaccagcttgaacatgaaaacagcacaacagtaaatatttcatattgtgacacctacaattcaacaaataacaggaagttgacaatgaacatgcatggccataaagcccacaagaacatgtttgtaaatttcaaacgagattgagtgtcagttcagatgcccctgacttaaaaccttacacaatactagactcaaatttaagatgaaggataggcacacaagatatgaacaatggaaacgaaatcataaagactacgcatactaatgattaccattttaccagtatttcaaatcctgccagtatatgtagaagtatataaatttataaccaaggggggaaatctagttcacaggaaaattagtgctagcatcactaaaccctcagttcaggcatcaagtcagcgcaaagtttgaaaagaacaaaaatggtgacataccaagactgaaaatttggaagggagactcaatcaatagtaagataaccaataatggcaaactttctgtggacaataattttattttttcccttcattttattgtaacaattcatcttatattaactttcttatatagaacagacccaaacttgaaactgaaaatctctgtatggtggaagattacttgacaaacacttgcacaacttcaagatttttggatattacaggtcttgtggcttgcaccagctatgcctctggtaaataaataaacgagaacattcttcattttccatcaaatgctatcatttttccttaattcctgataaatggctcatctcttatacactatcgaatgaaattctgcgtcccttatttgccatcgacgtaatcatactttaaaatcccatcactgaggttcattaatttcaaaccttctttcgaccttagtcactaaaatacaaaaatggcaattttgcccctagtcaacatgtcattgtcccaggctcactattcaacatgctctttctatctatcttttgctttttcttctctgccccccccctttggttccatcagtcgttgcttgctcacaccgaggtaggtaacaccggcagcacatggcgcaggcaagaaggcgaaaccagctactcctctggctcacctaaaaaacctccactacctgacacctgataacagcaggtttctggcatgttttcgtagacgcatgaaatcaggtcagccccaaccttttagtatatatttttcacgcacttcgcttctcagcttatctaattcatcgttgcttcaagcgaattaataataataacttatcatgctcatcaagactcatcatttagacatggaatagcagagcagataggtatccaagtgtgaatagccagttaaggcagagataggaatctgggcacagctggaatggagaccaacctccattctgcattctctgccaccctcaaggtgctcgacctcagccccaacccacatctactgggtgaatccagtgaatggactatcatacaagacaagtacatatgggtatgggcagccctgcatggctgcatcccaagatatagagagggcgggggggctgaactagtggcatataagggataagccaactctcagtggcgaataaggaaacatggtaatattgattgtcacttaaaaagaatttttctcgcaaatataaggtggttttacaataattttgtgattttgagggtccattgttacataaaacagtatcacctccatacaaggtaagttctgtggcagactgcaatatcagactgagaaactgcccatttatttgcatgggtttcagtgacatgtggggccataagcataaactgacatgtggggccataagcataaagtccccacaacacatgaatggccctagaattgctaattctagaaattttaaggggttacatacaaaatcttcaaattcacctgccacccacaaatgaattacagtattattatccaaccgtatggcttatagaaatagatgaagaagataaaaggaggtgatctagcagcatatttcagcatggttgcctatgaagatgacattatatgcctaatcgactaactatgctataaacttgtaagttttgcttttgcttttctctcttataatatccgttgcaacgcatttgacttggctagcaactctaaagttattatttgacttgttaattgcacaccagacattaaaatatctgcattctttcctcacccattttgcaactattaagtaatgtactgaagagatatgcaaatattcaagtccatggcaccgaaaaagtgcatttttcctagcaccttgcaactttaagttatcaactgaagagaaattcaaatgttgaagtccatgaaaccaagatagcaacaataaatgttcattttggggcatttaatttccccagcacaatagcagcataaagaggtaacataattcatgcagtgacagacgacatggtactttcaaggagaaaaaagggtgcatgtaggtttcttgcagctatattaccacctaaaaatgacggaggttcatacctccacagaattaatgtcaagaatggagtgaccaagcgaaaatgggaaaaaaatgtcctggtgtcatctgaaaacccgccccaagccacaagcccacgacacaaaagatgaaattcgagctaaaaaaaaaacaaggacagctcacaccaccgctactaccagttacagcaatagctaaacagctagctagggttctcccaaaaacggggtgaaacgccggccaaaccgcttgctagggggattaccgcgagcacaccaacacacgaaccccccatcccgagaccatacacgcacgtcgcccggcccgtacgacccgtgccgccgcggcccccaattcccacttcccagcccgcgccccccgccacgcacgcgcgcagggggtgaaaccagaccgccgtgggagcgagcgcgagccaaggaccgcagcgaattgggggaggaggaagggggaggg

SEQ ID NO: 20838 - DNA, 1597 bp, Oryza sativa
gttgtggtggtgggggatctgcggacgagggtggttagggtttggggggagccatgggatggagtggaaacgattcgaatcggctcgagcggtggcgtggcgtgggattgggttgggttggtgctctcgtgcgcggctggacgcacacacggacccggacccggaccgggacgagacgacggcaaccttttttccgctggactactactgctgactggtcagttcgttcgtcctttccgttggttgcgcgcggcctgctttgctttcttgtttgctttgctttgcttcctagttttcccgttagtgctttgctttcttggttactgctttgctttgctttgtgagaaaattgagattaaggcatagtagttctattcttcaccttcaaattttagcttcctggttttcccgttagtatgtttttcaaactataaaataatatgtattttgtaaaaattttatatatagaagttgctttaaaaaatcaaagaaatctatttttcaagtttataattattaatacttaatcttatcttatatacatatatatttcatccccactaagtgtagttaatattatttctctcttctgttattaagtcacatcatcccaattatttttaatctttggatgatagatctatggtccaaattgtcccttctttcttctttcataaaaacatgcaatcttaattagttttaggctcagaattgtatccaattgttttagttttgataatcaaattacatcttatttgtacatattatgcaacttaattttccgcagcaacgtggcggggtattcatctagttaatcatatgctaatgagctttctcgttttgcgtgcactaaaaatatctcttttgcaaaggatcgaacacaacaaagccagcattacgaacggtttttcgctaaaatattattttataaataggtttatttagttaaattgttattattaaccagtgtgtcattgctaaaatacttccttccctacttcttctcttccttgagctccaaccaatcctctcttactactccgcgctcttactactccgcgcattgtcacgaccgcaagctccgcctctgctcaggttcttctcgccgtccctgcttcccacttcggccattgcactggggctagaggaggttgtgacggtgcaggaagtggaggaggtcgaccatcgcgttaggcgtaatctcaaatttttgaacttctgcctcctctctttccttcacgaggaagacacggagaccaagaacatatttgtgtgtgcttaatatatgtaggaagttggatttaaacaaggtgagtagaatacatgactccatggacacatcgtcgatcgactaatgtttcgcccacaatagtgagtattggtgatgactcggtaagattattgtctctattataataatttgatgccataagagtatggagaacgattggcattgacatttgagcgatggattgatgacaggtaaggttatatcgctttctataaattatattttagcattattcgaacctacagtttttaggtaccgagtctaatgggtcgactaatttctttaatagtcaaccggggtgcagga

SEQ ID NO: 20839 - DNA, 1395 bp, Oryza sativa
tatcactcttcagttccttaccgagcacgggcaatgcctggttgctttgatgagcggcaaaatttgtgcttccacttttgtttcccacctatagagagatcagccaaaggacctgaccaagtaggaacagagcttttctcttgagtaaacatagtgctaaatgaagtcggatcttgggattcatatagtgggtccatgtgatttgaaggagccaagagacgacaccatcctgatgtggaggacgaagaagcacaacaagatcctccagatggaggagtcgctcaccgacgggaggaagctgaacaaggagcaggaagaggtgccctgatccaagctcgtcatcgtcgtgctcatcgacgagctcaagcggatgcgtgccccgctcgccaccgcactcgctgaggagctctcctcccgtcccgcccgttccccatccgtcgtcgtgtcctcctcctccagtgtcgatttgtctatcaaggatctcctcgcgctcatctactttggctccctcttcgacgtcaagccacagaccgagttcatcgccaccatgctcgtgcgtcccaaggagtgggactgctgcatcacctttgactatgtccgcccttgtcgcctcacgcgctgtcgctcactggtcccaccgccactcgcagctcgtcagtgcgggaagaagacaggagaaagaaggaaaaaagggggaaaaagaagagatggatggaaaacatgacggcggtggcacggttcgaattttgtaaaattttagtagcatggctacgaatagacgaattgtagtggcatttttttgaaccgacatatttgtaattgtatggatccaattaaccctagtatttattgtgtggtgagcaaaatcgataaaaatcaagtccaaaaggcattgtctgtaaatatcactcttcagttccttaccaagcacgagcaatgcctggttgttttgatgagtggaaaaatttgtgctcccacttttgtttcccacctatagagaggtcagccaaaggatccgttggctccgaccaagtaggaacatagcttttctcttgagtaaacacagtgctaaatgaagtcgaatcttgggattcatatagtgggtccatgtgatttgaaggagccaagagacgacaccatcctgatgtggaggacgaagaagcacaacaagatcctccagatggaggagtcgctcaccgacgggaggaagctgaacaaggagcaggaagaggtgccctgatccaagctcgtcgtcgtcatgctcatcaatgagctcaagcggatgtgtgccccgctcgccaccgcacttgctgaggagctctcctcccgtcccgctcgttccccatccaccgtcgcgtcctcctcgtcctctagtgtcgatttgtctatcgagga

SEQ ID NO: 20840 - DNA, 5445 bp, Oryza sativa
tcctaatatatagagatcagccaaagtacctgaccaagtaggatcaacgcttttctcttgagtaaacacagtgctaaatgaagtcggatcttggggtttgtatagcggatccatgtgatttgaaggaatcaaagagactgcaccatcctaacgcggaggaggaaacttttcactcttgctttcgcagttgcatgtgttattaatcttcttttaacgatatttacttggaagcattggaacggctgtattttaaacaatgtcatgcctagtgtcaatgttgttttggaagcagtggtaggggagagtgttttgtggtccgtggctagagctagggctctccatgaactcctgtgtctgtctatcctgttgactggttatttgttgcctgaaagtgtgttttgtgttttggtgacgcatcgcctgttgtgatgttttctttctcaagagggttccttcgtgaaattctcttttcaacatattttgagtattcttaatgaaatgaagcacatggcttttgcgttttcatgaaaaaagaagtccaaaaatcaatttgactttttagtgaatcctgtaatccaaaaccacttctaattttccttgtatggcatataacttacccctcccattgtttagtaccatcagaacgtctacatcttctcacaatacaagccaagccctagtaggcagtcaaccaccgaaaaatcttctagctagaagctctcacaaaaaccaatccccttttatgtagtgcggcacagctccatccgtcgtccaagtttgttgggtgcttgtcatagccaagcgccatggtacacatcaatccttgtatcgtggaggacatggcagaggccatgtacaccgctatcaatatggatgtccaagagacacacgaatggaaagtcaagcactacgcatttgccacgttgcatggcatcatcatatgggcgatgtcattcaccgctgatctatcctcctagccttctcttgttagggattacatgttgcgaagactaacattctcactggatgtcaaggtgctcctgtttcagtcaacgacacacatgcgtgcacgtgaccataaacactccaaaacacacacacacacacacacacaaactccgcgtggaccccatggcctcacctgatttccctacctccctaccatcactgctccatctccaagcccaaatcccaaaaccatagcccatggtcgcatctcccactggctcctcctcctcggccactgccgtggcgacgatggcagcggcagccgagcccactgacgggccaacccttagcgtcgtctcgaagtggctccacgcgctgcggaagaagcacaacaagattatccaaatggaggagccgctcgctgacgggcggaagctgaacaaggagcagggggaggtgccctaatccaagcccgtcatcgtcgtgctcatcgacgagctcgagcggatgcgtgccccgctcgccaccgcactcgctgaggagctctcctcccgtcccgcccgttccccatccgtcgtcgtgtcctcctcctccagtgtcgatttgtctatcaaggatctcctcgcgctcatctactttggctccctcttcgacgtcaagccacagaccgagttcatcgccaccatgctcgtgcgtcccaaggagtgggactgctgcatcacctttgactatgtccgcccttgtcgcctcacgcgctgtcgctcactggtcccaccgccactcgcagctcgtcagtgcgggaagaagacaggagaaagaagaaaaaaagggaaaaaagaagagatggatggaaaacatgacggcgatggcacagttccaattttgtaaaattttagtggcacggctatgaatagacgaattatagtggcatttttctgaactgacatatttgtaattgtatggatccaattaaccctagtatttattgtgtggtgagcaaaatcgataaaaatcaagtccaaaagtcattgtctgtaaatatcactcttcagttccttaccgagcacgggcaatgcctggttgctttgatgagcggcaaaatttgtgcttccacttttgtttcccacctatagagagatcagccaaaggacctgaccaagtaggaacagagcttttctcttgagtaaacatagtgctaaatgaagtcggatcttggggttcgcatagtgggtccatgtgatttgaaggaaccaagagaccacaccatcctgatgtggaggaggaaacttttcactcttgctttttgcagttgcatgtgttattaatcttcttttatcgatatttatttgaaagcatcagaacaattgcatttcaacaatgccattcctagtgtcaatgttattttgaaacagtggcaggggagtgttttgtagtccatgtctagagctagggctatccatgaactcctttgtcggtctctcctgttggacggttgttgtctgagagtgtgttttgtgttttggtgacacatcgcttgttgtgatgtttttttttcaagatggttcctctgtgaacttctcttttgagcttattttccctcttcttaatgaaatgaaacacaaggctcttgtgtttcatgaaaaaaggtccaaaaatcaattaacttttagcgaattctgaaatccaaaacaacttctaatattccttgtatggcatatgactcacccctccaattgtttagtaccagcagaatgtctaaatcttctcacaatacaagccaagcacttgtaggtagttagccacagaaaaatcttctagctagaagctctcacaaaaaccaatccccttctacgtagtgcggcacagctccatccgtcatccgagtttgtcgggtggttatcatcgccaagcatcacgatagacatcaatccttggatcgtggaggccatggtggaggccatgtacaccgctatcaatatggacgtccaagagtcacacacgtcaagcactgcacctttcccacgatgcatggcatcttcatatgggcgacgtcgttcaccgctaatatatcctcctgcccttctcttgttaggaattccatgctgcgaagcctgacattctcattttatatcagcgtgctcctgttcgtgtgaccacacacacacacacacacacacacacacaattatagaatttactgtacagtgagcaaaatcgataaacataaaggccaaaaatcattgtttgtaaacatcactcttttgttccttatcgagcacgggcagtggctggttgttttgatgagcggccaaatttgtgcttctacttttgtttcccaactctagagagatcagccaaaggacccgaccatgtagggacagagcttttctcttgagtaaacacggtgctaaatgaagaaagatcttggggttcgaatagtgggtccatgtgatatgaaggaaccaaagagaccgcaccatcctggtgcgaaggagaaagcttttcactcttgcttttcgcatttgcatgtgttattaatcttcttttttcatatttatttggaagcgtcagaacgattgtattaccaacaatgccatgcataatgtcaatgttgttttgaaaccattggcggaggagagtgttttgtggtgcatggctagagctagggctctccatgaactcctttgtcggtctctccatgaacaccactatcactggacgtccaggagaagcacggggcagtcaagcgctacaccttcccatgctgcatggcatcatcatatgggcaaggttttcaccgctaatctatcctcctgcccttctcttgttaggaattacatgccgcgaagcctgacattctcactggatgtcaacgttctcctgttctgattatgaatagacacgcgggcgcgtgaccacaaacactccacacacacacacacacacacaatcatagaatttactgtgaggtgagcaaaatcgataaaaatcaagggaaaaaataattgtttgtaaatatcactcttccgttccttatcaagcacgggcagcggttggttgtttttatgaggcggccaaatttgtgcttccacttttgtttcccaactctagagagatcagctaaaggacccccatgtaggaactaatattttctcttgattaaacaacttttatcttgagtaaacacggtgctaaatgaagaaagatcttggggttcgtatagtgggtccttgtgatatgaaggaaccgaagagacagcaccatcctgatgcggaggaggaaacctttcactcttgctttccgcatttgcatgtgttattagtcttcttttttttatatttatttggaagcatcggaacggtcgcattttcaacaacgccatgcataatgtcaattttgttttgaaagcattggcgagggagagtgttttgtggtgcttggctagagctagggctctccatgaactcctttgtcggtctctcgatgaacatcgctatcactggacgtctaggagaagcacgggacagtcaagcgctacacctttcccacgccgcatggcatcatcatatgggcgaggttgttcaccactaatctaccctcccacccttctcttgttaggaattccatcccgcgaagccagacattctcactggatgtcagcgtgcttctgttccgattatcaatagacacacgggcatgtgaccacaaacactccacacacacacacacacacacacacacaaaatcatagaatttactgtgcagtgagcaaaatcgataaaaaccaaggcaaaaaatcattgttcgtaaacatcactcttctgttccttatcaagcatgggcagtggttggttgttttgatgagcggccaaatttgtgcttccactttactaacaaccaaatttggtaacattggcatcggaaaagaagattagatcgaagtggagttgaaggcggagatcgattcaggaacaaagcaggaatcggctagagtccagatcgactacgattaggatcggctgagtctgagtcggactaggtgggctgatgcagccgattccgacaatacaacttggtgtatgacatcgggttgaattgaggtgcttcgagatgattaccgcacatggatagagtcctgagaaggcaattgtatctattaattaggatattttatgtaatttccttagagatatgcttgggcaaaagtctgccgcaaagacttatggtattttagagtttgttagagataatagtcgtgtccggtatggacatatcttgtaattctcgggtataaataagaccccgagccctatgtaatttctaacacacacgttcaatacaatttcggcgcatcgccacctttttgcttttgttttatttcgacgagttattgctttcgggttgagctgcatcggtttcgatcttcaacaagaggtaaaacttgttatgacaatttgcgctctcgggattagaggttccatctttatgacactctaa

SEQ ID NO: 20841 - DNA, 8305 bp, Oryza sativa
ttgtcagtagaggtttcgttgcagctttagaagcgaagcccactctaattgatcaagttagagaagcccaaattaatgatcctgatattcaagagatcaagaagaatatgaggagagggaaagctatcggtttcttgaaagatgagcaaggaactgtatggttgggcgagagaatctgtgtccccgacaacaaagatttaaaagatgcaattctaaaggaagcccatgataccttatactccattcaccctggtagtactaagatgtaccaggatctcaatgaaggattttggtgggcaagtatgaagcgtgaaatcgcagagtacgtagcagtatgtgatgtttgtcagcgagtcaaggcagaacatcagaaacccgccggtttgttgcagcctttgaagattcctgaatggaaatgggaggaaattggtatggatttcatcactggtctacccagaacgtcatcaggccatgactctatttgggtgatagtcgacagacttaccaaagtggctcatttcattccggtaaagacaacctattccggaagtcggttggcggaattgtatatggcaagaattgtgtgtttgcatggcgtccctaagaaaatagtgtctgattgaggcagtcagtttacttcaaatttttggaagaagcttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcagaattttcgtacaacaacagttatcaagctagtcttcagatggctccgtacgaagcactgtatggtcggaagtgccgcactccgcttttgtgggatcaaacgggagaacgtcaggttttcgggacggatatcctgagggaagcagaagaaaaggtgaaaatcattcaagaaaggttgcgtgtggcccagtctcgtcataagagttatgccgacaatcgtcgtagagatctaagttttggcgaaggagattatgtgtatcttcgtatcacgccttttcgaggagttcatcgttttcacaccaaagaaaaattggcaccgcgttttgtgggaccttataagattgtcaatagaagaggagaggttgcttatcagttggagttacctcaatctttggcaggagtccataatgtgttccatgtttcgcaattgaaaaagtgtttaagggtacctaccgaggaaactaatcttgaacagatagaagtccaagaggatctgacctatattgagaaaccaatccgtattttggaaatagatgagagaagaaccagaaatcgagttatccgtttttgcaatgttcaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctaaaaatcctaaatatataaattgttgtttaattggaattattagaatttattttaaaagtctagaagagaagatctaattttaattaataaattccaatataaaatggggccagataaaatttcattaaatactttgcttaattctataattcctagatttttctgggatttatttgagctaaggaagtatttttaataaatggaattgcatttcaagaataatttaaattgaaaaaggtttttaaaagtctcttttggctttgggccgaaagtcggcccaaaaccttctctctctccctcggcccaagtcggcccagtccgccgctagcgcgtgccctcgctcgctgacaggtggggtccgcctgacagtcttcgtctacctccggccgccgccgcccgaaaccctagcgccgcgccgccgccgtctccttccaaattcggccgcccctttccttctccggtgaaatcaattgaggggaattgtttcccgagatctcctctaccttttctcttttggaatcatcgtctaaatcgctttggaaattcatggattcgagtttgattcggattcatttttcccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagcgtcgccgtcgtcgccgtcgctccagccgtgcttcgtcgtcgctccagccgtcgccgtcgctcggggaggtcgccatcgtggtcgccaagtcgtcgccgtccttgtccgccccttcgtcgtcgccgaagaccgccggagcaccgtcgccgccgtcgacccgatcttctccgccgcttcgacctcgtcgccgtcgccgtccgttgatcttccgccgccgttttggtcaccagtgagttcgtcgcgtcgcgctctacgtcctggtgcctttcgttcgtgccgaagcatcatcgttcgccagcgagcgtgcgccgtccgagccgccgagccgcctccggaggtgacgtcgccgctgacgtcatcggggccgtttgccgtgagccgccgtagacccgatcgatctcggccgtccgttttggatggatcgatctcggccgttcgttcccgtgaaccgctgccgtgcacccggtccaccgcaaaccctagccgctgacgcaataattcccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtattgttcatgcttgtttatgtgctgttttggtgattttgctcttttctgcttagattccgatgtttccggagagtctgttttcgcaggagaagaatttgaagagttccaaggccagcaaggcaagtcacacagatcccaaacaaccctttgagcatgttgatcccgattaaagctattgtttctattcaactattgcatttattttcgaatgtcattgggtggaattaacctattgtttgttatagcccttttgttcttgattactttattccttgataccttgggttattataacttgactagttgagctttatatattggttcagctagatattagatatgaatgcttagccatgcttagaaacattagcacactattgggataacttatgattcactattaattatttaataaggacttaatgatagttcacgatggtcaatcgtgattggttaattaattacttgccaattaaaacctgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggtttatggcggggcaccagactgagaagtggcggagataagcccacaggggtcactggggagtccatgccttgtttataagggggtgattatgatccaggaatggtgcgctgcggtggattgtgttatgcaaggggtattgtcacagctcctttccgaggtaccgtggtggtattaaggcacatggtgacatgatgtggggctatgtcttgtgggtacagtggtacacctctgatcagagtaaaactattcgaatagccgtacccgcggttatgggcgggtctaacaatgtctttcgtgatgagtctcacatctctcatcataataaaagatgcaataactggtaataatttgtttagctcctggtttggaatggtatattcctggtttggagatagatctgtacagccgggtatggttgttcagaatggttgggcctatacaacagggtatgttgtatagcgttggattaatattgtttaaacattacttaactgttttattaaattctcaaatgtttgctaaatgctgtttatgcaaatggaaccctattatgccatcctttgttatcctgtgcacttgcatatttgctgcgtggcttgctgagtatgtcatatactcaccttgcaatcgttcatcagaggaagagttctacaatgatgctgatggtgtggaggattaggtgtagccctggtcaagctgcctgtggagtggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccccttctcttttaattaaaccaaaataatggcacatgcacttcataatctcttttagtggttctcattcaaaatttattccagtgttattagtactgtacatctattattgtactaatggctcatttaccagcaaaagttctacaacattgttttatttaatcttgctgcaaggaaataaatttagcatgttgattttatgactttcttttatttcttttgaaacctgttattcaaaagcacaaaatttgtggccttgtttccaactgtttcaaattatcctgcaagtttggtttactttttttttctaactttattcaaattaatccaaaaacttgtgctattgattggataaatgtcttaactccctcctttcacttgtctttagatgccgcgctacaagcctgagtacttgtttggtgttgagggatttgtccaggagttgcgtacgatgtccattgccataggatttgggactgcccctttttatgcccagattcctcatgatcgtcatgaagagaagtgccgggtcaaagtcaccttaaacagtaatagcgaagatatcccctcagtgatgttcgaagctggaggaaaaaactacatccatgcatgtcagaaggtggcaaggatcgccataggagagctgcgcgatcgctacagtgatcagttggccgacaccgagtatcgctaccatcctcgccaaccacagggaagtgaccgtggcagctaccttgagactgaaggaattgagaatgatgctaccacatagcatttggttgagatgctgtgggctatggatgaaacccgtgcagagactgtgttagcagctcaagatcgtgaagatcggaatcgtggtaagatttgcaagctagaggacaaagtggatcatttggagaaggaactagccgccttgaagggagaagcaccaccgcagaaggccaggattcgtcttaccgcaaggaagagagctctatttgtccctcgctatcaattggcgccaaaggttcgtgtggtggaaaaagaagttaccccagccctagcagatcctccggtcgtcaacgtaagtgatgatgaagtagaagaatccaagcgcacccattccaaaatcgagtggggagccactcaagatgatgaagatgagccgaacgagccttcaatcaactccgatgcccggaagacctagagtgccttgtcaaaccgttgtcttagatcgttgtgttagtttgcttgttttaagtttggttgtgtgtgtctcgcatgtgattacatcagtggtgggatgtaagtgcatgcgttggtttgctttcgagtgttaggtagttggtgagtttagtggtgtgagagtcttcagtttgtaataatgaaactcacttaagatcaataaaagttaaattaattctctgtcctaagtagttttccccggtttctcttcttgtgctcctgttcatgccagatggtgctcactcgcagcaacgggaatggccccaacaacaacaacaataacaataacaacaacaatggagagaatcccacacttgcccaagtcctggctcaacaggcacagcttatgaacatgatgatgcagcaactccagaaccagcagaaccagggaaataaccatgcacctccccagaacaagttagccgaatttcttcgtgtgaggccgcccattttctccagtaccactaatcctgttgaagctggtgattggctgcatgtcatagagaagaagttggatttgcttcagtgcactgatcaggagaaggtctcatttgcatcacaccagttgcatggccctgcctctgaatggtgggatcacttccgcctgcatcggactactgctgaacctatcacttggcttgaattcaccgctgctttccggaagacgcatataccatcgggagtggtgtctctcaaaaagagggaattcaggtcgctcactcaggggtctcgctctgttacggagtatctgcacgagttcaatcgtctggctcattatgctccggaagaggtacgcactgatgaagagcgctaggagaagttcttggaaggacttaatgatgagctttcttatccacttatgactggagattgtcctgatttccagaagttagtggataaggctattcgccaggaggacaagtacaaccgcatggagcaaaagaaacgccggattgctcaattcaagacacaacaggggaataatcaaaagccgcgtcttactttaggaccccagtccatgccacagggaggttcttcgtctgttgttcgtccgcagcgtcagttcttcaacaacaatgccggcaacaacatccgtaatcaagctccatgccctgttgcagcctcgacacagcaacaacctgccaagagggagcaaggcagcaagcccgtggtgtgtttcaactgtggagacccaggacattacgctgacaagtgtccgaagccccgacgtgtgaaggttgtccctacccagggcaactctaccgcaccagcatcaaaggcccgtgtcaatcatgttgctgctgcagaagctcaagatgctccagatgtgattttgggtacgtttcttgttaacttagttcctgcaacagtgcttttcgattctggtgctacacattcattcttatctatgagttttgcgggaaatcatgggatggaagtagaagatcttagacgtcctatgatggttagtaccccaagtaatcaggcactctctttgcaacgtagcccctctgtcagaatagaaattcaaggcgtaccatttctggccaatcttatcctattagaatccaaagaccttgatgtcatcctagggatggactggttagccagatataaaggtgtgatagactgtgctaacagaaaagtaactctcaccagcaatgatggtcgagttgtaactgtttatgcattgtcttctgagtcttaaggtcaagactaaaccaaataactttggaagagattcctatagtccgggagttcctatgtgttcccagatgatttacctggtatgcctcctaaaagggatatagagttcagaatagatttggtaccaggaacaactccaatccataagagaccttatagaatggcagccaatgagttggcagaagtcaagaggcaagtggacgatttgcttcggaaagggtacatcagaccgagttcatctccatggggagctccagttatctttgtggaaaagaaagatcatacccaaaggatgtgtgtggactatcgtgcactaaatgatgtgactatcaagaataagtacccgctacccagaattgatgatttgtttgatcagcttaaaggtgccactattttctccaagatagatcttcgatcagggtatcactagttgagaatcaaagaggaagatatacctaaaacagcttttaccactaggtatgggttgtttgaatgtactgttatgtcttttggacttaccaatgcccccgctttcttcatgaacttgatgaataaggtgtttatggaatacctagacaagttcgtggtggtctttattgatgacattcttatctactcctgaaccaaagaagagcatgaacaacatcttcgccttgcactggagaagctgcgagaacatcaactgtatgctaagtttagcaagtgtgaattttggttgtccgaagtgaagttccttggtcacgtcatctcagcaggaggagttgccgtcgatcctagtaatgtggaatccgta

SEQ ID NO: 20842 - DNA, 12625 bp, Oryza sativa
attaatattgtttaaatattacttaactgttttattaaattctcaaatgtttgctaaatgctgtttatgcaaatggaaccctattatgccatcctttgttatcctgtgcacttgcatatttgctgcgtggcttgctgagtatgtcatatactcaccttgcaatcgttcatcagaggaagagttctacaatgatgctgatggtgtggaggattaggtgtagccctggtcaagctgcctgtggagtggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatagaaattccgggcgtgacaggtactgtcaaggaaacaatccagaagttaggttttactgacgtcaatgaaggaaacgtcatgcctatcgatccagaaaagttcacacctgatcaaaagaaagattttgatgcggtgatgcagcaagcacgggatcagttcttgaactcgttcatgcagacccgaaagggaacacttgttcagaagtataaactaaaagtgtttcctgatgaccccaggactagttcttccaatgatggagaagggaaacaagctccagatggcttggctcaaccgagtgacaagaatgccacagagggttttttagcaaatcaaggtgacaacttgccaggagtgcacggggttcaaggtgatgggtctcagggtgttcaaggtggaggtgttaatcaagacagtaatacagcacagttgcagtttaacaactttcaagatcaggttgactatgatgtacaccatgctttgatcaaccaatctgggatattaactaacattttggcaaatatggtgaagtcaatggttgatggttcaatggccgagtatcaagctacaggaccagtatacctaccaggaggagtgttccccaattatcagccattaatcactaataatcaaccagttgtccagtcaattcctctcaatgcaccatcggctcagccgacggcaccagcatcgactccagcacctgctgcgccaccttcggctccaggacaattagttaatccccagttgttggtaagagaacaaccacaacacgctggacagaatgtgaatcggctaacgcaagaccaggttgcatctatgttcttgcaccctcaacacactattgatccaacccagcagcagccgattcaacacaccccgtcaaggcaacaagttgtgcaaccaattcaacaaacgcccccggtccaacaggttgtgcaaccagttcaacagacaccaccaagacagcagatcttgcagccgattcagcagacgccactaaggcaacaggtcgttcagccgattcagcagcaaggtccgatgaatgcatcggctgggtctgcaatacctggtggtcagcccgtgcagcatgttgcaaatcaggttgttctagaacacttggttcatcacgtacaaccagatggcacagtaattcctcaagttattcctgagcatttggtgcgcaatattcaaccagatatccaaaattaccaggggggtaatttgaattatcaatatcagccaccatcacctcatattcagaaccagcaagcaggatcggtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcctaatttttaatcttacaaagagcatttcagtaattaaccacatattaaattaatcattaaatggtctaattgtaattttattaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaatttagttgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatatccggcgaggtcgccatcttggtccggccattgatgatgtcatcatcgtttttctttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccagtttgcattgattaccctattccttgataccttgggttattataacttgactagttgggctttatatattggttcagctagatattagttatgattgcttagccatgcttagaaacattagcacactattggaataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaatagttatggatgttataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactatttgctaaatgctgctttcgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaatcggctcaaccccaatttgttcctcaatacaaccaattcgagcctatgccacaacaacctcaaggggcacctcaacagcgaccatgggccgatttgattgcagatgtcatgaaggaacagtttgggcttaggccgaaagatgctggaaatctatatcgacagccatatcctgagtggttcgagagagttcctctacctaatcggttcaaagttccggatttttcaaagttttcagggcaagatagtacatcaacttatgagcacattagccgatttttagctcaatgcggtgaagcatcggccgtgaatgctttgagggttagattattccggttgtctttgtcttgattggcctttacttggttttcttctctaccatatggaacaatcaacagttggactgatttagaaaaacagtttcacagctacttttatagtggggttcacgagatgaaactgtccgatctgacatcgatcaagcaaaaacatgatgagccggtacatgagtacattcagagattcagagagatgaggaataagtgttacagcttaagtctgactgatgcccaattagccgatttggcttttcagggtatgattgctccaatcagggagaaattctcgtcggaagattttgaaagcttgtctcatctcacacagaaggtgatattgcatgagcaaaggtttgcagaggcgaggaggaattccaagaaaattaaccacgtctgcccttatatgtatgggtcagacaatgaagatgatgattctgaagtagctacagctgaatgggtgagaagtaaaaaggttataccatgctaatgggtaaagagctcaggaaaagaggagaggtatgactttaatatcactaaagatgacaagatttttgacttgttgctccgagagaagcaaattcaacttcctgctggtcacacaattccatcgactgaggaattaggcaagaaaaggtatttcaagtggcacaattctgggtctcatactactaatgattgcaaggtgttcaggcagcagatccaagctgctattgagggaggcaaaatcaagtttgatgactacaagaggccgatgaaaattgatggcaatccttttcctattaatatggtacatacagctggccgaacagccgataggggccgtgcaaggggttttcaggtaaattcggctaagattatcaacaaatatcagaagaagtacgacaagcagcaggagaagcattatgaagaagatgacggtggctttgatcctcattggggttgtgagttctttagattctgttggaataaaggtatgaggctaccatctattgaagactgtcctgggtgcagtggtattgccgagagctcaagccgatcatatagtaggggcaatcggttaaggcagacaagagttcctgttcaacaaagattgggtccagtgaatcaagatcatggccaagaggacaatgaaaataggaaaagtcaatggtgtccttctggtatctttacgaagaatcaaaagagaagggttcaaagattgaggaacagggagcgctttcaggaggtcgagtaggaaattaaccaacggctgaagaagacaaagtcgaggcaagagtggcgtgtcaagaatcaaattcctgtagctgatgaagccgcagccgatgaggcgaaaaggttggctaaagggaaaagtgttgtaactgctttggttaacatggttttcacattgtctgccgagtttggggtcaagcacgatgaagttgaagaagaatcgggctaaattgattttgtcaccggagcaggcaatttttgagaagccagaggggacagagaatcggcatcttaaaccattgtatataaatggttatgtcaatgggaagccgatgtccaagatgatggtcgatggtggggctgcagtgaatttgatgccttatgctactttcagaaagttgggcaggaacgctgaggatctcatcaagacaaacatggtactcaaggacttcagtggcaatccatcaaagaccaagggagttttgaatgtggagctgacggtcggcaacaaaaccatccctacaacattctttgtcatcgatgggaagggttcttatagtttgttgctcggtattatcggatggcttgtcatggatcgatccaagtccccccttacaacttgtttatggacatgaggctgttttgccatgggaagttagaatcggctcaaggagaactgagttgcaagatgatttaacagccgatgagtattataaccttatggctgatgaaagggaagacttggttcagtctaaattaagagcccttgcaaaggttactagggataaggagcgaattactcaacactataacaagaaagtggtacccaaggatttttcggaaggtgaacttgtatggaagttgattttgccgattgggacccgggatagcaaattcggcaagtggtcgccgaattgggaaggaccgttccagattcataaagtagtgtctaaaggggcttacatgctgcaaggactcaatggtgaagtttatggaagagcattgaatagcaaatacttgaagaaatattacccaagtatctgggttaatgcatgattggctgatgttgccgatacatgatagccgatgtattttcatcgtcttgagatggccgatattgttatatcgcccttagttgttttttcatattgtactcggatgtggtttgccgatatacaatggccgatattgttatattgcccttagttgtttttataattttatcaatgcttttgacattgtaaaattaggggagcatatatatatattcaaaaagacaataaagtatgagagtatcttagccgattacagcaatttctaaggcttattacacagaaagtcaaaatttctaaggcttattatacagaaagtcattgagataagtatcgctggatagccgaaatagccctttgcttatatttgttctacttcaatagcttgggcatcttgagcatcggttccagggatgactttcaaacatttggtcaaatctgtaacattcttgatagccaatttgagtttggctttttgttcttcgatagacattgggaaatcggctaactttttctgttccatatctagctcggtgttgcattcttcaagttgtgccaagagctcaatcttgcgagcttcgagccgatcaatattggatttgatcggacccttagatagttgatcaagtttggtcttctcttcatgcacaagctgccgattggcttggattgtggcctcgatatccttgcgctcccgacgttcggctagtcttagcttggccttctccagcttgaactgatgttgctcaaggtatactactggagtaaggatatcggctagctcatctgggattagagcttggatttcatgtagtcgagtcctaattggcccacagtttaccaccagactatctaatgatgatgcttccagccgatgagagatatcttcaagtgttttcttcacatcatcggataagggagctaaagctttgcttgaagtatcttcctctgcctcattaagataatctctgatgtcaaaagaaaagagatcggctaaaacctgcagacaatttcaggaagattgagagttaggtaggtacagccgatctaaattcttgcatcaaaggaaaacttactgggatagcaggagcagctggttgttattcttccacaatatgatgactccccacagccgatggagttcggtcactcgatgattgttgtacaggggaagaaggaggaggaggaggctgtaaaagagacaagtgttagacaaaatcggctggaatcaactagtagaattgagagtgtcttactagtgaagctggtttgagaattggtgctgccgatttcttctttacagcagttttcttcttctgcagctacaaagtctatgagtaatcggctgaaaagtaataattataaaaggggatgcaaagaaagcggcttactcttaagatgtgagtgggggcagaaagagttggaggtgtctgcttaggcgaagccaatggcgtttttttagtatcgcttacttcggctgcagcctgatcaacatcatcctcaatatcttcttcatccagagcttgttcaatggatggatccaaggcaggcaggtcgtcggttggcttgattttcctagacttggcctttttctttggagctagaatcaaagtgctcacagccgatgatctagtttttcttttcttggttgcatcagttggttccctgattgcgccttgaaggagggttgagaccttgggggcatgatagccaatgacagtgggagacagtccgcctccattaggaatcagacctggagcatattcaatatctctgccgctgttgctctgatgtggaggagaagagtcgattgtctgtaaaacagaagaaaaattgatcaagtaatgaatcggctgacaatcatccaaaatttaaatgacaaagtttaccttgggtacgacatcagggaatagatctgtcatgtacattgaggccgattgatgaaacaagtgcaacttccattcgccccaccatctgtcaaagtttctgcttttaaatccggccaactcaatattgttaatactacctagaggaggtccttggaggttaagcagccgatccatcattagagttgaagaaatttctcctcggcaatggatcttgtcagcaaagaataagccgattggaagttggcctaatccaagttgtcgagctgaactcatagggtgatagaattcgtaggagacttggatatttcttccttagtggatgccaacaggtaagatgcatgggctaattgcagctgtaaagacttccctggatatttgatatctttcatggttgatatcttcaaatctaaagtctgatgggagctcaaggtttgctgagtcttcataaggaaaccaaactcgggcatctttctggaagccttcataaaagctgcagaaccagtctttgagcagctcggccgatagttttgccccagattagggttgaaagatatccaagagatggccaagacttgaaagtattcttctagtgacccagattagggttggctaatctaaaggggattctgttggtttcaccgatgatgaaatcagtggggtcaagattgccgattggaccaagaaagtagtggttttcgtgtgacaggctgggaattgcgattaggttggaaaagtgctgcacatccaagggaattgggaagaagaaaacacggtgaaaagggggaaatcgatttcatacgaagaaaggggatctagccgatgagaacttacctcggcatactcggccgatggcgcgacagatgagctggcggaagatgacattgctgcgggcggagatttgatcgagaatgaaatcgcctgggagtcgcctcgagcatcgaaggagtcgccgaagaaagagaaggcaaggttggtttcagcggtgaaaacggaagtaacggggtgaagatttttcagggcggcggttagtatttaaagcgttggggataacggtcagaaaacggcagattgcgaaactcgttcggggtcgatttatagcaaatccgaaacattaccaaatgttccggacttggggggcatgtgttaacaaccaaatttggtaacgttggcatcggaaaagaagattagatcgaagtggagttgaaggcggagatcgattcgggaacagagcaggaatcggctagagtccagatcgactacgattaggatcggctgagtctgagtcggactaggtgggctgatgcagccgattccgacaatacaacttggtgtatgacatcgggttgaattgaggtgcttcgagatgattaccgcacatggatagagtcctgagaaggcaattgtatctattaattaggatattttatgtaatttccttagagatatgcttgggcaaaagtctgccgcaaagacttatggtatattagagtttgttagagataatagtcgtgtccggtttggacatatcttgtaattctcgggtataaataagaccccgagccctatgtaatttctaacacacacgttcaatacaatttcggcgcatcgccacctttttgcttttgttttatttcgacgagttattgctttcgggttgagctgcatcggtttcgatcttcaacaagaggtaaaacttgttatgacggtttgcattctcgggattagtgcttccatctttatgacactctaatcttgtttacgtaattcgtcgagttatcatatatcttacataatctctagcaatattgccatctaacccacaatcggctaacatctgttaaaagagggcagccggttaggttaaatatcgatattggtttagattatataagatatataccactctatgaaatgtccagcggcttgattgtctagatattgttcttcttttcatacttaatgctgcatcagttgagtttgatctattaagtcgtgcttagaatatcaatctgtagcgcccgttccgtcgtggcgcctagcgggaaaattatctcttaaaaaccctaattgcgaaatttgtttctttgcttgttgtctagtgcccgtgccatctcaagatctcaaatccccgatctatcgtcgagttcaatcccgaatccaaatccttccaaatcaaattcctccgcaaagtctattttgcctcccccggggtcgatgggccgaatttctctcggcccatctccccctcttccccggccctctccccccggcgtgctccctctctccctctccccctccgctccgcccgcgcgctgcgcgcgcgagcgcgtgagccgccgcgccgagcgcctccctccccctccgctctgcccgcgcgcgagcgcgtgagccgcccgcgccgagccgagccctcctttccgctccctcgctgccgctccccgcgcgtcgttcgcgcgcgcgcccgcgtggtcgtcgcccgcgtcgcgactgcgccgcccggccccgctgccctgccgcgcctgcagccgctcggccccgcagccagcgcgcgtgcccgagccgcaccactccatccgccgcgcctcgtgttgcaagccgcgcgcgcgtgccgagtggccaaccgcctggtagccgccgtcgtcagcgcctgcccgccgtcgtcagcgcctgcccgcgcctatcgcccgtgtcgccgctccgctccacaccgccctgccgtcatcgccgtcgtcatcgcctcggccccgccaccccgcgtgcaagccgccaagggacggaggcagagccctcctccctctgccgtgacacccccactcccctcctccttttcccaaagaagaaaggggcgagccccccttcccatccctccttttccccttttcctcccgccggcgtcatcctccctccgccctgtcgccgattggacgcgagcgccgagcgccagctcgcgccttgaccgcccaagtcggttccaaaccgacattgccgcccttaaagcccaggcaccctccctctcttctccttccatcgccattgttgccgccgccttccgagctctgtctcgcctccgccgttcatcgccaagcgccgggagagcctgtgcgtttgtggacgcggaaggggactccgggcgctcgtctttctcctcttccccggcccgaggccggagagattactcccgcgccgtcggcctctcgtcacagcgcccctcctcatctcggtagtgcctccctccgttcttcctcctcgctccatctctcccccttagttttcagtagtagctcgagtagcctccccgtaactagccggcgccgccccgaccgttgccgtcgctcgccgtgtgctcgccgccatcgccgcccgagctccgtagcaccgctcgtcgccggcctcgctcggcgtagctccgcccaatccgatgctaacaacggattcccgtggccgcatagatgctctcaccgccgggaattggcccctcgtgacctcgtcgccgtttccccctttgccttccgccggttgccgctgccaaaatccgcc

SEQ ID NO: 20843 - DNA, 6181 bp, Oryza sativa
gcgcgttccaccgcgagccatgaggctgcgcgtgggcccgccgcatccgttcctccgcgaaccacgcgcgtgcaccgcgtccctcccccgcccgcgcgcgtgcaccgcgtgctcgctccgcacggtgaaccgtgtcaccgacaagcgggtcccacccgggaccactcgtggtgagcccggtccaccggcgctctctctctcctcccctcccgcgcgcgcgcgtcttgggccgccttgggccggccagcccatttagctcggccggaccgctccatttctcttgggccacgccctagccgcccgagaaaagtctatattccctccctcttttcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaaaccacctttgaacatcttgagcctatatttgaatttaattatgttgcttgaaaaatattatgcattgataggatcgcacttaatctgtttgtcccgtctgcaaggcagattggcggacctacctagcttgttgcatttgatccttcctctgttaattgtcataccatgttcccttgtaaccacccagttgcgcctcggaaatcgtgcactctgcacgagtatcgacggtcgccttcaaacttaaaatctgaaaaacatcttgggtaaaacttgggttttacaaaagacttggaaaacccgacacctgggacggtgcttgcgaactaaatgaatttccaaaaccgcggaccggggaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccaagagacatgtggattcgccggggtggtgtcggggaggacccctgggcttcctggcacagtatggtctgggacctaacctgttgttggtctgggatccctctcgtcggcatatggtaaacctgtgtcggctttggaaataccttgtcatgaaagcttggaggtctcccgacgtggctgatccccacgggctgggtgatccgggttagtaatgtcgtgtgggtaaagtgtaccccctctgcagaggttaacaaactgttcgaatagccgtgcccacggtcatgggcggatgtgaggtgattcctagcgtagttttgttcgactactgcttgtgaaattgctgttgtggaaaggggttcgatgtttgaaaaaccagcagctgacgggatcagctaggcccgggtggccgtttgaaagttgttggcccgggtggccgtttgaaagttgttggcccgggtggccgtttgaaagttgttggccgggtgccaatctggatcaattctaaagactgatacattgcacatactccgaccggacgagacgcactgtctcatccacgtcgtttgagaagcactcacttagttgtttttagaaaagggttcaaataaaatcaattgcaaaaacaacagcctttccttgaagcctgcattaaacacttatttcccatggcttgctgagtactcccgtactcacccttgctctatataaataattccccccccagttgctgaagaagatgaagcggaacctgctgatgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgttgtgatattctgtctccctgtgataccagcactgtttcctgggactggtatcgattaacaggttaatttggagcgtcacgggctagttccagtcgggactagttcggggcgtgacacaatctctagcctgccttctggttgccaattagggtagcatcggagtttcagccgatcttatctgatttaactatatttgctctatatgcttcattgacatgttaaatctgccctttatatcaagatattgtcgcatctaagtatattaagcttttgtttgatatattatacatgttttaatatcctgatatagagtagtatcggagtattagccgatacatgctaaatctatctgatcggctatgctataaacatatatagtcctgttattaatatatattctgatctaagtgatttatactgtctcggcatggcgaccgatctatcccaatcacttgatttaagtatatatcgatataagagttatatattggtaatatctacagccgatcgagtagatttagttctttattatctacttataactgccgatcgattcacatatgacatcggctcaaagataaatgatatgccatcggcacatagccgatcggctatcgtttatagatttaaccgcggtttctttgtctttatttcttgttgattgcaggatcaaatcaactggcacgctaacacacacgaaggcaagctttggacctgcactggagttaagcagatctcccaggcctcgtgtttttcatcaacacacttttgtttcccaactctagagagatcagctaaaggactcccatgtaggaatagagcttttctcttgagtaaacacagtgctaaatggagaaagatcttggggttcgtatagtgggtccatgtgatatgaatgaaccaaagagaccacaccatcctgatgcggaggaggtagattttcactcttgcttttcacatttgcatgtgttattaatcttctttttttatatatttatttggaagcatcggaatgatcgcattttcaacaacgccatgcctaatgtaaatgttgttttggcggggctagagtgttttctggtgcatggctagagctagggttctccatgaactcctttgtcggtctctccatgaacaccgctatcattgggcgtcccagagaagcacggggcagtcaagcgctacaccttcccacgctgcatggcatcatcatatgggtgaggttttcaccgctaatctatcctcctgcccttctcatcatatgcggcacgatacacatcaatgcttggaacatggaggccatggcggtgtccatgtacattgctatcattatgaacattcaggagaagcacgggagggcagtcaagcactgcaccttcctcacgcttaatggcatcatcatatgggtaaggtcattcactgtcgatcggtcctcctggccttccctcattaggaatcccatgccgtagagcccgatattgtcactggatgtcaaggtgctcctgctccgatcgccgatacacatgcgggcacgcgaccacatacactccaacacacacacacacaatcatagttttttatgcggtgagcaaaatcgataaaaatcaattccaaaaatcatttgattttgttttagcaaaatcttgaatctaaaaccacttcttattcccctcaaatatttagtacaagcaaatgtgtctacatgttctcatagtacaagccaagcactagtaggcatgtggccacccaaatatcttctagccagaagctctcacaaaaaccaatccccttctagctagtgaggcacatcaacatcgtgttgtgagagtttgtcgggtgctcgtcatcactaagcgctcacgatacacatcaatgcttagaacgtagaggctatggtggtggccatgtgcactgctatcactatggacgtctaggagaagcacgcgaggcacgtcaagcgctacaccttcctcacgctacatggcatcatcatatgggcaaggtagtttgccgttgatctatcctcctaccattccctcgtcaggaattccatgtcgtggagcccgacattgtcactggatgtcaaggtgcttttgtttcggctgccaacacacatgctagcacgtgaccacacacgcacgcgcgcgcgcgcacacacacacaaaatcatagggtttattatgccgtgagcaaaattgataaaaaaaataagtccaaaaaatcatttgacttttgtttagcaaaatctttagtctaaaatcacttctggtttccctcatatggcataattcaatcctccaattatttaccaccagcagatgtgtctgcatcttctcacagtagcactagtagtcatgtagccttccaaaaatcttgtacctagctagaagctttcaaaaaacctgatccccttctaactagtgcagcacaactccatcatgttgtccgaattcgtcaggtgcttatcatcgctaagcagctcgatacacgtcaatgctcggaacgtggaggccatgtacaccgctatcactatggtcgtccaggagatgcacgcgaggcacgtcaagcattacaacttcctcatgttgcatggcctaatcatatgggcaagggcgttcttacctcctggccttccctcatcggggattgcacaccacggagcccggcacagtagctttaggtcaagatgctcctgctccaatcaccgacacgcatgtgggcgttcgaccatacacacacagagagaaacacacaatcatagagttgattgcaataatacttatttcgttttgtgtgccggggaggagggtcccaacccctcctcccgaacgccagccttagttctatttagcacaactctcgcggttctaggtttatgctgaatttaaagtatggcacaacacaatcgtagagtattttgtagtaatacatttttgtttttaaaaaatagattaatatgattttttttaaaaaaaacaactttaacggaccgtttagtagttcgatcggatggccccgcacatgtgtcgctcgatcggacgatccgcacatgcgtcgcgggcttgagtgggatacggccgttggatcaaatgtggacggccagatctgtgacaactgcagactgtgccgtagccacacccaaacccgcgccaccgccgccgccgtgggagcagctcgaccgttcgaggaggcggcgatggagcacgggacagtggaggactcgagcgcgtcgacgttctccatcgcggaggaggaacacaccctcgccaaccccgccagattcgtcctcaaccaggagtgagagttcttgtgtaccctttgtttcttgtcccctttgttttttccttttatttttcctgtgtcccctttgttggtttccgtgaaattcgatcgtatttccggccaacattttgaatttgtgcggtagatgaatctgtggttagagccctaggagaggaggcaaaaacttggttctagcttctatcaatcttggggtttacagtggaagagaggagagatgtggatttgttaggcaattagatcgattttattttagtgagtaaaccgattggctgtagcagttgaatctccagttatcgataggaattctgatgaaattaagtgggcaagattttgttttgggtttttggagaatgagggcattgtgagtgttgaaaatggtgaagcctactttttttttgttaactaagtaaaattacaaagatagggagaaatatttgtggggtaatgttgcaaacaaccatcttgacctgttgatattagtgtcagttgatagggttgtctattggatcacctaggtttagatctagtcgggtggttctatttgcaatggatgaacaacaatagatgaatgaacaaagagggagtgagaggatttagggttgtgaccagtcgttgttgaggaagaggaagtccggccggccatcgtcgttgtcgtcgcgggcttgacgtggacggcggcgacgatgtgctcggttccgatggcggtgatgtggttgcagcagcgacggtgtcgacgacgaggcgtggcgcggcggtggacttcccgtcactggctgcgccccctcgatcggttagggtttatggggtgga

SEQ ID NO: 20844 - DNA, 3979 bp, Oryza sativa
cacccctctttatatggcacagtgtgacgggggcccaccagccattgggctgggcgcccccgatcagggcgcgggtcaaggcccccttgagccgttgggctcaaggggagggagatccatctaacattctcccccttgatctcactatttcctttagctttttctattccatcacagatttacatatagagcatgtttcatcatcacggttaattaccgatggattcgacagccactatacgcttctagtattcagaaacagatactttaacttttgggccctatagtccaggattcataaggcttcccttaaaacccatgcatgctacatgttccttgaacatgttgggaggtaggcctttcatgagcggatccgcgagcatcctttctgttcttatgtgctcgagactgattgtttgatcccggactttgtctttcacaacatagtactttatgtcaatgtgtttggcagcaccacttgactaattgttgtgagagtacattactgtgggttctttatcgcattataactttagtggtttctcaatactatcaaccacctttaaaaccgggtatgaacttcattagccagttcacctgccccgtagcctcatggcatgctataaactcggcatacatggtagaccctgcagtggtagtctgttttgagcttttccatgaaatagctcctactgccagggtaaacatgtatcccgatgttaactttgtattatcttttgcaaagtcagaattcgaataccccactatgtggagcgattctgattttctgtaagacagcatgaggcttttgttctttgcaaataatctttactaattccagtgctctaggcctggattactttgcaatctgccaaataacccggtaacaaatgccaagtcaggtcgtgtgcacacttgagcgtactgtaggcttcctacagttgacgcatatggctttattttcatttcattgagctcatactgatttctaggacattgtgatgccccatacttttcgcctttgactataggagcaggtgtagcactgcatatgtacatattgaatttcttcaacaccttttctatatatatgccttttgagaaaatcccaatgcatactttgttctatttcggtgaatctctatgcccaaaacatatgaagcctcaccgaggtctttcatgtcaaagtttgaggacaagaatttctttatttcctgcagtagattgacatcactactagccagtagaacgtcatctacatacagaattaggaaaatgagtctcccattcttaactttgaatcaatacagttgtcctctacattctcttgaaaacccaaatttctttattgttccatcaaacttcaagtagcattgtctcgaagctttgcttttaacccataaatggatctctttatacggcatcccatattttcgtttcatttcatgacgaaacctttcggttgtgccatgtatactttttttcttcaaatcaccatttagaaattccgtttttacatccatctgatgtaattccaaatcataatgtgccactagtgccattataatcataaaggaatctttacaagagactggagaaaagtctcattgtaatcaatgccttctctttgcgtgaaaacttttgccacaagtcgcactttaaacttttctatattccctctggagtcatatttggttttgtagacccatttacagcctactgttttggctcctttaggaatttcttctaaatcccagacatcatttaatttcattgatttcatttcatctttcatggcttctcatggcctcttcatatgagatgggatcatcctccatatgcgactctttcaggccttctaggggcctcctattctggcacattatctgtttgaggctgttgcagctcctcctctgatgtggcaataatttctgttgaatcctgtagaacaggttcctcactttcattcattgttgccacaggagagataacaacaggtgttggtaccgcaacggcatgcattgctggcacaacattagcaggtagagagaagaaaggttcctgagtcgacggagcgggtacagacacccgcctctcctcaagatcaatttctcgaattaccgagctccccctaatcatttcgtctttcaagaagacggcgtgtctcgtttctacaaactttgtataactgtttggacagtagaaacgatgaccctttgatcttttagaatagccaataaaatggcagcttactgttttgggttaaatactttatcctttgcaggacttccccacacacggaggatccatagctcatacggtgttttgggcaccgatgcattctatacattgtatgcatcgttctaaaactgagaactccaatggaggaagaactacattcttaaccagtctctcaattctccccctcgaaatatggcataaacaacagtgccataatttcgatgagacatcagaagttcgcttttcttttcttttgtcaacgaggacacaacattcacattctcagaaagagataacaaataaagctgatcttgcaacacaagaccaatacattcattattataccatagttcacatttgccatttcatatctatcagaatccaatttggatactcttattatcaagtttctttgcaaagaatggacataaaaacatctggaagtaaaagtgtgaagccattcgcgagttctaggcgaaaatctccaacagcttcaacttttgcttcaactccattggcaactctaatggatctttcacttctttgcgtagtcctcattgaacggaatccctttaaacaattacacacatgaatagttgctctagaataaatccaccatgtggatctagaataaccaatcataatgagattctttacaaatgtaataatgttctcacctttctttgccatgatcactgtcaggaagtcaggatgatctttcttggaatgtcttgtcttcttgcagtgtagacactgatcttgtctcaactgtaaactgttgtttctgaggcggatgctgaggctgtttttcttttgaggagggtgacctgtggctcttttccttgttatctttgacaaggttaatggagtcaccattggtctctttgtgtctttcctcctcttgcacacaattagagatgagctcttcaatattccaattctctgtacttattttgtagttgacaacaaggttgtcaaagttctttggcaatgaggacaaaaccagatggaccagaaagtcatctgagatgcccaaatctttttgcttcaatttggaagccatgttgctcatcctaagaatgtggtcttttacaccacctccatggtacctctctgtaacaagctgctttatcagctgtgtcgcataaaactttgaagaaccagtaaactggctctttatactttcgaggtatttagagacagtgtcatactctgggattgagcccaatatggttggctcaatcgtgttctttaccgcagccaaacaattcttgttagctgaagaccatttcgcatgctcaatgtcatacgacatgatgagggaagcattgtccctctctctctttttccattcagcatctgactctttttcacctctgaaaatttcagcaggttctataggacatggggtagtcaacacccagtccacctctcccaagataaaggcaaggtcgagttctcttttccattcttcgtagttatctcctttcagggtcggaatatctttaatgtaacccatcaaggagtagccacctgagataatcatgtattgtgagaacaaaattaacattaaaattattatgtattaagtctacatcaccgttgggcagaaaatagacataacacataaagccataactataacattgcaattatcaacgttggtcagaaaaattacaacatcatagcacataattaatgttcctaaaattaaaatctcccgttggttcgaaattta

SEQ ID NO: 20845 - DNA, 10317 bp, Oryza sativa
cctccacccctctttatatggcacagtgtgacgggggcccaccagccattgggctgggcgcccccgatcagggcgcgggtcaaggcccccttgagccgttgggctcaaggggagggagatccatctaacatcagtgtcaccatgtctatcttgcttttgcagcttgcatctcgtcattttttatgtatttgtatctccattatcatcatatccatgcccttcagattatatgtatggacttaagtaccctgagattagaaaaccagaaatcacaggcacatgtcaagtggaccagagcaaatttatttatttttttacgatactcattcttgtacaactttaaagtgaagttttgagatgtgttttagcaatcaaaaagccatattgtttcacttggaccatttggttgcgttgagttgaaaagattgtggaaggtctctcttgtgcttttgatgtgtacaaaagtattaatgaacatgaagattcttattttttctccttccggttctctttctgccattgcagcccaagggtagcgttttgtggatatggggtgtgtttggttgctcgtatccccctagcctggtccgtctctctcatcctggctgagtttgacctggctaagaggatacatatgcagctgtttagttgtttgcattagtctatctaggttggttgtttgcattagtctatctaggttggtatgagatcttgtttggttactcgtatgagaaatacggtttggaagggatcttttttggttggttgcactgatcgagtgtggttacctctttatttagctgggtaagattacctttacaatatatatataattatattgggtttttagttaacaattaaatattctcttacatatgcaaatgataatattagaagtgcaaaatcattgtcttctctatataaaataaaataagtcatcaactttacgagtttgtgataaaaaaaagaaaaaaaagtagatttttattaaggtagaccgcggtgtactaatctaccattagtagatactacagcgacttctttattacgaaagaaaaaagaaagcgaaaaaacgagagaggaaaaaggaaaggggatcggcgttgcgtcgtcgccttcagcaactctccgctcgccgccgccgatgcgcgcctgtcgctcccctccgcccgccgccggtgcgcccatcttcctgtcgctcccctccccctgctgctcgtcactcctcccatctccccgcgcttcttccctttgcccgtcgctcgctgcatcagatctggatcggaggctggtgacagaaggtgggagacgacggtggccggcgattgaaggtcgggggacggcgggaagaagaggagggatgcagcagcaagacggatccgcctaggggctcgtcgttgtggcccccgtcgagcttcgtcgcctttgagctgttcgctgctgcttcgccatgtccgtagcttcgttgctcgctgggagaatgaggagggggagaggggcagggtggtgaccccatcgcctgcccttgcaggcgcgggtgcggcgctgcacgcgcgggtgcatggcgttgcatcgcgcgggcctggctgagcagcgaagctcaaatcgagcgctcctgctcagcctggctcacggggcttttttgcatccactcggccaggctgggagctacgtgcaggcaaccaaacgaccacatagtgcatccacgcattcgagccaaggactatgcaggcaaccaaacacacctagcatccctcaccctgctgacaacaaagtcaacataagagttcagactacaggtaatttaaaatattatattatcctgatgtttttaatactgtaagatggactgaagttgttggtttcagacctttttttatcttgaatgcatattagattaatttgtgcaacttaatcaactaattaaattatgtttcctctcaaagtttgtcttttggcatttaatattgtttagattgtcacctaacatatattttcaaaatggtaaatagtcccattatcttgtatattttttcccacttgtggtatagataggtcttacatctaaatagaatgttatgggcatgtttctgttgaaagataattcgactaccaaaatggttagtaacttctaacatcgatattcatgtttgaaccaaaagttaaattcaaatagatgtatctcaaagaaatacttgtaccattatggtcgacttgatctcattgccttcttgatattttatggtttcactgcttttgtccctgaagaaagtgtgcgttctcttctgacgcgtttttatgttggcaggggatccagccattgatgtattcaaggatggtttacaggacttgatagtcatgtgccaacatgttagagggacttttgacaatgcagtggtagattttagatcaaaggtacctgctcagcaaatggacatagattcaaagtagaaatgaaatttccgtatgccctctgctccattgttttccatcagaactttgtgtaaccagttcattattggaacgttgattaggtgtgattcttggctataaggcgattttactagaaatctgctttgactgagttgtggaaagtcagtgctctgcttttcaatttttggaaaatcagtctatgtactaaaactagcctgacaatgtgaacagtaaaatgtttccgtggttgttgcttaaatacttgttccaaaatgcattatcatccattcatgtttcaggtaggaacatagagaattaagagaactttgctttcgttatgttctgctgtgaattatcctcaaacaggcattgcacctaatgataaaatgacacagcagttgacaggatttcacaaggaaattgcaaacattctcacatcatggtttggaacactgaacaacgctaatacttcatttgcactagcttattgaataacaatgttacaacacatacggtttctcaaggatgtggcacaatttcaaaacatctgtatgtaccagatgctgactagtgctccacattccattgataaaggcaagactaatccaaatatcgctaacataatgcatgatcacagggaacaggacggtaacaaattagaaccctagcatttcgaaaatggtacaacgatgcgataataaaagcatcaaactacaaagaaaaaccctaaacacctccgactggtcgagcatcaacaatggaagtgagctgaggatgaccgccaggtgcatattccaaaagaataaagatcagatccacagttattagcctttccagtgttattattcaccatagatgggggtacacgattccaggtgcgcctgctcctttcttgatgcagatgacagccacaaagagttatctaggagttgtggcaactttgtgtggaactcacaagattgacgaggactgagtacgaagaggcccagagttggggtctttgtgtttcagagacagattagcaaactgtgaatccaggtctctgctgttacttcgactagggtagtagtaggttgcggctgcttctgttgctgctgctgctgctggtacaatgatctgagacgaccaatttcccgctcaaacatctcctgttgaactgaaaaatcagaggaaaaaatctttagagcacttaataatttgttgtcagcataacttttggtttatttttagcatcagtaaataaattgatatacggtattccgttggactgaaaggcagtgatgatgctaaaataatcctatagttcatcattagggcagaatttttctagtttaggaacatatgaggcttagtttctatcttgtgataagaaaagaagctttaacaatatgttcaggcccttatataatacaatcactggcataccgattatgcaactatccaaacatttataggacttcaaatactcatgtaccagcagtcagaagtcagatattgtatgtttctgccaagttcataagttatagaagtggatatggaattacttgacctttgcacatcttggccaagggtagcatcattcttactaaaggagctaagtagtaggctgtttggttctatatttgaaatcttcggttaaatggtttgtcaactgagtttatactccatgtatagaccaaaaaaacattctacaaatagtttggctaaaagctcaactataggtatttttgtcatgattagtacatcttaaaacttgagaattaaatttcatttcttcctaactgcgaaactttgacacatgctaaaatgatttttactagcacttaagtgcagacaagaacaacaaagtaggtacaccaaatcaaaatggagcatacttacagcgtttaattagttgctcttgagctagactttccagcctttgctttaaggctttgttttccaagtcaagcataatattctgttggctaagaaactccatttcagcagacacatctatcccttctgactgtattgttcaaaaaaaaaatcagtgtcaaatatagaattggagtgttgaagagatagcaggggaaaaaaaggttgtagcaacctcacctgtaatgcctgaacttttctctcaagctctgcaatatattgaagcttccgaacgcgggacctttgagcatattgcctgcaacaaacatggggaaaaatcttcaaaacatatagcatgagaagtatttaatcacgccatatgaggaaacatttaattacgtatgttgtaagtttggagactttgatgggctgtctaagatttacgttgaaggtttgaccatatccaaaatacaatccacagtctatgcacatgcatacacagaaatgaatgcattgttcgtgccatcctgtcccatgaatcatacgcacaaactgcgcacgagtgcaactatacaaaataattgacatccaccaaatgcactgttcactttcatgtgacgcatactgcattctcaaggcttactggttgatagatgaactccacaacaaagcctccaaaagcatattcagattgcatattctaagtgaaggcctgatccttcttgtatgtgttaaagcaaacattatttgatctcttcagattatcatcatcaaatttcacatgtgatatcctacaatatgaacacacttttgaaagcgataatgtgaatgcgacagtatttgaactcactgtttagcgcgcttggtgtccgcctcggattgtgcatgcttcggcggcacgccctccttcctctcaggcccaaccttctgatcatgccccgattcgtccgaggatctcctgtccataccatgatcatgatccctcaacacgctcggcgacccatggtgcccaccaaccttctccttcgccggcatcggtggaccgccgctttgcctgtaattcaccaaattgttcatgccctgctcccatggccggccctggtgcctaccaaacgagcttggcttcgcatagtactcctgcacaccaccccacggcgcggcctgccctcctcctcctcctcctcccatcccttcaaagccattggcgtaagcgccggcggcggcgcctccgtcgaacatcgcaaacgagtcactcgacgaccggcggtggccggcccggccgtgctgccgcaccggcgtctcgggctcgttgagcaggtcgtcgagccacgacggctgctcctcgatgaagctctccgacgacgtgcgctggtggtgcccgtggccgtgcccgtgcctgtggtgcggcgcaccctgcggccgcgcgatcgggccgtggtcgccggcgtacggccccgccgccgccgccgccgtcgggaacgggctgcgcggcggcagcagcgcctgcttgggcagcttcgcgttcgccatcatcatccgctccgacccaaccaatctgaaacaacaaacacctctcctccataagactctaaacccaacatcaactcgagatttgagcgaattcaagcaccgagcaaccacgaactcgcatcgaatcgaagcaggctactcccccaacccaccccccagatctcagcgaccagttcgctcaaagcaaacccccgaattcgagccaaagattcgatccaccccccgagcggaaaaatcaaggcgaaacagcacacggacacagtcaagatccaccaaagcacaagcagcaacacccaaattaacctcagaaacgcggctcccaaaccccgaatcacaacgaaaacagcgcaaaccgagcacggatcaagaaccacagaaccccagccaacgccaagaattgcagcgacaaacaccaaaaaccccccacgagatacccaccaattcggccgccccgaccgccgcaacgaaccccagctacgagtttccgactccccggactcttctccggtggtagccaagctaatctatggaggagctcgagctcgaaggctacgaagaagaagaagaggatagagtagtggagaggaggagaagaagaagaatggagaaatcgtggagagaagggagaatcgaaataaatagtgtccttaaataaaaattacttggatttaaattactagattttaggaggagagatttttcggggcggcgaatttttgggcgaagcgtggccgttggatctgatgatccgacggcacgtgaaggtgatgaggatttattttattttattttatttttcaatgcgatgatatttgggtgggggtggccaacagcccaacactgggacactagtgactcgtgaaatgctaagcgtactactgtagtgtacatgaggagaaattcgggttatccgttgatatgtttacgttggcaattcgcgccaaaaaaaaataacttcttattttcggccgtaaggaatatttaaaatattactataatttaggtgttgtgagtttagtaagtaatagaaagtacaattataattaatattgtctcatccatttcggttatcttgtatgtattaaattacgtctatgtaacaggtataggtacgaccgtttgttcactgagctttgggcagttgacaaatgtaatatttttgccatggtgcctgctatgaaacctagcatataaagccccatgacattgacaatagccaattttcttctctttttcatacctttatgctttcatgcatataaattgttctccttagtgcctaagctattaacattagttgtttcttagatttctactgctaaaaccataatattgaccacaataaaatatattttttatagactatggttggcttattttagtttaccacttacgcctgcaatatttttagagccttattgctctatatatataattattttttatttacaaatatatcgtttcgcattttcctcttatcagccaacgatggggccaaaagtcacaaagattcatctttaccaaaaactctagatcagggggagtggataaagggcgagaaggaaaatatccaagaggtacatagatagcaaatgcagttggtgcatgtggcaaaacaccagctatatgaatggcctttctttatgcagcccatattgggtagtgggggcgagtgagcgagcgagcagagcagaaaacaactaatgccaacagcaggacagctcagggatggatcatccagctgcgaccacaccaccatttgttggctctgtcgtgctgttttgtttttaattaattgattataattaaaccccatctttattctcccccctccttgatctctagcttgttaattctttctcccttgtgaccatctctttggctgacctgattgggtgaaagaaccaaaaagaaaagatcatgcattttttttttggtagggagatcatgcatgttggcaacaaaaaggaggagacataaccctaaaaaaaatgatcccatgattgatgaatgagtatgatgtgcatgcaacgaataattgtatgtggtatagtggcatttctattttattttctttagaatgaattggtgaagataatgtaatagctatccattcatcttatttatgaaatgtcaaatgttatcttgtactatgtggaagaataatatggcatatacataaattgtttacagaaaagaattagctcaattgtatttcttttcagatactcaatagtggatgtggattgggtggaggtatattggcaatagctgtgttgcttggaaggtttggtttggttttcattgtttgctactttgatctttttctctatttttttttcatttcttggctctaaatatttacattatttatgagattggaattatgagggggaaaatgatttttggtaacattattggatcaccttttgctgcccctacactcttgccttttggggtgaccttagctgtgggcaactgaggtaacagccggcagatcatggttgcatacgcaccaagtttattagttgtaaaaagatgacagttacattaccaaatccaaactatacctcttaaactctgccactgaagatttgtgcttgacaacgatgcacttatgtttttcctacctgctattagcttcaggtttttaatgctgccctatgatatggttgtctagttgtaaacctaatcaactgtattcctaggctagctaactgccacatcctcggggaaaagaaaaaaagaaaaaaaaaagaaagagttcattatatgtttgaaatatgttcttaacttttggaccgagtacattataatataggggtaagtatgtgttctttaaaggttatatttatataactttgtgtgcagatgttcatgaaagtctataagagaatgataacgacacacattttaatttatcacacaatttatattttcacgaataactacttcaaatagagttatatatctaaatgcgatgataatttatacgtttagttttatatactggctcattgttgacagggttcattaaaaaaaaatcagatttcgttgcaaaagagatgtgtgacatgtagagcttatcctgcttgagtccagcctgctgctatcatcgacgtgaggacaagttagctagccgttcggttggatgtcacggttggagtatgttggctcatcagtgtcacagtgcaataatctcataacaatatggcaaaatttgctacatgatatttagggatgaaaacggatcgaatacggtcggaaactagctctatcatattcttttttattttttttaattgaaatcggaatcggaaacccgcatatgaaaacggaatcgaatattatcgaatacaaatacgaagcgaatacgaagcgaaacgaatacggtgacgaatattaatcggaatataaaaacctctcactactaaataaacgatttttatgtacgagaccctacgatttttgcaaatagactacaacttgtcgcgtctggaaaaatcaagtagcattttcacatacggctccttaatacacccctatggaaaaattgatttttccatgcgggctcttcagcatatggaccacttaagagtccgtatggaaaaatcgatttttccatactggcgtcttaagaagccatatgcgaaaataaaatttaaaactagtttatctcactcatatgaactctaaattggataattatttttcctaaatgtttctaaaatcatactctatcatgttattaagttcttactgctattattttaaccattttttcttgtgaatttgttttatcaattaaaaatttgaattttaaaacttcaaataatattttgaagcagtaaataatttcagctgaaaaggttatgaatataaaagttgtagaaatcatcaagacatacaacttttattttgatcatttcttcatctgacaaaatggtagtaatattatttacaaaatttatatatctctactatagtttataaaaccaaatgagagatatgaaattttgtgtacaatgttactatcactttgtcggatgaagaaatgacaaaaatagaagttatagatcttgatgaattatacaactttgttgttgatgactttttcagttgaaatcatttagtatttgaaaatgttgtttgaagttatcatattttcaaattcaaattcaaactgttcaaacaaagtcatatagaaaaatgaccaaaataaaagttgttgatcttgataagttatacaactttgtttttgagaattattccattggaaatcatttactacccgaaaaattatttgaatatcttatattttaaaattcaaattttatatagttcaaacaaactcggatggagaaatgaccaaaataaaatttgtagatcttaatgagttggacaactctgtttttgcccaatttttcatatttggtcatttagccttcaaataattcaattcgacatttatttttgccaaagaagggctgcaggaat

SEQ ID NO: 20846 - DNA, 4000 bp, Oryza sativa
tcgtctcgcagtttctaggcgagttatgaaattagttttttcattcgtgtccgaaaaccccttccgacatctggtcaaatattcgatgtgacacccaaaaatttttatttcaccaactaaataggccaataatccctggcttgtgtaccgtcattgatatttatcatggtctctgtgtctaattgacataattgagaattgttttaatcgatctatgcctgcaggtgtacgtgttcaaggcccggtaaaattttacaccatgtcacatcgaatgtttgaacacatgtatagaatattaaatatagacgaaaaaaataactaattacacagattgcgtataaattgcaagatgaatcttttaagcctaattgcgccatgatttgataatgtggtgctacaataatatttgctaatgacagattaattaggcttaataaattcatctcgcggtttataggcggattctgtaatttgttttgttattagactacgtttaatacttcaaatgtgtatctgtacatccgattgtcacgtcaaaactttacacccctaaatctaaacacagcctaagcagaagataggagtaccgaggtcctctttaggaagcttgtagctgcaatttattattagtttttgaagagttgtaacttcttttagaatattcagctttccaaacaatttaaattctcacataaattccaaaaagttgtagttattgaaatataaactatccctctatttcatattataagtttgacttctttttaagttaaattattaaaagtttagctaagtttatagaaaaatatagtaacacttataacatcaaattacttccattacatctaacattaaacatagtttgatagtttatttgtcctgtattaaaaataaggttatatttttttataaattttatcaaacataaataagtttaacttagaaaaaagtcaaaataacttataatataaaacgggtgtagtagaaagcagataaaacgaggttcattctcactaactggtcactgtgttgggaaaaggatcctctgacttactcacaagttgattctcagagctttctcagccctcggctggtcactgtgatgggaagaggatcatctgacttacttccctctgactttgagtcactgacatgtggggccactgactttgagtcaccgagtagagggcccacatgtcagtgataaaagttagagggaagtaagttacagaatcttaattccactatgatagctctagatgttctttttgtttcctataacacaaaggatgtacatatatatatatatttgacgaaacaggtgattacatgaattctatgttccgattaagtagttaactgagcatcacatccagttgacccaaaagaagtgaagccgaagtaaagtgctcagctcaaagaaagaaggtggtgggggcttcgaagagtgaataagttcggcattctcgatctcagggcttgactagttgactatgggcctggttgggatgtttggcagagtttctagctatggcaacttttcctaaaataagaagtttcctagagttaagattctgaaagctgtagttgtaaaacccagaaaataaattagaacattagacggatttgctaattcgcgcatacgtgccgcgggcgcgcactccagcccacccggcccacgcgtacgcgtgcacggtccacgtcgctcacaaagcatgacgggcccgttacggagtaaaatacgattagtgcgaggattagcgtgctgattttttccgagtaattagatcgtaattattatttcggttaaagtttgaaaactttctacacaaatttaaaaactttttaactcatatttaaaactttcaaattaaaatttaaaatttttaagtcattttaaaaagttttcaatccagatttgaaaactttcaacctagatttaaaaactttcaacccagatttgaaaactttcaattcaaatttgaaaacttttagctcaaaatttgaaaattttcaactcaaatttgaaaactttcagcacaaaattttaaaactttcaactcaaaatttgaattttttgaagtcaaattttaaaaactttcaactcaaatttaaaactttcaacccatatttaaaactttcaacctagatttgaaaactttcaactcaaaatttgaaaactttcaactcaaatatgaaaactttcaacaaaaaatttgaaaactttcaagtcaaaattaaaaactttcaactctacatttataaagaggtgtgtgaaagattgaaaaaaaatcggaaagaaacagaaaaaagaaaaacacgatgaaggagaaaaaaaagtgcgaaaaaagaaaaaaaaaggcgcagggacgggcccagctggcgtgcgcgccaaaatttgaaaactttcaacaaaaaatttgaaaaatttcaagtcaaaattaaaaactttcaactctacatttataaagaggtgtgtgaaagattgaaaaaaaatcggagaaacggaaaaaagaaaaaagaaaaacacgatggaggagaaaaaaagtgcgaaaaaagaaaaaaacggcgcagggacgggcccagctaggcccagctggcgtgcgcgccagctaaactgctgacgcgtacgcgcgcgctaagaacccacaacattagaagctgggaagcttaatttttccagagaaacaactactgactaccaaccagctgtttgtgtttctcaggatgttaagtttctcaaatagaccctataggacacaacaattaaggaaccaaatggctgtgatatcaagagagagagagagttgggggatatttatacaaagttaaaagttagacaataattgactataaccacccatgccactggtaatacatggcgtgatttgatttagcacgcgtgagatgggacattattacacgaagcacgtactgaaatttggcgaagcatcactcgagaatgagattgtgatgccgtccaattgtgctgtgtttacttggagtacttttgattagcacgtacccttgtgccgcacaacaccatcgctcacatcatctaggaccaaagaaaattccagtggtcgtgctcactgcagcctgcaggcatcagcatattgaccatatttctctgtcaatttcccggcacaccgtgttgtagttttagcttattcaccagattaataaaacagattatttgtttcatgttttaaaaaatatatttagtaaaagattttttttactgcattgcattaattagaccacttgtgacttgtcttatgtggccccgttcttttccttaactccaaactttatctttctcgttttccattagcatacttttcaaactattaatttttttaaaaaaaaggttctacgtagaagtcgtttaaaaaattaaataaatcaatttttatttttttttataataattaatatttaattaattatgtgctaatgagttttctcgtttcgcatgcagtatagttagagaacgaacagggctttagactatttaacaagtttattcattaaaatacttaatgtatcctcgtaacaaaggagatagtttgtgataataatccattcaataatttaaattaaaggggccagatcatctacgctaacaatttggaattttgcaaaggtaagcttaataagagagaattttaaatttttatactactgttggtagctgttgatagcggtggtgacagttagggcctgtttggcacagctccagctccatccctcctggagctggagctcagccaaacagtttcagctccatcaaaactgggagtggagctggacgtggagctctctcacaaaatgagctggagttgtgaaactgggtttaggcagctccacactccactccagacccaactcctggagttaaatttaggagctctctcacaaaatgagctggagttgtggagctgggtttaggcagttccacactccactccagacccaactcctggagttaaatttagga

SEQ ID NO: 20847 - DNA, 2430 bp, Oryza sativa
tctaaaacagagtaaagcaaacatgtgacacccctctctatttggctctagctccacccctgcatcacttcgtaataaatacgactgaacatgaatgtttctaaaaaaaaaagaaagaacatgaatgaacagttctaatttgtgtggctgacgatgctcctcgctctcgctacattgccaatttgccatcatcgatcttccacacagaaccgcagtgcagacacaagtcggaaaatgaaatgggtgaaaaagagaggaaatgaaacgggtgaaaaagaaatcaggttatctcgcactgatgcatgcggtgacgtgcttgtaatgaatcgacactaaaatgacagcttgattgatacaaagtatgcgtatgatcagctataggcgtctattgtagcttttgagtgagttaattgaattgtttgcctgtattttgagcttattggagatctgggcaatttttttattcgttcaaatttcgcgtgtaaactggttgatattgattttacatgatctttacaaactcttatcctcttccacaggttgctttgaaattgttcagatcaaaatagcagcaagaaaaaggatcaagaaaaagaagtactttatagggcccaaatgtataaggaaactcaagggctgcatatggcccattagtcgcttgtttgggcttcaaatggttagggtgggaacgacgagaaggcccatccatccacatctatcaagcgatgggcttttgctataggaataagtgcacttaaggttcctcaatttgttactgaatctgaaattcgtccatgaacccaaatatcaggtatagcacatcccttaacttacaatcatgtatcaactttgatccctctgcagtatagtggtcgatttcggttgacgtggcgagtgagacccacgtgggcctatatgttagttgttaacttttcttcctcctttccctcttcctcttctcttctcttttcttatctttaggattgtgccggcactgctgattgatgaggaagaaaaagatgatgctcctgaggcaacatgaggaggagcagtttcaaaagatgatgctcctgaggcaacatgaggaggagcagtttcttcaccaccgacatcaggaggagcatgaggatgagaaggcatttgagtccaaagagacgacggaaatcagacttcaaagagactccaacgatgagaagatagccgtcgttttacatggacatgcccctattcatacctaagtcattgcgtgacactatctagctcaaagagcaagaacggaagcgatgacgacagcttgagttggagctgcacgagaagaggtcaagagggttgatgacaggaaggctctaacgaggcagatcttgctccaagagatcatcaacgaagagctcctcacctacaacacagcttcaaacgacgaatccatcaactgtgttgtcaacattgacgacgagacagaccaagccgaggagcatgagtcatggcaacgccgggagatggcaaggatcaagaggggcagggaacaaagcagcttgatgacaagtcgatggaagatgagaacccggttgctgatcatcccaagaagcaaatgagatccatgcagaggtactaccacaagggtagcttcttccaacaagacgccgacaacgccacgcagactgctggagcagagggagagggagagggagatgagggagaagagttggtcgctaatatgtggggtccacgtggatcctactcgccacattagccaaaaccgaccactatactgtgtgggaccaaagttaacacgatattgtgagttggggaatgtgttataattagtatttcggttcacagacgaatttcagactcgacaacaaaattgagggacctaaaatgaacttattcctttcatatacaatgaagcttcattggagctaaccaatgaatatttgctaaaaatataaaaactatataaaatgctatagaaaaagttgagctagggtttaggattcagatttgagttcggggttagggagagatgcatagtaatacaccctttcagttcctcttttgtgtcctatcttactataaagttatccctcactaacttattaagcttaagcttaacatgcaaagatgccacatcatcatccactaacaatcatcacatttaaacatcatgcaaacatgttgtattatctataattttatagtttttataatttaagagcttttaaaatataaacatgttaaattatcatcccacataattcacatgatgtttcaatgtatatctttattatgttttataatatcctacatacttatatagttcatcctcacttagttagtgcttaaatgattaatctatggtccaaattatctttctccttttttttctctaactaactccttaagcttaacatgcaacaaagatgacagatc

SEQ ID NO: 20848 - DNA, 746 bp, Oryza sativa
atttagacaatgattccaaaagagaaaaggtagaggaaatctcgggaaacaattcccctcaattgatttcaccggagaaggaaaggggcggccgaatttggaaggagacggcggcggcgcggcgctagggtttcgggcggcggcggccggaggtagacgaagactgtcaggcggaccccacctgtcagcgagcgagggcacgcgctagcggcggactgggccgacttgggccgagggagagagagaaggttttgggccgactttcggcccaaagccaaaagagacttttaaaaacctttttcaatttaaattattcttgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctagacttttaaaataaattctaataattccaattaaacaacaatttatatatttaggatttttagggtgtgacagtacccgggctagccgaggatggtcatagaggtggtttctcggccatgagaaagaatggcttgttcacttcttatcggtcccaccgggcgtgccaaaagcgtgttgatgaaaaacacgaggcctgggagatctgcttaactccagtgcaggtccaaagctcgccttcgggtgtgttagcgtgccagttgatttgatcctgca

SEQ ID NO: 20849 - DNA, 892 bp, Oryza sativa
ctccaccccataaaccctaaccgatcgagggggcgcagccagtgacgggaagtccaccgccgcgccacgcctcgtcgtcgacaccgtcgctgctgcaaccgcatcaccgccatcggaaccgagcacatcgtcgccgccgtccacgtcaagcccgcgacgacaacgacgatggccggccggacttcctcttcctcaacaacgactggtcacaaccctaaatcctctcactccctctttgttcattcatctattgttgttcatccattgcaaatagaaccacccgactagatctaaacctaggtgatccaatagacaaccctatcaatggtatcagagccaggttagcgtttagtttggttcggggatagacatccacagagaagaaagaaatccaagagaaaagcaaacgatccaacggatcaaaaagatcgaaaccctaaccctaatcttacctcgtcgccggccgtcgatgacgccggccacggaggggggaggggcaaagaggcaccgccgaggagccactcgacggccgcgcgcgcacccgcgggtgcacgcgcgcgccggcgagggggcccgcggcggcgccgccatctccgtttttcggccgccgctctctctcacacggtgggggctagagacggtggagggagcggagaagagaaaatgaagagggcgcaagggccgctggcggcggcgacgccgctccgctcggccgctccggccggcggcgcgctagagaaaaagtgggcgcgcggcagcgcgaggtcgccggccatggcgcggcggcgcaagggtcgccggcgtagatgacgccactcggcgcggccgcacccgcccgcaagagagaagaggctagggtttcggccggccggcggctggggtcgggtttttg

SEQ ID NO: 20850 - DNA, 721 bp, Oryza sativa
attcctgcagccctgcgtgttagtttctgtttgtgtatgtgtgtgtgtgtgtgtgcgtgtgtgtgtgtgtgtgggtggggggggggttcacgcacccaagtgtgtgtcggtaaccggcacaggagcaccttgacatgcagtgacaatgtcaggctttgcaacatagagtccatgacgagaaaagggcaggaggatagattagcggtgaacgacctagcccatatgatgatgccatgccacacaaggaaggtgttgtgcttgacatgcctctcttgcgtctcttggatgtccatgttgatggcggtgtacatggcctccgccatggcctccacaattcaaggattgatgtgtatggtgacgcttggcgatgacaaacacccgacaaactcagacaacaaatggagatgttccgcactatcttgaaggggattggtttttctaagagcttttagatagaagaattttcggtggctaaatgcctagtagtgcttggttgatgttccgttggatttaaacaattagaggggtgagttatatgtcataagagggaaacttgaagtggttttggattaagcattcgctaaaacaaagtcaagtgatttttggacttcatttttttcaattttgctcactgtacagtaaacttaatttatatgattttgtgtatctgagtttgcgtgtgtgcgtgcatgcgtgtgtgtgtgcacgcgcatgtgtcggc

SEQ ID NO: 20851 - DNA, 6226 bp, Oryza sativa
ttagcaatgacaagaaggtctggaggacaggtcagtggtacatggcctcgccagatgatgttgttgtgtaccatgaggaaatatgttgtgcttgacgtgcctcacttgcttctccttgatgtccatggtgatggtgatgtacatggcctttatgttccacaggttgagcgtatcacgttgctagcaatgacaagcacccgatgaactcatatgacacaatggagctatgccacaccaactagattggtttgatttctagtagagtatttttcgatggctaactgcctactagtgattggcttgtagttggagtggacacatgtgcatttgctgatattaaataattagaggggtgagcgatatgcgaagcaagtgtaataagtagtggtattaaataaatgatttcgctaaaacatagtcaaatgattttggactagatttttgtcagttttgacacaacacggtcaactctatgattggtaggtgtgagtagacgtccaatggcattgttgggctacgtgatgatgactccttgatgacgcatggccatgaggacaggtcagtgatgaacgaccttgtcgagatgatgatgccatgtagcttaaggaaggtgtagtgcttgacatgcctcgcctgctcctcttagacatccatggcgatgtacgtggattttgtgatggtctcgacattccatgggttgatatatatattgttgtgtagtggctggttggtggcacccagcatgatggagcccctcttcccggcataccgtgtagaaatagggtatctagttgagcccgttgcagatggcgtggatgacgcaacactcgacaacagcacaataaaccaacttactagccatggtagttattgcccatgcagccatggtgggaggttaggtgaggccggggaagttccctcgttgataggaatggagcagaaaaccacgacgaagaggaacggcaagtggggggaagaagctgatgcaggagaatgtacacctatggcgaatgaagaggggagcagccagaggtactaattgactaacaatggacgaacacaaggtcaccatcatctagatagagcaactcgatgatgccaacttgtacttccaagtgtggcattgagagagtggtatcgatgtccctaaagggtgacaaagagaggttaacggaggaggcaagggaagagactagagaggatgaagatgggctcactgagatgtgggtaccactatatattttttatttttttccctaattgcaatgccacatgagtgacatgtaaggcatcacatcatatgaagaccaggtaaacgtgtcacgtaggcactacataggatgaaaccacaatccacgtagcttgcggaggcaaaacaaaccatttcaatagttgagggatccttcatatctagtttagaggtctgagggaagcgaatgaggctcggcccatagctgaggaaggcaaaatagacttttccaaaatcaagaccaacctagagggtcttcagcctgttagtcaaccagtcaaccagccaaccaggctacacttcacgcataaacctgacaacacatcatgagatttccggaagaggatcactcagccctaacatttcctgggtgtcacatctcgctcactgtgacgtgctgcacaatggcgtagcatcgaccggtggtgtggggttagccatcttcatcaaaaagcctaattcgcgaacacacacgcccattgaatgcatgaacacgttctggacgcataacaacaatctccaggttagtgttagggtattgggggtgggttggggagggtgtggtgctagggaggggaagtgggggatcaagcttagagggatagtgcaggaggcgatggacaagggcatacaacgagtgtggatagtatgggtactagatacccacaaggcctcttatcagactagtgatagaaggtgaaccagatccatgtaataggagataaagtaaaactcgattgccatgtagccttgtaccctaagataggatatagaatccaggccgaagaatactatgtacagattaggaaactgaaaccgtgtccggctaagttttccccctttgtaaccctgtccaccaaggtatataaaggagctcttttaggatgggccaatcgttcgtacgaactcctccacgaacgttcgcgcaacggccattctggcatgaacctattaaacccttgttttccacatccatctgctttgagatctcgtgcgtagccttcttaaattattgccgatacaaaacatcaacaacaaggcggtggtagtgcctccggagccacgggtcggcaactgactgtgggctggtgttggtgcggaggcaaagcgaggcaaaggggaggggaggaggccagcactgcaggggcgcgcctgcacattgattccctttggtgccgccaaggccaggcgactgcattgtaggtgggtggcagtcgaggaaagggctaacctagtcgccagatcaatctcgtcaagagaaagctcgccatagggagggagctggggctcactagaggaggcctttgccgtcatcatcaccagagggaagctgctcgactacgtcttgtcttctcaatcggaggaagctcaccggatggatgtggagcaagctcgctggaggaaggctgctcgtccgcgacttctcttctcactatgttgcatgcgcggatgggtggcttcctatccgtatgtaccagacaaagaaagagagtttgggagggggggagctaattaatatgttgtgggctgccgttttgtggtaattccatgcatgtcatagttcatcactaattaacaaacaaagaaatcaatccaaaactgggtgaatccattctctatggccgagcagtagtgctaagaagggaaattaccttctctatggaagacggtgtggtctcgcgttagctgctttgcggtggatggcacacgatcagctaaaaccctacagcaaaagcatcaatcatcagtcaaacagctcggcgagctcaaatcctgtcatcctgatcagataaatacatcaaaatttaaatggaagaaactaattcgttaatcttggatatgatcttttggagaatcaatttacttaccaaaataaatacttgatatattctgtctatcctaaactcgatttcttccatgaagaagcactaatctaattttccatgatatcacctcaaaacatcacgcaaatggaaaggtcttactttgcaacgcaatccaaatttgagagaacaaataaattcagcgagaggtacagttagattttcctgtagaatggggggggggggggtacttaccgtgcacgatcactccacctcacgagctgatccgctgcaaatttccagtcatccacactgtaaaacaacttagaaaatttaagaatggcaaccaatgccagaaaatcgcactgagctaacacagtgacgaccaacacacaacggcttacacggatctacctcccaacgaggccattgaccatgacgatgaggtgctccaggaagcccccctccctacactacctcggcctcggccatccgcgtgctccactcgtcctcccctccactacactctgtctccccctccacgggtccacctccggccgcttccctttcacctccttcacggccactgccagccagaaacagctcatccatcccgagctactagctgctcaccatagccacagccgcggccgcggggacaggaacatcaggcggagtggtccgacagcgcgtggtaactatgaccgggtcccaatgttagagtaggtggggctgtggtatatatataaaggtggcaccggcaacgatcatctagctaggaggggaggatgtggccgccttggctaccgtggctgctagatccactctgcatcgatgagccagtccatatctggatgggcagatccaagcaccaattcaaaggccgccaccgttgagcatatgcacaaggggatggggtgcatgatatgttgggaaggggggggagcggtgacaaggaggggatgggaggagccgaggaggcagcgtgctgggtaaggaggggatgagatgagatggcggcgtaagggagggtgggggaggagttagaggaggggaggataagagagggtagcgggcggcatggaataggaataccagatgcacacatgtgggggcggcacgccggtgaggattggggcaagcggattgcggcgtagggaaaccctactcttgatgagagggagaggggtgggggagggggggatgattagtagagagttttggttggtggaaatgcaggtgtcaaccatccgattaaatactatggaccaccaaatcaatcataagtgtattcgagggaggatgtgggtagtggactgcatgttaaaattgacggacgattaaaaaaagatgacgaaacagaagcactttgatttgttcaggtaggtaagttgattttttaggtaggtaaggtaagatatggaagtgaactaacttgtaatatttttatttgttattatcgagaagtgatagctcatattatttttcattgttctttactacaatattacgaaatgacagcttgtaattgattcccttgttatttagtatagggaaaaactcctaatatgccatttgataaatgacaataaacagatacactgtctacagtatctcacaaacatgtaaattgtaggattaatttgactagcaattttctatcacatacattcccacagttttcatctaatctattattgttataaggaaatatcttatattatcaaaattgataacagtaaaactaagttacttccaaacaatactagcaatttgctattatattttgcacatctgtcatcacatttcttatataaagattatcttatgtcttctatggctgcgttcgtttgtgagacatagggtgagaaagcatctcgttttcctcgcgcacttttcccaaactattaaatggtgcgtttttgtaaaaaaattttataggaaagttgctttaaaaaatcatattaatccatttttgaaatttaaaatagttaatactcaattaattatgcgctaatggcttacctcgttttgcgtatcttcccaatctccccaatttccttctcctcaaaggctcaaacacaccctatgttgccatatattggtaacacaactatacaacagcctatcaaaactaatatatttcattgactttttcttacatgtttgactattcgtcttattcaaaaaatttacgtaattataatttattttgttatgagttgttttatcactcatagtactttaagcgtgatttatatcttatacatttgcataaaatttttgaataagacgaatggtcaaacatgtgaagcataaaatttttgaataagacgaatggtcaaacatgtgagaaaaagtcaacggcgtcatctattaaaaaacagaggtagtatttaacaagatataccagaaatatgagataaatagttttttttattttctagaaatgtgcatagtacttgcatgtaaactagtagttatattttttataaaaatgttaattcttgaacatttaagaaaatgaactaggcgtgtgttcaaacaatataactttcagcgtgccatataaataatatattcttttatagcaatgtggaactatattagttgagattttttttcaccaaaaagaactgtattacattagaaaaaaatgagaaaggacaaccaattaacatacttaacaattatagcaacaggtagaaagatagtttgtcaaaatagttggttatacaatatcatattcacaaaataatatctcaaccattcatttgttttatgaatgcttgtgagcaaggagggccatgaatccaggaattcacacatacttcttttgaatagggtgatacatatgcacgtacataaagtcagtaaacatgtgccaacagacaacacaattcaggtgaaaaccggtagagtatgatcttggtcctccattttcgggcataaacacataaaatttgacaagaattttacagtcgtatggtagaaatttcacaaatctgttgattaataagatattacttacaaatgaatcaaatatcgacccaaaattattaaatatttgttaataagatctcttggaaacgttaatttttcaacattctattcttaccttttgaaattgtcagcagcctaaaggggctgcagg

SEQ ID NO: 20852 - DNA, 2331 bp, Oryza sativa
tgcttgtatcttatatttttgcagggaaagaagttctgcttctgacatacctgtagtgcatgattttgatgttagatactatctccgtttcaggttataagactttctagcattacccacattcatatagacgttaatgaatttaggcacacatatatgtctagattcattaacatatatatgaatgtagacaatgctaaaaagtcttataatatgaaacggaggaagtatgatcataggactacatgaagctgctgcacacactgtgcgcaacatctgtttttgttggtcattccatgaaagattggcatacctcattgaaattgaaatttcaaataaaaagcaaaattcaacattgcaagctatatatttaggcgataatgatctgttgtcacctgaaacagtctggtacgcagcaaaggagagacgttcgggtagcgcagggataaaaccttcattatactcctcaaaaatttctttttcagaccacaacagggaggccttgatgttagtttgcaatggttcatcctcaggtacctatgtggcaaaaatgaagtctcacgacttacgacaaaaccattgttcagcattcgcaaattgctgaaattacagtggtagtggccaaaccttcagtttcatctgtagactgtgtaaattacacatagactctcttagcttggaaattcttaatcccaattcaatactctcggaagatatgtccataatgggagaaacatcaccacgcaagtagggttccatctagatcaatgaagtaaaacaggagaaggactgtgaatcacaactgctcaaataaacgtacagttttaaagagcatgtgcctgaaaagtcatttgtttgtaccacttcttattagtataaatacgtacttcaagaccaatgcaaaaaaaaaaaacattatataatgttccatcaaaatataccaaaccagagcttttttttagacagtagaagtagtactttcgacttgcaccaactagggatgtatacaatcacatgtatggacaccaggatttaaaccttgatggatggagacgcccatgactccatcaccacactataaacaatgcttccccaaatcaatcttgagaaaatatggtcatcacaattacaaaggaacttttttaaacatgtttgaccgttcgtcttattcaaaaaatttaagtaattattaattcttttcctatcatttgattcattgttaaatatatttttatgtagacatatagttttacatatttcataaaagtttttgaataagacgaacggtcaaacatggctaaaaagtcaacggtgtcaaatatttagaaacggagggagtatgaagcattgaatggcacatgagttcctatcggtgacacaatgcccttacaggatcaatgcggcaatgtctggtggattatacagacaactcatggaatttatattgattaggtatgacatgttataagtataaacattgaaaaaatatttcaatctacaaaattgcaatgaggttacctgcaaaaggttgataatgtttacacggcaaactcctctaattgatactagtgctccaatatcaagcctttcaacctatactaaagaaagatcattgagtagaaaatgtaaataatcctatgcagaatcctgtcataaaaaaattgtaaaaaaaaagggtatgaaccacaagaactttacactttctatctggaccaaacaaccatgtcttacagcaaaggaagctttaggtgaacctgatacaactgggtcgagcaccaaatgcacaaaagaattgtttgtcctatacaaggcctgttgagcaaaaaggtagaaacagatgagaaataattatattttcgcataactacaacaacactggtgcggtgtgtgtgtgtgttttttctataacaagcaaattacccggctttgggagaaagccaaaaacagagacagtcttacataacggaaattggtgtggtgtgtcactcagctgaactactgaaggtctcgttataactattaatctagtgatagagatatacagtttttgtaattctgttacgtcatattatgtcataatcccatttccaccgagaaattcttcccttgcctattaagggtaactagagcaccttagaagagcttagagctgaaatcaaaatatagcgcaatagcaatataattcaaacttaagggattcagcaaatggtaattacctcttctagcaacgccagatacctagcctcatacaagtgtaaagtcttgcactccgatggaatcaacacctacaatatttttactgtcttagcagcaccctagtgatttagttga

SEQ ID NO: 20853 - DNA, 16818 bp, Oryza sativa
tttggtggctcctcatcttagcctcttgcaagaaagcaataactttctttcacttgaattagctacagataattaatccagctcgattcgaacactgctattgacctattgttgtgtcaaactgacggtatgcatgtgcgtccaatttcaaatcaccatagccataggtaggggcggcagctttcttgttgttcagaggtcatgaggtcgtacctctgcgggctggaacgggaggagggggaggtcgagggacgccggcgacggcgacgagcagcgtactacggcgcggggatggcggcggcgcgtcgcgcgcgcgtggagggatgctggggacgagggagagaggaggcggagcagagccgaggcggccatggatgggtgggagtgggagccgtgggagagagataatgcgcacctgtttcctctcctcttcttttcttttattttcttttgttttattttcttgttttctttttaagcctcaacccttcaagtacaagtagtagtgtctgaactcacgcacaaactcacaccaccacaccgcacactacacactcacacaacaagatctacgcaaatacccaaaggctgcacgtggctgagagatatgcgaagtgaactggcttcgcacgtgacaagcatgtcaccttgaccattgtggcacattcacgtgtgaggctgcaacagaaggaaaaggggaataaaaccccaatgcgaaacccgcgtcgagcggcgctcgaacgcgggtggtgggcgctccaccgagcagcccaaccaccgagccaacggctcgttcgctcttttcttgttttgtcttggagaaatcgtgcaaatcctctcttactatatatataaaaagttataacatttaaggatcacgtaagtatgctatattatctatagttctataatttttttttaaaaaaagtcagagattcaaaatgcaagcatgtttcatcatcccacataattcatataatattttgatatatctctccatcatttttttataatatcctataagttcatcatcacttagttaatgttattttattttctctcattaagccatataatatcaattgcttttagtccttatatgattattctatggttaaaattatctttctccttttcttctcattaaaccatattatctcaattttttaagccttcagatgtatagtctaaattatcttccttcttttgttctcacaccatcttacttttacatttgaatcatcattctatataccatttcaatttaaatcacatcaacttatgtagtcctcgtcaccggcctccttcttgcactgcgccgcatctttcggtccttccactccttcgcccacatcgcgcgcccaccgccgccgcgggagacgacgggagccatggatggatggaggtcaaagggcaacactgcaacacaactctttggctgcagggatgattagcatataagctcgacgtagaccttatgatccagtggttcatatgcaatctcatccatcgatcgaacggctgagaattagtgataacgtggaatgctgaggtttcagctttagatcttaactttatagaaagaagggatttacgtgagggaggtggagagccggagatgatttttgggagatgggattttggttttatatttaaaatagatctaatggtgtaatataatgggcccactgtattaagggaaaataagagtaagatgttttgttctcttttttttagaatttcttgggtttctctaatttattagagcgccaagtgacgtcctagagtgtttatagaaagtttaatggatttttaatatataatagataataaaaaagtaatcacatgctctacccattttcttttgttccaaacacgtagagaccagatgcgtggagattttgagctcggtttgacaataaataccagtgcataaacctcatgcacataatctttcaatcgcaacataaaattttcggtgtataaactttatacgcataaagtttcaatgtgtaaactttataaagagaaagtttcaaatatactcaaacgaattcaaaaattgaaaagtttttcactcaaaatcataatcattcaatcaaagatctaaaaatttcttttttatatataaaaaaaactttgttcaactgaaatctctaaatgtcccgctccaaatcatgaactttcaactgagatatagcaaaagatataggagtaggaagaacctgttgaaataataagcacataatgatttaatttattccataaataaattatgacattacagatgtaaactagaataatcgcatcattggatctacacatgtaaactaagcagtaaaacatgaacagatcgaatatgcgcaacatgttgaacgcgtatcgaggttgccgaaagatcggttgctcagcaggaattactcgcggttgtggacattgacgaagcgtgagcaaacaggaagacgagccgtcatggacaaacaaggagcggtcgtgtgaagcgcgcgtagtgtaactgaactggataagtcgcgcgtaacttatccggactctatgccattgtcacacatgagtaaccaattttgcagaccattcgacgcgtaacatcgtgcacgcgccaagcgaggcgagcgagcgcatgtgttccccctcttctctccacctcacatgctttaagtggctaggagggcatcctcccatttaaggaagtccctctctcctagaataagcaaggtggtactaaactccctatgcatgctatcccatgaggtgaacttttgtgatttttcaaagaattaatctttaagtggggtaaggcctatctattaatttcaacagaacccgcacccatctaggatggggtttcacgtgctatggtctatggctcaatcacatttttttctgccctcatatgtataggagaaagcagagattaggggagaagagtggctgcggcttcactgttccgttgttgtgtttccatccgtgttccgtaccatgtggagggcatcggtttgtcgattctttttggtggtggggtcggcttctatctaccgtgcagaatatgacgccgtcactactccgtcaaaacaaaccgggtactagtacttttcactccgcgctgcacaacttggaaaaccactgcatccttatctcttgtccccaaatcagagagttcatctgaagttctgctcatctgctgctctcctcatcttcctcttggccgcacgcaaccatggttgctctcgcgttgtcggcggccaggctcgccggcttggcgtggtctgcactccgcatactcgtcggcttggtgtagttcaatggtcagtaccaaatgtggaactcccttgttgctggcaactactatttgctatggtgaagaagtgaagaattgaagatcgaaacttttttcaccatacagctgcattaaggtagttttatttgataagttcatttttgcaaacacctcttgtgttttgatgcttctaaattattatgatttttttcacatgagccaaacaacatgtttggtgggaaccatatatttgatgctaatacaagagaaagtactagtatgatttgacagcttgaatcgacatgggaattcagattaagatccaatcttacaagttgtaatgtgattggaaattggtaaaggtgctaattaatatgaaaaaaaggtggggattttaatttaaatgggcaaacatgctatagggatatgtatcaaatgtctgtgcagtctcttcatgctgcatcccttgactttgtttagaagttcgaaataaccagatgactgaagtaatgaagcaccttcaacatgatagtagtctggcatttgcatgtgattgtagttagtgggaatctctgaacgaccctgaatctgtataaggcaaataataatcagtagcactgataagagagtctctgccaagtgtgtgtgtgtgtgtatatatatatcttgaatctactaacctgcatcatggtgtatggcagtgatggtgttaccacctctgcttgtactggacactttgatgtgcttgaatcactctttttctttttactccattgtgttgccttgtcaaaaccaccaattggtctcctcgacccacgaatggctttctccttaacctttatgcctcttgctttactcgggccaacattttcctctgtgcctatgataaaatatttttgagatagctgatttagattataacatagtagtcactagcataagtactattcaactcagagtaggatacaaacctgatttatccaaatctggatcaggccttatactcaagtatttctccacatcttctgctaacttttgtgcattgttggcagccattaagtatgtttcatcagattctgcagctcgagatgctattttaacaaacattctgcacaagtctctcctgcgcgttgataactttattttaggatcttcatgagtactgcagttgctctttatatgtagagattttgcatcaatggtccatctttgtagtatgtattgcttaggaatttcttttatattgttaacatcaagtatcttcaatgcatggcaacataggattccgagaaattcaaacttcttgcagctgcacctgactttaccttctgttggagaaaattttataacatgctcatggtgcttaccgtgaacttttaatttgtacatttcagcatcaatatcaccacagtagtataggtcacagttcaatgtttgcaacacttgttcctgaaacactttaaatattgctggagtataaattcttgttgcttgccttaatattgtcaaatctacttttggccatggtgtactttgtgttgtcttaaagtcatttttgacttcctcatatcttttgtctgacaacaacctgtcaaagtgttccaagaaggtaagtatgtcatatttcacactgatatagcccttcaattcattgttcatgctctcacttctctgtgttccactcatatcagcagaaaatgtgtttctcccatacactaatgcccattgctcttttttctgaaatagcctctcaagccatttgttctcctgcagatcatactttttaagcattctattccatgcatttataaattcatcttcctcctctttgtcataaatacaattctgaaaatctgcattgaatttcttgtactccttcacaactccagcaaggtgtttgcaggcattttggttcatatgccaaacacaaattctatgatgactttctggcatgactaacttgattgctttggccattgctgcgtcttcatcagtcaatatagtctgtggcttctttccagacatggcttttaaaaatgtcttgaaaagccaaacaaaactatcagcagtttcatcatacaaaagtgcagcaccaaaaacaacgcttttcttatgattatccacaccaacaagcaaaccaaatggacgaccatcatttagttttctctatgttgtgtcaaaacaaagaacatcaccaaaaacttcataatcagcaatcattttagaatcagtccagaaaatatttgttatcaagtcatcctcatcaacctgaatggaatagaaaaaattaacatcttccgatgattttttctccatatattccaagactccccctgtgtcaccttcgtttaccttcaatgacctctttgaatataatatattcttcatgtcttcacgagtaaatccaagattctcatatccacccgcttcttttgccattaaatcaatagtagccttattagaaatgcctactgattttgcattttcagcacttgccatctgtgcttcagttatttttctttgagatcttaagtagagggcctgacttccagtagcaagaatgtggttatgctcgtgcaagaattcatatatgcaatacaatccatcatccctaagacttatcttcatgcatgctcggcacatacatcgtgtttctggcctactaaaacactgaccgtaatttgaaatttggtcttctcttttatcatgaccacgagtacctattgttaaataaaactaacttagtatatgaattctatatgaacactgaactttgtaaatataagttggaactagtacctgcacgagaacaacaaaatgtccgattctttattatggtggaatctttcacataatggtaactgcttcttcgaatgctaaaacccatgtctcgagcataggcattatagaaatcatatgcctcttgttcactgttgaatttcataccaatgattggtgccttccctttggagggatctgcttgtggagtagcttcaattttactaggatcctgattaatatacccgttttttatttgagacaaattagaaaagaagaaaaactttcatgaaacttacagaaaaaaagggctaatagaaaagaagcaaaacttctatgagatttactgaacggagatatgatgtgcttgtagtgatcaagtctcaatgattactaataaaagaaagtgaaaacattatgaagtcttactgtctctaattccccttccaggttaccatgaaagcttgtccctggatgatgcagtacaaacgttccagcagaggcagctggttccgtcggcatggttgtcacttgttcatgcagtgaatcggtgaccttgattgaccttggaagattagatagagaggccattgttgttgcgaagaagatgattgtgatccgataataatgtgccatatgtaaagcttaatctattttctgaaaaactgtctaatggtttggcgccttaatttttatttggcgcctttgtttccctggagggccacgctaattaggattaatcgctaactgcgtaatctggtaattgacggagagaataatcatgtaatctccgtttatggtggggccacacaaaaagaatcgacaaacggatgccctccacatggtacggaacacggatagaaacacaacaacggaacagtgaagccgcagccgagaagagtggaggaagatgagatgttggatgacatatgggcctggctttttcttattttatggatgacgggactgctagataagcagatgaatagcctgacattttcttatttcagccctgtctagttcaccccaactatcccaaacttctaactttccatcacatcacatcatatctaaaatttttttacacatataaactttcaacttttttttcaaacttccaactttccctaaacttctaattttttttaggaactaaacatagccttcgtagatgattggactggtatttaggcgaagagccaaagaggccttcatcaactacccagcaaagacattaatcaactggtactggctagaagagttgaaggggtcttaagttgtgttcggcacagaaagttttctgctaaatggtgagtttttttttcaaaagaaaaatcgataggaaagttgctttgctaatccattttcaatcttttagctaatacttaattagtcatcattaattagtcatcagctaatgagtcacttcattttgtgtgcacgggctaattagtcaacagcacgtacgcattctaaaatagtcgtgagaaatgagtgacttcatattctaattaaaatacttatttaagcctatcttagccgttgggaccagattatggccctctttgtttaggcttaaatttattggcttagacttttaagtcagcttattggcttataagatgtatttaatgtcctaaatttaatggtggagtcatgcatctacctcacataaaccaaaaaatcttatccaacctaacttttggcttaatagtgttagagtggcttatggcttcaaaaaagccaaacgagaaagctgtttgtttatttaggcttagacttttcatcttataaattgacttataagcctaaacaaagagagcctatatacagtatatttaagcatcactttccttttctttcgtatgcctctccgccccacctcagcctatgttaggccattcccaacccaatgactaggatggagtcatggagtctatagcattaaataagctgccacctaaaatgaaaaatgatgtggcaagtgaataaatgaggaaagagaatgaaaccatgtcttgcatgagacttggtttctacacgatatccaaaacatcatgtgagataagtagcattaaatttaagtatagaatagtggtgtttgcattggaagagtagtgtctagtactagtttcttgatgatgtggagtttatggaaactatgtctagtatcttgggttgggaatggccttagcatgtgcagatgtgcttcattgtagagctctgcatgcaattagaaagtatgcatgcatgctaaacatggttggtttaatttttttggcaacttcatactattttttctcctaaattacttctccaaactatgatccaattacactattaaatttgttgctattaattttttacaacaagaccacatgtttcgatgaaaaaaaggtatttagctttgttaattcttttaaatgttgcacgtggattaatttaaatgtttcaataagtattttagaatgtttgactagttaatttacaaatgttgtacggtgctctttgaatatttcggcaaatattgtgtaatgtctctatagttacaacttaatgttcctacatgataaaacatgttcaatataaagtttttcaaatatatcatatgtcccccatgattctttttatgttttactcgttgggactcaatgcttcatatattggttgactatttttaaatgttgcatatctctgaaagtgaattaaaaacaatattttacaagtggtgaaacaatgttcgatttttttttatcaaaatataatcatgtgatatcatgttataaagattgaattataagtaatataacactgtaatcggataatagaccaaataaatattttaagaaaaaaatcaaaagaaaggaaaatgtgtaaatgtacctgcaaagaccttgctgcagacatgcatgggcacattgacatgcacttagggatgaaactggttcggatagtttccgtccgtctggaccaattttcggattcggaaaaattcggtcggaactatccggaatttctcggattcggaaacgtattcggatttttttctcgcatacgaaaacgaatacagtaaggtgatatccaacggaatcggaaaacggtcggaaactatccgggatttttcatcggatatccggagatatttttcagcaaaaaaaataaaaagaaacccagaaaccctagccggctagccggccgggccagctgcccgctgccgccgcccggcgccgcccgccgtgtgagcccaccagcaggctctgccgcccaccgccgcgcggtgcgccgctcgagcccgcctgccgcgcggcgcaccgctctcggccgatcgccgcctgccccgccccgcgttggctcatccggccgccgcccgccttgtgccctgtggtgtgtggatgagaggaagtgagagagagagagagagtagaaagtgtgtgtgagagagaggagaggaagagtcaagaggataaggttggggtgaaaaaaaattggtggattttttttcaatgtaaaaatcaatttttattttatatgtggctctttaaaatgaatttaaaggcactaaatcaactcatttgaaaaaagttgttaaaaacaaagttgtataacttattgagatctatcatttttattttggtcatttctccgtccgagtttgattaaattatataaaaatttgaatttaaaaatataagaaattcaaataatttttcgggtagtaaatgatttcaaatgaaaaaattgtcaacaacaaagttctataacgcatcaacatgtacaacttttgttttggtcatttttctatatgactttgtttgaaccgtttgaatttgaatttcaaatctatatgactttgtttgaaccgtttgaatttgaatttcaaaatatgacaacttcaaataatattttgaaatactaaatgatttcaactgaaaaagtcatcgacaacaaagttgtataactcatcaagatctataacttttattttggtcatttcttcatccaacaaagtgatagtaatattgttaacaaaatctacatctatcttatttggttctataaactataagagagatatgtaaactttgtgaacaatattactatcactttattagataaagaaatgaccaaaataaaagttgtatgtgttgatgagctctacaacttttatgttcatgactttttcagctgaaaataattacagcttcaaaatattatttgaagttttgaaattcaaatttttaattgataaaacaaagtcacaagaaaaaaatggccaaaataatagcggtaagaacacaataacatgataaagcatgattttagaaacatttaggaaaaagaatcatctaatttagagttcatatgagtgagataaattagtttcaaatttccaaattttatttttgcatacggcttcttaagtcccttaaatggtccacatacaaacaaatgaaaaaaattcaattctgaaaaataaccactcaaatttttaaaaactttcaattgaaatgttcaacccaaaatttaaaatattcaaccaattttcaaaaatttcaatgtgcctacgaaaatttcggtgatacacattaatttatttgtttcatgataacataaatttatatggaaagtaaacataacattttctatctcccccttgcccttataaatagagataaaatttgaaaataatgatgttttgatggctacatctctttctcgttttaagaagcttattttgaggggtcttcatattttgataattattcgttatcgtattcgtttcgattcgtattcgctccgtatctgtattcgataatattcgattccgttttcgtatccgggtttccgattctgatttcgattccgagaaaaaatatgaaaacgaatatgatagagctagtttccgaccgtattcgattcgttttcatccctacatgcactggatatagtttgatcaatagcctaacatgcattcagccacatcatttagaaataagagctagccattggatcatttccatgttttaatcacaaccattcattttgtacctattattcctcattaattagtatataagtcagaataaaatgttattgccataaataagttacactatcaccatctttggcaccattgcataacactttttcatctcagcctatatatactcataactatattttgaaaatttataactgtattgcagctgcacctcgcggggtgtcatctactatcagaaaataagaaaagaagagagaggaggagttaggcgtgagttgggcatccgatttaagaaaaagtgcattttgactcccttaacgtaggacaaatctaattcgtactctttgaccagaaaattggataggacgactccttcaattattaaaactggtgtaatttgactctcttagtggttacggaaaacagttttgctgacgtggccctgtgacccggtccaatcggcggactcaacatgtgggacccatatgtcagtgtcatattttcttctcccctctttcttttctcattttctcccctttttcttcagggcggtggtcggtggtctgcgaggagaggagcgaagtggcgagagggtctcgacatgatgtgctcgagcagcacgtcggcatcggcgggcagtgggtgtagtacacagcgaccgacggcggcgacccgctcggcgtggccggcgtgcatagcatgtacatgtcggaaggaggtggggacgggattcgcgacgggttcctcgggcggttcctacttggggagggtggccaaatttacatattaagaaaaatatcattacaatttgtctatttgtagccatgtcactaaaattttacaaaattagaaccgtgccactgccgttacttttcccatccttctccatctttctccgtcttcttccttctcgcttccgtcttctctctccatctctctgctgtcatgcctctgtcgcgcctcatcgtggaggacgagaaccgcacagccatcggcgtgctcggcgccatcccgccacgctgacggagtagcggacgtgtggagcggtggcagtagcaagagagacggcgctgacggcgcgtgaagcgagccatctcccgcagtgaggcgagatcggaggagagagagcttgccggcgacccaaccatggcaggcggcggcggcgcatggcagctccgctttctcctctccctcctcttccggatttggcggcaaaacccaagcgggtgaaatccccaaatcccctgtctcctccttctccgccaccacatggatccagctgttggcttgccgatctggtggtgggggcaacctcctccacagcaacgaccatcctcctccgccacctcgacaccgccaccgtgctctggcctgcctcccgcacccccggcttcctcgacggtgatggcttcgtcctcttctccatgggcggcaccatagccgccgctgtcctccaccgcatcgacgctgccaccgcactctgcgctctggcctgcctcccgcgctcccggccttctcggaggtgatggcttcgtcctcttctccatgggcggcgccatcgctgccgccgtcttccgccacctcgactccgccaccacgctcttgcctgcctcctacgccggtgaggattgaaggcgacggcaccacgtgcggcggtgaggacggaacgaaggaagaagacaaaaaaaaatgtaggggatggataaaaaacatcacggcagtggcacggttttaattttataaaatttcaatatcacgattatgaatagacaaattataatgatatttttctaaatatataggaaaaaattacaattgcaggaatccaattaacgaattaaatttgaaaatatactgttgattagttttttttctcagaaatatttgggatgtaaatttttttttggcagaaatatactatcagtctcgcacaaccgttacgcgaaaatgacgtgagcatgatgatacagacgttctcacacgaggaaaacgcgagactttgcagtatcgcgtaacgacgtcacgagaccgtgcggtgtcgcgcaacggaaaacgaaaccacgcgtcctcgggcgcacggagaagccacatcacaagcgcgtgagcgaacggcttgcttagaaagtagccgcattattagtgattaattaataataattagtaattaatgaggttgattagcgattaattaatcgataattaagccattcggtctcgctccttctcgctatttcctcgcggtctcgcgttttcttcgtgcgagatcgtccatatcatcatgcccacgtcattctcacgtgactgttgtgcgagaccgatagtatatttctaccaaaaatttacggcccgaatatttacgagaaaaaaacaaattaaaagtatatttgcaaatttaattctccaattaataacccagataataatacagttccattcctattgggctcatgaggcctgttatgtcggtggcccacgtgaggaacgccggcctgcacgccgcacctctccctcttcaggcgtttccatccatacaccatacccacccacactactgcccctcattccctctatagatggccatatggcccgaggcccacggcccggcacgaagcccgcaattttggcccggcccaagcacagcccggcccgactagggtcgtgcccgtgccggcccggcccgacagccgggccgtgcctgggctgcaccctcggcacggtgggccggcccggtacggcccaatcaaataaaaaaatacagggatgaaaaatagacttatataatcgtataaggcatggcccaagacaataggtatacaaaatagacttattatccagccatttaaacacagcccacagagttgagggaccaaaaatagacttatttccagccatttaaacacagccactgagttgacggaccaaatatagactttttttgtgaggcagcacaatagcccatcataccttggggccggcccggcaaaccccgagtagtattgggccgtgcctgggccgtgtatgccacccgtgggctggcacggcacggcccggtgagtcggtcgagccgtgccggcccgacaagcctcggcccaggcacggccgggcttgggccgtgccgtgccaggcggcccagatggccatctataattccctccctctcttgtcctcatgcacgaccacgaggaggcgaccgccgccgcacctctcctcctcttccacgacgaggcgccggtctcgccggcggagcccagcatcgccggcagatccacgtcgagcatcgcggcaggagcaggacagggagaggccgaggacacagcgaaaggggatcgatcgatcgatcgatctagggttttttgagctccgccacccgccccctccttcccgatggagaccccctccgctcccgctcccggggatggaaactcggctcccgcatcatctcgggtgacgtttgaggatatgcttcgcagctgcgatcagagttattatcaaatgctcgggttccctgacgctgcttcctacttcgaggcaaaggagcgggtaggtacccagattatcccttctccgtatggatcgatcgatcgatcgaccgaattgcaatatcttcccttcagacattcatttggctcactggttatgcaatcattttgcgactaactataaatatggcgacatgttttttggggaaaaaatactagtctgttgctgataacaggtcggcaacacagcaaagagacatatttggttggcaaaacagttagattaaatttcctgcaacatataatatttagcaagaatataacctagactagatcggtggtaagaattcatatgaacaagctccaatcaaatttcaaatttttattatctatctatataaaagttacatcagagttacagtgcaattacaatgtaactttgttgtaattatatataattatggtgtcattgtgctgtaattttaaccaaacaaaaagcaagctagtgctagctgtctgttcccggtgtaaaatgttgatttagctacctgtttcacactgctacatgcagggcccttatggagtgtagaaaactagtgttgtcttctttagttggatagaagcatgaatcataacacagatcaaacggtcaaacaacttactgtgattaagcaaaaaatctgttgacacaactatagcaactccaatgatttttggcttcctttgtagaatttgttgggtcagtatattgattacgcaatgtttctttttgggcttcctttgtagaatttttgggtctgtactgattatgcactgttttcttggcttcctttgtagaatttgttggctcagtactcgcgtcaggtattccctctgctatggcctatactggagaaggatagcctcacgcgcttcaatcgactttgccaagggtggtcgcgcttgatgggccttcgtggtttcatttacccggagattctcagctccattgtcgccaacaacgctttgcgctgtgccagagtggccctgcaaggcagctctccgttgcgcggacgtcgtgccgatcccaacggcctccatccttatggctacacggctctccacctggccgctgagacgttcagcgtcgaaatggtcaagctcctcctccgccacggtgcgtcagcaaaccaccgcactgagggcgactacgtcattgagggcctcctgcctcttcacgtcgctgttgagaatgccagcatgcacaaatacctggaggacaattgggctgatggccactctcctaacaacctcatatctctcctctgtctgccagagatggttagtgtgcatctactataataatttatcgcgaacatccatcaagctaccactattttgtttcttttagtctgcttacatttacttcatatgccattactctcgccgttttgttcagttaactatgtccatgaatgcttacatgtaaggcaaaaattatttactagtggtagggtagctaccgccatgcctcatttgttaagtgaactttatctgatttcaagatttttttaaaatcttgtgcataactaagcccaatcatttctccttatttgttgcatgcatccatcgaaacttgtttacagatttttcatgttgcctcccatttgcagaagatgtatttggacacaactagattaattgcccaacatacgcataacattgtcgatgagttgtgggattacatcgataagaagaagtttgtccagttagcaattttgctgctggcttctcagaagcagctccatggccccataaataggagccgtggcaaggctaatctgaatgggtttgaatctattagacggcgcacttatgaagctatcagtggcctacatctccagatgatagctatggtgaatgaggggaaaaatggcagtgcgcttaagaagctgaaagagaagaaggaagcccttcttacagcagacgcactagttggtattatagacaaagctggtcaagatcttgaggattatattcagactaactcagaggtagttcctaaatgatacccccctttgtgatactaatgagttttcattttctatttttatgtatgcttcaaatttctgtgatgttgtgcatgcatgacttcgttctgctagggatgctccaattagtaaaatgctttcttttgtgacttgtcaacagtaggagagattcctatgcagtttaccatctagtcatcatcccataaaaaagaactaaacatatctttacataaa

SEQ ID NO: 20854 - DNA, 4958 bp, Oryza sativa
cagtagaatatttttttttaaaaaaaatgtgttcaatttgtaacttagtaactatttttattgatataggataattctttttgtcacaatgtagttcttttgtcagtcatctaaaaattaactaatacaatttaggggtaatttcgttcatacccttgttttgatgttcaatatcgattttatcctcattttttagggttttcatttttacccctgtttttttgaaacgaagttttattttacccctactctggatggtcaagttaacaaaatgacatttataccctcagttgtggttgcacatttgccccaatatttattcattaattctgtttttaccctggtttggaacatgattttggttcggaacataatttcgaaactcaaatgattttgacaaacttttactaatacatatgaatgaatgaacaatttgtagcccaccgtatgcaccaatatgtacaggcagaaatcacaatggatcctagacagaagtgattctgttctgcaaaataggggcaagaacgaaattatccctacaatttaagatcactttcatgggctgtgtttgaaatgtgtactgcaggaaatgtaaaaaggggtaaatgcctaggaataggcctaacatttgaagatctatttggatcacatgttttattttgggcgagtgaaacacctgatagttgttcatatggccaatagctaaacaaaaagaagtttcattaaaaaaatggagaattttgggatccatttggaagggaagatacataaagagtggtagataggaatctcatactatctttcctgtaaaattcctttggaatgcaagaacaacaaagaaaaccaagatagtaagagcgccaagaacatgcgatgattctagagcttcctcacacataggatcactactgcctatcacatcatgaagtgcctgtgaccacttaatcattaatcattctatcactgtcatggttggcactgctgttgccattcatggtggtggttgtgatggaagtaatgggatgacggagagtagtagcctggttggtttaggcagccccaactttccatcaccttttttttataaaaaaatgttttctaatttattgtctctcagtgtcagatgtgtgcaaagtggcccttgtagaggggactaggggtgaatatattttctgccctgtcgtggtgtgaaaacgggggtgagatgcgtgttgtgagatgtttgtgttttgtgttttggggtgttccaaagggtcctcgtgtgttttagaaaaaaaagatatattttcttgggctatttccgcgaatattcacagcaaacacagccagtaggctactagcagtggtgcagccaggaaccagtcatagaactgcccttgcctactagcgcgaagtagtagtgtataccatgttgagaaatctaaagtagtgaaaatactaaagtttttcaccaccacaaagcgccaggtcatcggatatttaggaccgtcggatgcagccacgaattcaaccgctgccatcagatctgaagtgaagaggagtgcaaaatcctggtgaatggtagaatactccagagtctggccaaccaataatagaagccacaccaccatgtatatataagaatcactgagtgctccaccaaaaaagaacgcaaaacccagtgaacaaaagaaaaaaaaacaacacatccattggagtaggtgaaaaaggtacaaaaagaaaaaaagaacgcaaaacccatctccctaaacgcatccattccaccactgcctgcccacctcctcgcctcctcctcacctcttcccccattgctgttgcctcctccgccgtgcgcactcgccctctccatatccccgtcgccgcagcaagcccaccacctcagatcctccccatcccctccggtaaagttcctcatcctcctagtgcccgtgacagcctcctagtccccagccccatgccgtcgccttctcctctctacccccggcgtcttttcccctctctgcacccggcatctcttcctcgcacagtccaccgcctcctcccccattgacgctaaagccttgagctacgcgctttctcatccccatcccaatcacagctccagaaaatatcgaggttcacaacggtagatcaaggcgggcaacgataaatcggatcgcagcttccagtcacccctcgtcaacgggatcaacacgtcaataacccttggtatttggtgagtcacaaacttagtaaatcccatcgcctcctatctttgccttcccaagctgtagccaggaaccagttggggtcaataaagaacagtgatgggatggattgatgaagagcaatgttataataatatattagaaagcacatgtccaactgtgtttcgtaaaaaaaaaaggattgttcctgtgttttgttcagcaagggaatattaatgtgataagctgatagccaactcaaatgatttttttttcatggacaatagggtctttttaattttttttgccttctgagttctgaagctgaaagccaagcgcaacagttcatggtcaccatgtgacaataggccctctggtgtgtccttgaagcctgagggcacgttaaccttaacctgtttaagtacaaaaaaatttaggttctacttgatatatctttaaagccaacatcgatagcacctgtttaattgtacaccaatcacctgaatactggagtttctgactctgcatttagcctatgtaaatgtcaatcatatattgcaaactgtttatgcacatgtcaatataggattttagcgtgaatttgagaaacaaaatgtaaatgactgcatctgtaattactacatactaggtacttctgcatttttggcttgcaatatgctgaccacaaatggttgtcaagcctgaaatttatgatgactttcttcactcattctgatagagcttctttgatagaagaagttatatcttcttactctttaagattctagatattcctaccctcaacagcatatttcttcttactctttacgattatagatatccgtaccctgtttaacctttacgatattatatacactttgcaccagcgtatacatatatcttaaatagaccatcacatactaattttacaggtcatcatggtcgtgccacgcgcgacctacgtggctagtgttatttgaagttatgaactcagtaccatggcaaacaatgttcttaaggtggcggcgcctaggcaacaatgcactcccagcgcgatgtagagctgcaggagattcagaaaggtcaatcttgtgttatcaatctatataaaactgatggtcaaatgttaaaagagttggacttaggacaaacctagatggacttatatttgtggtaagaatttagtacttagaagacgatctttgtgtttttactgtgctgtactgtttgtcttgagagatgttctgttcaagggttattatgtgccatgcagccaccaccacccttgaaatgtatctgtataattgttggaataatgtcttgaacatttttttagtgacttacaaatattttgatgaaacgtaggtaaaccatgaggaggtccttgaacacgtttcatcaattctaaacagcaagggcattgttccttctgggaaagggatagacactgcagaccttaaatggtatgtcatctattagcttcaccttcacttatattcattccgtatcttctaaagcacatccgacatatagttgatgaggcgttcttttcctaaaatattccttcttgttttgaagctaccgatatcctgggcaaacatcaattaatatgtcacattcacgaggtttgttacttcttggttgattttatttcttaatactagaaaagagaaaaatttatacttccacctgttgtttgtggtgatgcactactttccaatattgcagtataaaaaacctgatcttatccagtaaaaaaagggggtgcaacgtaatgtaaagtgaatcaaaactgactggaccaccactctgctgctgaccgacaagtatcagctgtggtgctcgtaatattgtctgcagattcttttttttattcatgtatgtattgctgctgccaagatgcaaggacaacgattttcctccatatcgctaacacccataacaatcttagccattgcctattgattagatttctggctatgattaactttctgttcctttacactgtgcctttattgaatatagttgacccctaaccaattcctttattgaatataatggacactgggggaactaatgaagctgacaagtcatatacccttaatgctgaaggttgtaaaagggtaaggtgatactttactaaattggaattgtggattatctttcttttcccatgtcaaaaatatgtttacttcaacaaacatataattgctatgccgtttttttgcaagtacttgacagcaaaagcctttcagttttgttgaaaaaaaaagttttagtctgatcactgtaacttcttgtgatcctccaaatggcaccgtcaattcttatcttagttgttcaagtacagtagtgttgtagtctactcccttcgtttcacaatgcaagtcattctagcatttcccacattcatattgatgttaatgaatttattaacatcaatatgacttgcatttgtaatctgttgagtctaatttgtacttatagatatttatagtggcattattcttctgaagtaacatatcctatcaacttggtcgattaaatatttaaggtggtatttgatataaattaaataaacataacacgtaacctctagttgccgccatgctgtttaacaagttaccatgtatactcattgcttcccaggtgtttgttgtttatacattcagatgctacgtctcatgtaaacagatcccttcaaagcgaccatctaaactactggtcctaaaagaagcgagagataagttctttccatactggaaatcggtg

SEQ ID NO: 20855 - DNA, 5653 bp, Oryza sativa
tatgaatgcaggaggcagctttgtgctcttgctgcgatgtctcttaaggtgttgaggcgcacgtgagtgaatctatatggtaatatacctgttaaaatactccttttttaggctactgcatgatcgtttcttttgttatagaatcttttatgctcaatgttgctataatctttgtgcaggcttggtaaagacgaaagtatcggcggcatgagagtagctgtgctagaatctgtgttcgtgttcttttgaccttcgtggccgtgttatattaacatgtatgtacttgtcatgaaaataagatatatatataccagatgtaatgtatttcaggcttgatgcaacctggtaacttggtaagatttctagctgaacacattgtgctatctttgggagtgccttaattttatgattaaatgctgtggtgccttgtgcaatgtgaagatcgatttaggttttactgaagtatttatatagtggcgctgcgaattgttgtatttagtgtagtcgctagtctcctgtaacatagctatagaatgggtatggctgcttggctatttggcctttgggaagaaagcacatactctcgtactggggacgtggagtatatgctatgtgacgtcagaaaatgtattattacagcatacgctactaagtacggtatttcgcagtctacttggcaggcagtattagcaggtctcgtggacgatccgcactagctcccatgtattgaaatgtggcacattagctttgatcccatctactaattggctctattgatttgcgtgcacacatgacgcacgtacacgtacccatgcatgcatgcatgcatcctaattaattagttagttaatgcatgcatcatcctagctaattagtaattagttatatgtatgcatgcatatagccgaacttaattagttactactaggatgttaatgattcagctatatgtgatgtatgtgtatgcccgccgatgcgatgcatggtcgcgcatccgacgatccgctccggccgcctcctaactccaccgatttcctttcctccaacccaccggccgtcttcttttgtttgtttggttagcttaattagtccctcaacctcaagagacgcggaattaatccctctcaagttacttcttgacaggtaaatatgtattaatgttctctaatcatccttaatctctatctagctattattataggaaaagaagctggatccctaccacctcaaccgcaaccgcaccggtgtggtcgtcacgtctgtcggagtcggagcccaagttgcattggtgcgaccgcgagtccgaccgacgcactaatcttgcggcgaatgaccggggaaaaaaaataaaatcaaaaagaaaaaagaagcgcaaaaacctactactactactacttccctcactccagagtccagaggcaaaaaccctctccgccgtctcgagagcaccgctgcggaggaggaaagccggggagccggggaggtggggggacgcggcggcggcgctctctcccggcccccgctgcgcatcttcgcgcgcggcgtctctagctctccccccggcccgcccggcgcccatcttcgcctccgccggtacgcatcttctcgaccttgaggcctctccccctctcctctcccattctcgagggttttattttgccatgttgccttgcctgcgcggttactggccgagagtttcttggtgacgaaatcttttggctttttgatgggtacggttctgtctgtgcgcggggaacttcacaatttctgggccggtggggaataatatatgactagttataacacaggtcttatgtctcttttcttatgacacattgtggatctatgtatgacaccattatggatgcactaagtagtttattaaatgcattgcttatttgtcagtcttgctaatttatttctttattattattttttttttgaaaagagggctttgcctcgtatatatagatagagaatcgggctaatttaattgtaaatgctgttaatttgcagccatgttacttcgacaagtgaatcaaaaatcatggaatcttctgaagcaacatagccgtccagtgtgccttcacttctcttctgatagttcggccaattcaacggctaatattgatcttgatgctgaagctatctgtatgaatcctttgaagccttactctaagtgttggttttatgtgcccccgtggatcaacttgccgcccataaataaggataatgatattaagaagttgattagttctaatccttcaacagtaatgaaagcttatgagactagcaagttagaaatgttgtttgagaagaaagttcgctcctttcttgtttcaaggtgtattctggcttgcgaatctataaatggtcctgacatcaagaaactgcattttatgaacaagagtatcattggccactttcctgtctatgtgacctctctctctttgatgaagtgtttgatcaaacatcgtgaagaatactggattgcaatccttcaatcacttgcagcagagaaggtgatggtattacctgactggaaacaagaattaactcctatcgaggtttcgttcttcgatcatggactacagttgccatccaagtctgaaacatcccttgacttaattacttgcgaactagaatctgatgcgtcatactacaaggtcccagacagtgaagcaacaaatccagacgtagcaggaggacaagaagcagccataacaactactgaaggatcagcatcagcagaagtgggaatggcaacaattgcctcgattatttggaacaatagagcgattttagaaggccgaattacatgtgggcttcgttgtgaggattctgagcacgcagaagcaattgggattttaagcggacttcaactagcaagaaaattgaagataaaaaagatagatgttgtaactgataatatggaaatctatgaggttctgattggcagaaaggatgtgtttcagcacaagcatcgtgatgttttgttgatggctattgaagtagctaaagaattcgatgtttgtaggtttaggtgggaacctcgagaattgctgtgccttgtgaatgaaatggcaaatgcaacaagagaagattaccgggcaaaaacattgagcttgagaagaatttgggagggcaaagtagcatattgtctgtggagtttaccggtcattcgtataaaccaatcaacaaagaagattgcactaaaactaggtatgtcaatgtactatatgcaatttatgttgtttgttgcagtttgcaatttatgtactgcaccatatgtactgtattttttcctgttgcactttgcaccagtggtggacccaggatttttatcctgggtgtgcccatgtcacgagcaaaatcaaagccttcacacataaataaggttttagtttatcaaaaagtttagcacaaatagttgttattttggtgttgaaccaacagtgcatccttagatggaactaaacaaaactggaacaacacaaattacaatttattcctattttcttccgatattattcttccctgttctgaatttcctcatcaccttcacagaagggaaaccctggacatagcattggtgatgtagaacgagtacagtatagaaagagttaatgcctatgctcctcttcatagttgactgattcaatttgacctaatcctacaaatcacggaacatgccttcactgatttggcatttcagttttcaattgaaaatatagccgtctagagaagcaggacgagaaattttgaaacttcagatatatatttttttcagtttttcaattaatctcttccactgccaaaggagaaagagcatacatgcacggctggaccttggtcgccacgggcagcctcctagtcctcgttgccttgctgattaccgtgcgatccaccagcgggaacgcatgcacacgccaccatacaatcttttggtgagctatgcgagaatcatggcattgggccttgatctgtctacttctcgatgaaacaagttacacatccattttttaggccaactaaagcatagttagatcctaaaattttttcgtaacttttgggtacccggcaccacctaggtctgcccctactttgcactaacactttgttttttttatatatgtagaaaaaggctgggctggggaggttaatatgaagttggttcaatcaaaagggtatcatgtgaacgttcgagaacaaatgcttaaaattgatgcattggagggattacttgacagtctggaccctccactgttaattgtattagtaggatcagaagaggctgcaagtaaagtctcacttgagctgaactggaggtttcgttccgttctgttgaggggatctggtcaagttagtggttccataagcaatgcaaatggtgactgcagtcctattccagagggtacagctcttgttctgaatagtgaaactaatatcccaccattttctgcacaaaaggtccttctagtagtttatgacacgccatcaagtgaactacagttcagtaaagatcaagataccacaggagttatcacagtcagaatcgtcgctcctcacgaggaagattctcttccagatacctcgactgaggtcaatcctttcgttttggggttctttaactcaggtacatattttcttcgcttgaatctgcattttggttctttactaaatgttatatttgtgtatcccacttgcaagttattcacttgaatctgcatttcggttgtctttactaaatgttatatttgtgtattccacttgcaagaaattaatacatgtaaaaccatgcagctaaaacaaaagcacacaggaaggaaaagacatcaaataaatcctttggagaaatttggtcaacgtgggaagatagaaaaggctgatgactctgttgtcttcaattcgatgccctttacatgctcttcaatatgcttgcttctttttggggggaattttaactatttgccacttttctgtttgctaattattcaaataccccttttaggtttgtactttaatctgtcattggagagagaagaattcttaattttatgctacttttgcttatgtggcgggacaaattagattggcagcttggatgtatggtgtgaaatgtctagacctcacccgtcatttatctatctctcttctctccggtccggtgtacggaccacgagcccacgaccgatccatggtggggcggtaggtcgttgtggcacatcctgacgcgatggccgctccatacttgtagcccaggattcaaacatacttgcagccaagaaatagtccgaatgaaatcaatcgcaaagagacaacaatagtacgtaatatcgaagggaacagccgatgaaaccatgatacaaacgagcatatcgttcagaaaagaagcgatatatgcaagaacatctcaaatcagagagcacgcacgcaatggatttgtacatggatagaagaagatcgatggatggatgtgttttaccggaggaaaggatattacggagcgatctgccagggatggagcggccgtccgtcgtgccgcatcggcgcatgcgctgctgcgccaggctgtgccatagcgccgcctgccccagcaggagtgcaggacgccaccgctcccccgcgcttcgtccggcgcccgtacgctgga

SEQ ID NO: 20856 - DNA, 4758 bp, Oryza sativa
attcctgcagcccgcatatcacgagggccttcaatcggacctgacgaaaccaccgacaccataagacgtcggctgagtccaaggggtgcacctggggcgaagaccgaaggattcgccaccaaggtcaccatccggccaagtcgctacctcgactcagcaagcagcggcttcgaccacgctcaactctactcaagaaggcgttgacctcgaagcacaagccgaagcagaggtgggtgcgatgcgccaaaacatgaataagctgcaagacatgcttcgccaaatgcaagagcagcatcaagcgcacgaggcagctaggcaagtcaagtaagtttcggcagcccccccatccatcttcgatagcgatgatcgtcgcccaagctccagctacccaccaagctttcggccaagctgtccctcctcatgtggcgcaggcattgagcatgattaggcaggccaaccaagctccgacgtacgttgccaagaccgctccgaccgtcactgcacggccaacccctcacaccaccatggcgccagtacggccagcggcgatgcaagtacagccagcgaaactagtccaaatgccgcataccacgatggaaacaacttcggccctacaagcgcaacttcaagcttttcttcaacaactcaaccaaccccacaccattccaagaccagcccctttggcgcacgccatcgggagctcaagtctggcaaccatcaagtcagttcggcgccgtgcaccaggcgaaccaacaaggacaaggggcattgacctggcagcaggcgccgcacttcgaacagaatgccgcggtccaagcaccttcgactgaccttcaagggatgatcgccggtatcaacaccacgcaacaagcgaaccagccaaatcagggcgccatgacttgggcccacgtaccacagttcgacccaagcatggcggtccaagcggtttcatcagatctgcgtggaacgctgtccagaaccgggccccagccgaactcaatggcacatcatcacatgcaacagcgatggcttcgccattcgtggctccgtatcaaagcttgaactcacctttccagcaaggcatgatgacaagggctggggacgaaaagaagctgccactaagctgggggctcaagaatcatcccattcccccagttcaagtacccacccgttgcaagatactcaggcgaaacagatccaagcgagttcttgttgatctacaagtctgcaatcgaagcagctcatggcgacgaaaacaccaaggcgaaggtaatacatcttgcgcttgatggaatcgtccgctcttggtatttcaatttgacctctaatatcatttactcatggaagcaacttcgtgatattttcattcttaacttccgaggtatctatgaggagccgaagacccaacaagacctctttggcattcgccaaaagccaggcgaatcaacaagggagtacgtgcgacgtttttcgcaagcacgatgccaggtgcaagacatctcggaggcatccgtcatcaatgctgcttcggcaggcctcctcccaagcgaattgacaagaaaaatagcaagaaaggagccacaaactgtcgagcacctgtttcgcatcgttgatggctatgcgtggggcgaataagacacaaagcaaaggcttgaaattcaagctgactatgacaaggccgccactgccacggctgcgcaagcgacggcgcaagcagccagagccgtgcctatagcaaatcgctagttgcagctggtgaatcaagcgccgctcccaagacccagccaagatcccatgacttggaaaaagttcagaaccgaacgcggaaaggcagtgatggcggtcgaagaggttcaaactctccgaaaggagttcgacatagatacatgctgtcactatcaatggcccacctctactgtcccgtagcatatatgcccagataatgatacttaataatctagacaccacgtctacattattaaatattactctatatcctctggaatgacatggagcaaccgaataatcggacattaaacccataccattgcacctctctggtaagctagctacacaactaatacgacacaaatataacataaagccgatacttagataaagtaaagtaccgagagtatataaagaagaatattctattaattccgaaaatcttacaaaagaggaaagtagaactactaaagccatacctgaactcctccgaagacttcgaggattccgagagctattctattctactccacttagcactagagcactaaactaaagtatggagagatcttgagcttgcttgagtgtgtgagggagtgaatgaggcctcctccttttataggcaggtaattacggttacttctatacaaattgtccaaactacctcgcaactgtcattgggaagcaatcaggatcgtccacgtgggacgccaagataagaggagctagtcagggttcgccgaacctaggctggcccaacaggcctccagcttcggtagggtcactgacaggtgggtccttatgacggttatggtagtttttgtggtttccaggacggttacacctgacatgtggacccatattatcctttagcttgattaggagtgagttttcctcattttttcgtttattttatttgctcaattctagcaacaaataatactacaagtacaagtggaaatatactattctaaaacaaatatgcattataagcataactagttcttctttattttagttatattgacgatcgaaattggtctataacgaccgtcaacaacctcctagcctctccttcggttgggaggctgcaccaacatcttgtacctttgttgggctcaatcctatgattttgattaacatctgggcccttcaatccatgtaaatgcgtcccaattttttgtaggtgtattttcgttgcatgacggatgcattgtctccttaattgacatgcatacatagatttactaaaactagtgaaaatggttagttgtaaatcccagtcactaagatttgatactatattttatatttcttatgtaggagttgatggttaaagtttgtacttaacgaccgtcaacaacacctccacacttatcttttactcgtccctgagtaaagctcatggatctactacagttatggctttctgtccaatgatatgatacacaaaatattccaagacatacctgtgtatttgaaccttgatgtgtctaccatgtcatcttgattgaagaatgaaacggtcatcgactcaagtcagctttactccttctgatgaattaccctggggttttctttggtgcttgtttaggatgaaaaataacgtccgagatctctctctatttagagagatatgtgtgtgtgggtgtgccaatgtacctaaatacaccataaacaacacatagggaacatgcactttattaatctcgaggatcataaatacaaaatctcatgtaatgatacacgctacatagtccgtcattggacatatccgaattgtgcgatgtggtcttcctggttcctagggcctcgataagctcccatttaattacctccgcaggcgaaggcctacagcaggacctcggattaagctgcttgtggtcatcttgtcgtcttcgtttcacaatctccatgcatgattttggtggtgtagatgtgggcgccggcaacgatccacaacctcgtcggtccgtgcaccggtgttggtgacatagccttcgcatcggcttcactcgccctcgtctagtctcgccggtcttgagcgatgtgttggtgtagattgcttgaataagacatacatggattcgcgtagcttggatggcttgacgtcatagaagttcactactacaaaacatcaaataggtgttggcactataggtgccggagtgctaaaaccggcaccaataggccttttcccacctctgtgggttgaaatcgcaaaaaagggcacctttaaccaattataggtgtcggttctaaataaaaacctacacctattctatatgagtcggttttttaaaaaaatcggaacctttactataaaaactggcaccaataataaattataggtgctgtttttttttctaaaaaaggcacctacgaattgagccgagccgattggccccaccacgacgcgtcgaggagataaggtctgctcgctcgttcgaactctctcttctcctcttgatctctcttgttctctccgctctctctcgcccctctatctcgctcgctggtctaggcggcggcctggtggagcggcggtggcggcggcccggcggcgacgccctccccaccattctctctctcttagtggcctggcggaggtggtggcggcccggtggtggcggcggcggccgttgacgtgccctcccctcctccagatccagtgggagggaaggcggcgacagctcagcgactcggcggctgcgcccttcctcggctagatctagagggaggcaacggccgtgaggcggcaacacatcctcgggcgacggcggcggtggtggttaaggcagcggggaagtgttctatgttgttaatgtgttcttagatgtcttctgttttctgtgctgtgttcttgacatgttcttgaagttcttgatgtgctcggtttgattcgtgcttgggtcggcttgattcgagccgagccggcatttttttggggctcgttcatccttatagttgccggttttaaaccgctggcacctattttgtttgacatcagtgtcgcctccgtggtgccgg

SEQ ID NO: 20857 - DNA, 888 bp, Oryza sativa
  unsure (1)..(888): unsure at all n locations
attcctgcaccccccctccgtcccataataaggaattttgagtttttgctttcactttttgactattcgtcttattcaaaaaattttggaattattatttaatttttttgtaacttctttattattcaaagtaatttaagcacaaccttttgttttttatatttgcacaaattttttaaataagatgagtggtcaaacagtacaagaaaaactcaaaattgacagagggagtaattaataagccatttggttggttttcttttcactgtagtactgtacagtagcatgcatgcacacgtaaaacactagcatatcaggtgacacacaatggcgtggcagcgacgacaatgatgaacacgtgaggaagggggcagcgctggcgaagagaccgcgacgagcgtgaaggcatcgcatgcattgcccggtggagtcttggtgagagcatcctcgcttagcaaggctgcacaacgacggcgccggcaacaggatccgaagatgtgtcatcatggcttgtgaacggtgcaacagcgatcatcatggcaacatccccgaagtttgcggtcagtgaagcgacggcttaattggaatggaagccatcttggatgggcacactactagaaaaatcctcacaaatcctacagggaccagctcataggtgccggttcatttaaaaccagcacctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20858 - DNA, 340 bp, Oryza sativa
agacgtcagccggcaagccgccacggcgaacaggcagcacggtgttggagaccagtttgccgccgtatccgctccacgggtagctcgggaggatgagggcagagcctactgtcggaagcggcgcttcggttgagggatcttcaggtgagggtacctgcggcggtgaccggtggagctacgcctggagcggcggccgccggcggcacatgattgccgtattctattgccccaccagagggcggcaagggttttcctgcaaaaaaaccctccctccgtcaccgcccgttcctcccccgtttgccacgtcagcttgccgccccagaggtgggcggcagggtct

SEQ ID NO: 20859 - DNA, 7303 bp, Oryza sativa
atgtgtgagttccccgctagtgatggccccgagaggaaacaagacgagttgtgaaaccaaggctctctagcttctccatggttacagtcgacctccttaacgaattgctaatgataaccatcttcgcccctttcccactgcaacaaccaaaatataacttaaccagtgcatcgcatcagagaaggggaaaaaaaagtaaactgaacactagtgcaacaaccaaatataacttaatcagtgcattgagtcagatgtagaacaaaataagagaaatggatatataagttagagaatataattatatacagtgtgtaccaagatacatacatgcaaggatggcaccaggtaaggcatattcccatggtgaagaacaccaatctggtcgaggaaccacgcctgcaagccagacaaatgcagctttaatcaaacgagcagaagaagtgctagtggtaaatgctagtactacgcgctgggtgggaaatcaactttccccgtaaattttctagccgaaatttcccccaaataattccatatccacccctgaatcgaccgcgtgattcgcagttaccataactaggaaacgcacgagtaatcaatggttaggggaataatcacaagcacaagcgcaactgaatgagcaaaacgagtagtaattccgcgcaggtcggcggttgctaacttgatggataggtgagggggaaaagagagggcataccttgaagcgggcggagtcggcgagtgctcggatccccgtcagcctctcgaacaccggcgccatccaccccgccgcctcctccgccgcctgaagccctgaacaccgcggcggaggagggaagcaaggacagagcggggcgagtccgcgagaggtgagattcgttggtgacttgtgaggggcaaggcagtgaagggacgggacaaaaaactccaaactagaccagcgaatgcatcagaaagttgagaacagcagcaatggcctaatgtttgacaaatttaagtcacttctggatgaaatatttggcaaatgacgaatcagtgaatcatgccgcgtactttctgtcgttgactcagtttaacatgcggtgccaagccgaaatactctccaccctcttggaagcgtcttaccaaaaatggacagtcacgtatcatcagggatttcagggccgggagacgtcgaacgagaccctcagggaacttctctatcggtaaacagttaaaaatctccaattcctcaagagctgtgaagccattcatcccatcgggcagcatctccagcatatccatgcaatacgtagtaagcgatctgagtctgggcagatttcccaggtgcgaaggcagtgccactaaacttcggcaatgtgaaacttccaaattcacaagtgacgtcggcatcttgggtatgtccagtaaattgtcacaatgcgatacttcaaacctctctagttggggcagcggaagggcttcatccgatgatctgcacttcccctccaacttgccacatgcacgaaaagacagatgtcgaaggcaaatcaagcaacggagctcctccattggccactgcacaagatcatcacaaccatggacagtcaaatccttcacaaaagcaaagcactcccagagcccaagatgcacttttgacaaactgcacgttgcgagaacgaagactgccatcatttgcttgtgtcctgtgattatacggcggcggtttggcgcaagctgagacgttggtacaacattaacattgcaatccctgcggaagatggcatgccgcttgcagattggtggatcgcgacaagacggcgttttcagaacacgtataggacggatttcgatagtctgttcatgctaatttgttggcttatctggaaagagcgaaatacaaggatctttcaacacatcgccaagtcggttgaccggctagcggatgacatcaacgaggaaatcgcaatttggagggcagcagggattttttcccatgctagcgagtaatcccgattagaggcgggacttgccccattttttctttttctttccgggcttgagtttgcctgagaccggcgcgacatccttcatgtcgttgtaattaaaactttatttcccccaatcttaatgaaattggccggcctacctttggccgtcccggcaaaaaacaaactgcacgttgctaagaagcagttagaaccacgcagagtcaagctccgtagggcttcgaagggtctacggcttttcttgtcttccagaggcaccatcatgttcgctggtgagctaacatctaagctcacgggagaagcccaacaagggtccaaaggcatcctcatagagtcaatatcacctgctttgtaataaaggtcagacaatgatgtgagatgtgaaagtgagaaaattgagaggctgtgacaccccagagcctccagccttttgagagccgggctttccggaacacttgaaattttcatgcaactcttcaattctaggctttcaagctccgggaaaatgatcacatcattattctccccctcactgttttctgcccacctctccaagttcggtaaaacaaataatatcaactccttcaactttggaaataactgcactggggtgttcccatcaatgttcttacataatgagatcaaactagtcatataagacaaggacaaatactcaagagaggctgatagccacactgttggaatgtccttacatcttggacatcgttcaataatgagcctttttaagcaccggaacatttgagggtctctcatccacactgaggctttacttccaccataaccatataaatccaaaattttaagcttgctgtgaggtttaagagattccaacatttcttcctcattattgtctttgtctccaggcatgtaggatgacatgcagccccaaaataatcgtaatatactcagctcttgtttctgatggagattggcttctttcgcgttcgatgtactctttatttttctcaaattgtacagccccaacatattggtaaggtatctcaactgtttgagctcctcaattcccctgccagcatcggtgtccacgacaaacgttgttagtgtcaatagattgttcagtagactaaaatttgggggcatccgttttaatctatcgcatcccaacagataaaggtggttgagtttccttagatttgccatgccttcaggtaaacattctagatagctgcagccattgagcctcagtgattgtaagttatacaatgcacatattgaatctggcagtctatgtatattagacctagaaaggtcaagatatcataattgttttgtatttatgagatggctagtgataatagaagaatcgtacctacagtgacaccacagtcctctcaacgacctcagttttaacctttctaagaaaaatgacctcagttccaacacttcaagacccctgtataatggtaattccatcaacaaagtgcggagagatgttgtacctttgaatgatccactgatttgttttaattcaccttctgatatttgcacatgccaaacatcttcagatggtgctttctgttgaatcagttcttctgtagttgcacattcacttgaaacgtcttttgctaagtcatgcattaaatcatgcattttacatacaacaaagtcataatctaagcttctgaataatattgttttaacatcttgaagaaatgatctccaaaccaactcattgaaaacaaactcgcctttttgtgacaactcaattgtgccctcttcttgaataaaaccatttgctatccatagttggatcaacatgtccttctccatctcatagtccttgcagaaaattgcacagaaggtgaagcattgtttcatttcagatggcaagtgtttgtagctcaattttagtattgataagatttcgtcttttcctttgacactatcaccaatattacttcttgcgatggcttcccattccttgacttggtgtttggaactcattagaccgcccatcgtcttcagagcaagtggcagccccttgcatttatgtacaatacatttgccaatggtgaccaaatcttcttgctcttgtacgtctctaccaaacgctctcttcgagaacaattcccatgattcatcttcacttagacatgctggcttatagggttgaagggtttccattatagatgccacccgccgattgcgagttgtgatgactataatgctccctggacccccgacagaattcagaagtggccttaggtgttcattccacttgttgtcgtcctcattccatacatcatcaagaacaagtagaaaccttttcctgtcaatgactccttcaagtcgccttcgcaacaactcaattgagtcaggtaggtcacattttctatttgtagccaactcaatgatggatttcacaatagaaataggttcaaagttctccgaaacacagtgccacatcttcagttggaaatgtttctggacaatcggatcgttgtacaccatcttcgcaagcgttgtcttgcccaaaccgcccatccccacgatggggagaacctgcaaattctgttgatcatgctgatccagcatcagtttaaccaacacctccttgtcatgctctcgcccaaatatgtctgctgactcgtccagccccgagtgtgttagccgataaggaagctgtggcgcctctgtgtgctccatcaggccaaacttgttcatctcttcaaccagatcgttgatcttcttgaggacatcgcccagcttcctactcatggtaacacggaacaggagtgggctatgcggcgtgaagtagccgagtaccttgcgggtggtggagtcgccgatcttgacctcgcggcgcagagcctcgtactcgaagtcgtcgaggacgtcgtcggcctcgtaggcgacagccttgaggtccttcatccagcgcttgacggcggggttggtctcgcttagggttgtaagtggctaacccgtgaaacccacttataggctaaaataagccgcgagcccgcttattttgacctataagtaggttcgcggctgacccacttacacccttagtctcgctcttcgccttggcatcggccagcttgcactggacggccagaagctggcgctccagcttgcggcggtcgccgtcgacgccgcacacgcgcgtgacgctctggacgagcgcgttcgccgccttgccagccaccccgcgcaccaccgggaagcgattccgccatgttgcgttctcagctgcaaagcacggtggaatgaatgaagatgaaaggcaaagcatgaagcgctctgggcactctggtccgtaattcaagtgggcatgtttggcccgtatgagtataatatggagaaaatttacaacttgacttacttttgcgtccttctcaaaaaaaaaaaagactaacttttgcgtagtgcattcatgtcgtggaatccaccagtttggttggcagtttcgttgaaatctcctcggccctcgccgtcttttcttatcagcaaaaacatactttgctgaaacaaactggcacggcagtcggcaaatcctgggcttcgaatatgatcctgttgagacgaatgcatcagaattcagaatagcaaaggccaaattttgacaaagtctggatgaaatatttgctaaacatacttccaacgaacaaatcccaaacaaacatgacgaattctcccaaaaaaaaacagagcacgaaaccaaccatttccatgggaatacccaataacgagaacctttacatctcaaaccacttgggtcagatataatcagcaacaagtttcagtaaggcggaaacattttcatcacaatatgccgtagtaccttccaactcaagttacttggtcagagaggttctcaaaagctagattcagtagaatcacttcatcaaaactaagaacgagaaggcgggtaggaaaacagattctgctatttcataatctgagcatgaacactctattaagctttcagaaataaaggtacaatcggctaggctattacaaaactgacaaggtataacggatccatcccttgcacatgaattacgactgggcataggttctgcactaattcaacttctcaattaattcattgattttatcttcgcggttccctgagtcaccaccatccttgaagggtttcttcttcatctgcaacctcctctctggacacttgagcttgaagggcatgaggaaatttgaagcttctctgaagtgtgggccaactgatgcgatttcatgcacaagatcttccaaacatatgatgccatattctcccagagcctgttttcagaaaaaaagcacagatgggtatatttcagtgtacattaccaaaccatgagattgtcttcaacatcgaaaactgaaaccaaatatccttttgttttatttagagactgatgaaaatgtatcttatgtctgggaaattatacataaccgagatgataatcaacacacaaaaaaaagcataaccacagtgatttttacacttgtggaaggagacagaaatagctctaccaaagcagtgcatgcaacaatggaattgatcctaaatgaagtattgtagcatgccaaatttgaggtccagaacccaacaaaactattagccgagattaaagaatcaggtttcagacagcgctacacctagtggttttatataaactatatctccaaaataagccagcccaattcccatgctcattgcaaaatagcctgttgtagacaaatttactaatgccgtgcaacctcaagttttataaggtgtaacaaaacaataccttctcaatgagatcattgctggtaagagggaaaggttccttgtccaggaacccacggcccttcttgtaaataagatccttcacattcttcaaatttgggaacctatattacacaacaataaataaaatttcagcactgcaagctacagatggacaaatcaatatgtttttgtacaaaagaactgttaatagagaagcatgtttgagttcagttacccataagtgataaacggctccacaacaagaagcctcttcatagtagcgtcagtggccttgaggaacacgccggtgaggacctgcgtcagccgcagcttgcgcaaaatcctcctcatgtgtggatgcaagtccattgtgctgcagattacacacaaacaaaattgttaaaattgtgaaccgcaatcatcaccaatgaaaagagacaaaccttgcagaaacaaaaacaagaactcctcatcacttgtactgctgctaaaatacagtaataatactgacccaaggatgcgaatcgcgaagacgagcttggagttgagggtctcg

SEQ ID NO: 20860 - DNA, 11744 bp, Oryza sativa
ctccttgttgcggaactccttgacaaagtcctcgggcctcgtgatggcgcccttgccgtcgtcgcggcggcgctgcctcttggccgccttccgctcccggttcttgaccgcccagtcctcgttcaccttccgcttcttcagcaccgtctcccgcacgtacggcagctgctgcgtcccctcctccgccatcatcgtcgccgctatctctacgcaagcttcgccctggacgacggcggcggcggcggaacgacgcgagggagaagggtttcggggatcggcggtgtctgggtctcaccgtcttattatggccttttcatctcttactgggccgggctcacgaaagtttaggcccattaatgatgtgtggcccagttgtagtgggcctgttgggctttttcttgctggttggtgtggcccagttgtagtgccggtcaggttgggtcggcggcgatgacacgtacaagaacagtcgtcgtgactcaagacgacgactcactcaaaggcagcggcggcgagccacgcctccgccgctctctcctgctcttcagtcggcgggcgatcgccggcggctcttccggcgaactcgcgagtcgcccccccccacctcccctctagcctgtactaaggaaggtatgtcatgtgaggggtggtctatggtcgccgccgcgccatggccacgagcttttcgtgttgattctagaaggtgcgcttattttctgagtggaatggcgaataagtgcactcggtgatgtcctgtgatttagttgtgcttggaattttgggtgtactgaatactgatgcttatgttcttcttgctgtgtcattcaggcttgtaataatttattggattttgataatttattcgtgcaatatggttcgcggttctgttgatgtggcaatcaaggagatggaggctttatgtatcggacaaaatcaagaaaccaaagtaggtgtgctgcactagtttcatctttggcgtgaattaaattgttttgtgcactaagcaatactgctgaccatgctttgcactaccatgttccataggtgataccgtgataatagatgtgtaacttttgaaaattgggtgccagacaatgatgcgaatgccgtttagaattaacctgttattcagtgtttgcagtgttctcatttattgatattgttagtttggttatgttcatagtttaccttaatatatccttgtaagttgttaccaatggcctgtttgctaatcttttttgttagagatcagaggtaccatttccataccaggagtttgaaagctatatgtatgatttcaatactccacctaatagtaaatgacatttggtttctaggatagctgaacctctcatggcttccatcttttcattggtccttggctcattgcctttctataaatttactttctattaagttaacattattattacttctttggctgcaggaggaagtcggttttgaaacacaggaggcctcattaaaagcaagcaaagttgcagatagcaaaggagctccgtactcaccaccagaaaatgatgatgatgcagaagtggactatccgtctcaagatggagcacaaggtgacaactctgacttgcaagctcttattgctgagttcctcagctagagttgaagcttttgcaattctctttagcacttgctattaaataatctcattccaagttaaaataatctcattgcaaggaacagtaatagctgccaagaagaaaaagaagaaaagcaaagcgaagtaagtttatgttaaattaagccattactgttccttttctttttagaaccatgctttaatttatttattctgtagaaagaagaagggacctcttcagcagacagatcctccatcgatccctgttgatgaactcttcccatcaggagaatttcctgagggtgagatccaacactataaggatgagtaagtatgcatttatcctcataaaatttgtttttttttacgcaatcctcataaaatttgtatataatagcaaacctggcacactaatttcttagccattttcacctctaaaaattcctaatggcaaattcaatggactgtaataacagtgagcatatgtttgcataaattaattgtgctattgctcatcagtaacttatggaggacaactagtgaagaaaagcgggaactggaaagattgcaaaagccaatgtacaatgctgttcgtcgggcagcagaagttcatagacaggtttaaaatttattgatatctttgaatatttgcgaattcatttgaatatgctctatatgttacaactctgaaacatatgttgtggtttgctaggtccggaagtatatgagaagcattttgaagcccgggatgctaatgattgatctatgtgaaactttggaaaacatggtcaggaaacttatcaaggagaatggattggaagctggtattgcctttccaacaggatgctccttgaattggtacggtattccagtattttacatttagtacttcgtaagttccttactctgcattcccttatgaaactaacgaaaacaaaaatgcaatgcttagtgttgcagctcactggactccaaatggtggtgataaaactgtactacaatatgatgatgtgatgaagctggattttgggacacatataaatggtatgtatattgtttgttatacgcgtcagagttttttgtggctttgtccttgaaagtataaagtcacaccttttctactgccaaaaataatttggtatttcgattcttctcagggtacatagttgatagcgcattcactgttgcattcaatcccatgtttgatccattgcttcaagcatcaagagatgccacaaatgctggtgttaaggtaattctctacacttttctgtgcattttctgaagccctcaatatagcaaatcaatgggcttggaaatggccccttaagaaaacacctttgtcatgtcacttgttaagggcttgttttaacggaatccattcatagttgttcattaaactgttagtcaaattgttgtgtagcatttatacagtttttttggctagttattgcatggtgttcttcactactgatttgatggatgtataatgaatctattgttttattttctctaaattgtaatagaatctaccattgtacttcagtagtgttttggttgttcccttcattttaggaagctggaatagatgcacggctatgtgatgttggcgcagcaattcaagaagtcatggaatcatatgaggttgaaattaatggaaaagtattccaaggttagtgctagtgcatctttttcccatttcacactggtaacgtaaagtgataagttgacaacgcaaattaaattattgctatgcggcagtaaaaagtgtgcggaacctcaatggacacggcattgggccataccaaatccattttgggaaatcagttccagttgtgaaaggtggtgaacaaacaaagatggaggagggggaattttatgccattgaaacttttggatctacaggtatgtcaatctatagcttaggttgtcacattactaatagttgaaattcagttttgcatcaaatataacaagtaactactaatatgaccctccttggctaaagtgtagaagttttcaagtgttgaaattatctttttttaaataatgtatatcaatccggcctctatatgttgaagttcttgaagaattttatgcttactgtctgtcataatgtttgcaggaaagggatatgtcagggaagacttagaatgcagccattatatgaagaactttgatgttggccatgtacctttgagggcagcaaaagctaagcaactacttgtgacgataaacaacaatttcggaacacttgccttctgccggaggtatctggaccggcttggtgagaccaagtacctcatggcactgaaaaatctgtgcgatgctggcattgttgaggtatgtatagaagtccattctctactccaatattgttgtaggccttgccataaccatattcgtggttgctcatagttgtatgctttaattgttggcagccatgtcctccaatgtgtgatgtgaggggaagctatgtgtcacaatctgaacacaccattttgctccggccaacctgcaaggaagtcatatccagaggtgatgattattgattgcaatggctgtccctcttgtactggttttgtgagatcattgctcgccattttttattttgggaaacctgtatacactgttgtatgtatcatatgatatcactatcataagataaataatgtgcagtaagcaccgtttgttgctgctgctgcttaccacttggcagttggtactctttaaataatttttagtggaagcttgatactatttcgaagcatagtcttcattttgctggaaatgtgccaatctgttgtattttggtttattggtatgtaggattaccatctaattctgatatgttggcaaaaagtaatagagtttccagagaaaaatgcaatagcaaatttacaatagaagagaagaagcttgaaagaggaggcccatattaaagcccatgaacgaaagcttagcccatctaattggagcccttctatgcctaggcccacctgcagcgagtgatgggggcatctcctgaaaactcgcgcgcatttaactaagggttaccagctcaatataaagtgtgtcttccctccccgccgccgccgcctcgtcgtcgccgctgccgccgccgccgcggccgcgcgagaggaacatccgttggctctagggactcgcgtggaagatggtaactattccttctgatccttccccttctccctagcgtagccggtttctaccgccaaagtgcgggtaggtgttactcatgccagatcggtctcaagatccgggatggtgtgaaggagagctgcgtttgatcttgctttgtgcggcatgtagcttggatattacgctgctgaggagatgccgctttgtctgtggcactctgttccgttatggtgacaggaatgtgggaggagattttgagttggctgttgcttcagtttatgatgttccgtaactttcctgtaaatctgtaattggttgatatgtgccacttgttattctattgctaggttcaatttgaggaacgagtgcttggtagtttttgcttgcagtggttgcccatcgctaccgtgttccgttttctattactccctccgtttcataatgtaagactttctagcactgcctgcatttatatagatgttaatgaatctagacatatattttagattcattaacatctatatgaatatgggcagtgctagaaagtcttacaatttaaaacggaggaagtaataattttatcaggctctgaagtttagttcatcccagattactgtaatatagcaattgttaagtggtatattgactggaaatgaattccaggttgtgtaatctacacccgtttacctagtttgtaggtaggatttctgtatgctcaccaggactagttatgttttcccaatatccctgtcatggaacatttattttcttcatgctactgcttgcgtggtttccttgatgtgcatgtaaatttcaaatgtgatatgatgctagaatggagccgattaatttgttatctactgtcatcctgtgtctaaactctaaactaaacaattattatgattccgtagccaaagcagattcgtgaggtcaaggacttctttctcactgtgagaagaaggatgctcgttcagtgaacatcaagaggagcaaagatgttttcaagttcaaggtcggctgctccaagtacatgtacaccctctgcaccttcgagctgagaaggcaaacaggttgaagcaatttatcccaccaggtttgtaaaaagtggctctagttctgtttagcactatctcatttctgtttgggtatctgagtagtttgtgctggtataaatcttgcttacaattttgttcttcttattgatgggcattctttctctgcaacatgatgctttgttccaatatgtttgttgtttataatgctggtattgcttatatctgttggttgatgtcccagtgacgataaaattttgctccaaagatgattattctctggttttagcttcaagccctctgtcataccattttgacacggatggcttgtggctaaaaccattatcaagaatcatcaatgatggccaataatagctatgagatctgagggacaaccctacagtacaacatattctggtatctcaattctttgttatccttggttcctattgaactggatgtgttattggagatgtcaacacattctggtatctcagttctttgttatccttggtttctcttgaactggatgtgttattggagctgtccccaaggaagataaaaactttgtaccaaatatggatttgcaattagttttagcttcaagccatccttcctaattcatatgatgtgtgtggcttttggttaaaactaggttacgcttttaagttcatcagtgattggcaatagctatgagatccgagggatatgggttatggttttttcagacaaaaaaaaaactattagcagatcaagaaactatttgagctgtcaattctgttttttttttaaaaatagagatgtttttaatgatgtagagattttctttatataaatttctgcatctgataattttgttttcattgatccatgtctgagcgtccaagaggtataaagatacaaaggcaacatcttaatgaagtatccaaggtctttggtgctgagaatgcaaacaagttgaagcaatttctcccaccaggttcacagaaagtgtctggtaagttgatgccctagcgaagataaagttttggtccaaagatgtttggtgtctggttttagcttcaagccttctgtctgaccattttgacaattggatggcttgtggctaaaaccattatcaagaatcatcagtgatggtcaataatagctatgagatccgagggacaactgtacaatataaaatattatgatatttcacctttgttatttgggatgtccccatgaagataaattgtttggacctaagatggatttgcaattagttttagctttaagccatccttttaattcttatgatgcatgtggcttgtcaaaactagttcaatttttaagttcatcagtgatgggcagtagctatgagatttgagggacgtggactatggtcgtttcagacacaaaaggctgtcaccttttgttctctgtctcgttttgtatggtccttcactgttctgaccaagaagctatttgagctgtctgttttgttttgtgaatgcagagttttttttttcatgtaccaaagttttgcatttgatgactttgcattccttggtccaggtttgagcatccaggaggtctgaagacacaaaggcaacatctttagtgtccaagtttctgtctgttagcagttcatgcaatgtgttgaatcttttggactcctaagcaaattagacctgcctgttcttgatctgtaatctccgctttggagaaaaggtgtcttttgccacagttctgtgatgcagattttcagcttattttaacccagcagattttcagcttattttagaaataaactgctttctggataagatttctctcttacagtttacattgcactgaatgaagcttttttttttgtcaaagtaccttctgggatgaaggtgatcaaatgcgatataaaatcgtcctgtgctgctgtcacgtatcaccctgccatatattctgggatctcaatcatggttcatagacgggctacagtgcttcatctttgattctttgtttaacttgtgaatcatgcatggataatataagtagctattaaatccttgattctcactggaagaattgaagctactttggccgtgtttttagtttatttaccggactgtgaaatggattactttgctccatgttttaaaaatatattttcttaaaagtacttcacttagactgcttattttaagctatttattaaatttatttctaaaaactatttaatttattcatatatttaagtagataatccataacaataatctaaggcaaacatcggctattgagagaaatctaactttctctgttttttttcgatgggccggcgaatagctggccgatgtatattaagagtaaaaaagggaatgtacaaggtagcgcggtacgtcaatgcaccaccattatagacataaaaagaaagctaaaatctcacagaatgagttgttacagagtgacatatgaggttaacaagtcgtgcagctatccaagtctctcattcatccgccccaagtcctgcagctatgcaagtctcctgttcatcccccatggaaccgttgccacgatcccttcgaacacccttgtgtttcactctttccaaatcaaccaggttacaaggatcacccccgcatcaatgttttatcgtcaaccttagcaacagatttttgggctgtaagccaccaatcagcaaaatcagccgacggcgctcgcaaaatctgactctgtgatttcttttgtgatgaagttgtactttgggcatgaaaatctttcactatatcgaaatgcacaatttgtaacttcaaactgccatttttcattgtctttgaaaggttaccactttattttattttacaggaggtaaaacaatcctataaactttcagttagtaaagcagcccgatgagatcgacggcgatgttacagtgcgtcgccgtcgtcctgtcgatgtcggccaccggagagaccttcgagcggcggacgatcatgttgtcgcacatgatcccggcgtagtaaccggccagctggtgcctgaccacgtcgaggtacgcgccgccggagctgtaggcgtcgaccgccgcctgggcctcgccggcggcgaggtcgtacatccaccagcactcgagcagcgtcagctcgaggacctggccgtgattctccaggaacttgccgtacacggcggcggcgctggacttcacggtggcggcggcgatgtcgaccgcgatgccggcgagctggtgcacggtggtggccctggcgctccgccggtcggcgctgagcatcttcacgcactcggtgtggttggtgcgcttgcacgtgcgggcgacgaagcgggcgtcgccgacgacggcggaggggagggaggcggcgacggagacgaggacgacgacggcgaggaggacggtgacggcagcagctggtctcgccattgctgaacccaactcagtttgatcgatgaactccttgattaattactctagttcttgtgtttgttgattttgctatgagtgttctagctagtttgtgtatatataggctttgaaaagaatcccaaatataaaaaaactcattaattgaagcatttaatgtttttttcccttagagcaaggtcaatagtatagccaactactgactccaaaacatctatagtcaatctaatagtctattcatacaatagctaactataaaaatatactacatcattaatacctggtcccacctctcatacacacataatatcttggagtccgtgttacagccgactacaaatctgtagcccgctttcttctctcttctctttttttctcgatatatggttatagccagcttatagcctgctattgtacctgctcttatggaatccaaataggagtaatgcctttgagcatccaatttgaggaatttaatactatttggaagaatttagtgtatgtatctttaatgaatttattgccttcaccccctagaaattccaattttcttgaggacttcattgtattttcctcaggaacccaaatgtttgtgtgcatttatttttcgtggaatccaatcttttgctatgaaatttattgtggattttttttctttttgaacccaattatccaaacccaaaccgtgcagaatattaaaaaggtcatatagatagaaagatggtgatttaacattggaagtacacatcttagagggacgtgactatacaggtagtggtagctccatctatgttagaccctatccacatatatttcaaataaaattttctcttaaactactcattcgatcgacgatccgattacaccgttgtgttcgtaataattactccctccgttttttaatagatgatgccattgacttttttttacatgtttgaccattcgtcttattcaaaaaatttacgtaattataatttattttgttatgagttgttttatcactcatagtactttaagtgtgatttatatcttatatatttgcataaaatctttgaataagacaaatgataaaacatgtgagaaaaagtcaacggtgtcatctattaaaaaacggaggcagtaaatctttataacaagatctcacatgattatattttgataaaaaaatataaattacttttataatatatctaaattacttttagatttcactaaattacttcttggatatataaaagtaaattcaataaagcctaaaagtaatttacatatattatagaagtaacttataacaaaaaaataactttaatgcatgcctttttttttattttggacgtgactacacagctagtggtagccggtttgtattccttctagtgtctcatttcaacttgaaaaatgcaatagtatgtatcttttttaatctctttaataacttatatcttttaaatcacatattgtttttaagatatatttatagagagttacttctgaaccatgcaaaagttacttccatttaacattgaagttatttttaaaaattgttaaactttcatgtgttgatctgtgctgattaaatttaatttctagatagtcatatttttatccctacaacaaatttacttctaatgtcgtgacaaagttacttccgttttattttaagttactttttataatatatgtaaattacttttagactttattgaatttacttttatatgtctaagaagtaatttagtcaaacatatgataaaagtaacttacatatgtaataaaagtaatttacaaatataattttatttcatcgtaatataatcatgtaagatcttgttctgaagatttaattgcaatgaacacaattgtgtaattggattgtagatcggataagtaatttgagagaaaattctataaaaaaaaaatagacatgcattgtgtgcactagtaacaactggaccttttctcacgtaactatactagcaacactggaccttctctcacgtactatagcactggaccttttctcacgtatgaatgcatcgctcttttaacactaaatcgagagcgctgtcggtttagattttgcgatcttagagcttatactagttataagtaagattggagctagtagtaaagtataggtaagctctgatccaatattgagcccctgagctttactcctttgcaactatactcctgtgcaaacagttggtgatgattcataactgctgactgaaaatggacgttagatgtctatgatatgatctcgttcagaagcagaactgcagaagcataagggtttgttcggttcatgcatgatcctgccatgatgcatgccatggcatgctcagttcgttgagacacattcagaatatggatggatcaaattgtcagacaactctttttatttaggagtacattttatttccatccaactagatggtttgatatggacacaaaaaatatctgaaactctgtgttgatcgttgttattaatttatctgaagggctgcag

SEQ ID NO: 20861 - DNA, 37907 bp, Oryza sativa
ttcagaaattacggcgtaggaatgaccagttgagcctcttgatgcgaacgatgcggttgagctcctcgcgaacggagacgagcagcacgtacgcctcacgtgcgccctccacctccacgtccaccacgtgctccaccgtgccggagtcggggtcgtagtagccgccgccgccgtcgaccacccgcacctcgccgccgtcgaccaccgccacctccttctccgtcgtcaccgtgagcagcagcacggccccgtcgtcgtcgacgtactccacgcaccgcaccgcctcgcggacgccgccgccgtcgtggagcgccgccggcaccgtcctctcctccatcagcgggaacacctcgccggcgatctccaggcactcgcgcgcgtcctcctcgtcgtcgtcagggacgaggcggcggcgacaatcctcgcgcgagaagaagagcggcttcccgtcgtactccacgcagtcgcgcacgacgccgccggacgtcgcgacgcgccacctcgtcagctgcggagcgtacagggacgccatggccgcgcgccgccggtgacgccggatcacaccggagaagctaagctaagctaaggatcagcaagtgcaatgcgctctgatcgatggcgacgatgagcttgcgatcgaattgcttgagctctcatcagggccagcatctgaatttatcatgagcaccaaactcagtgtggaattcggagtcggacaccgattccgagacacagtcgatccggcactgccgctcctgtgggacccacataatgtattctcctggagcccatgggcccatgaccagttcagtgccatcttgggcttcgagtttctattctccataggaataagttcatcagaggtcccttaacttatcaacgaatccaattttcgtccttgaccctcaactatcataaccggtgcagataagatccctcggcggtttcgatggtggttttggctaacgtagcgcctacgtggttattttgactcggtcttcatccgacgtggcactgatgtggcgcttaggtggcaattcagtctagaaaaataataaaacctgtgggacccacatgtcagtttcacattcaaaaatatatttaaaaagtgggacccacgtgggccccacatgtcatcctctctgtctatcttttttttttcctttttcattctttttcttcttttaagatggcatccggaggccgatgcgagcgccgcgccggcggagagggcggccgacgggaatggagcgacggccggcaggagggagggagaggagtggcggccggcgggtgggagggagaggaacggcggcgcgcgccgcgctggcggagagggcggtcgataggagcgccacgagggaggaggcgagctcgtcggggcggccggcgggagaagaggcagcacgcgccggccgacgggagggagggagaggagcgggaggtggctccggcggctgtgggcggaagaggaaggggcggcgagaggtggccctggttgcggctgccgttgggagaggagacggcgtcgatggtgaggaggacgctcgcggcgctggagacgcggtcgctaggttggtcgaagggtgagaagggagtggcgggggaggtgacgtcggggcgcactagtcacggtcggcgagcgcggcatgcacgtggcggaccggaccgagaaaggcagcggggacgacgacgagaggagatggagcgcgaatcgggacagtagacggcggcggcgtgaccccggtgtcgaggccgatcgaggtcgagtagcgtgaccccggcgtcaaggtgcgcggcgacggcggtcgcgtccccctcacctgccaactcaggatatctggtggtggtggtggccggcgacgtcacactacccggtctaggaggagcggcggcgcgggcggtcgtcatcgccggagttgcgcggaagatggggagttcttgttgttgccggacgggcggcggccggaggcccggagcagagtagcggagcaggccaactttgccgctatggatcgccgcggccacctcctcgctggccatcccactcgaacgccatcttcgtgcgcgctcgccgcgggccactgtttttctttttatctgaccgacatgtgggccccacattttgtttttattttttatttttatattttacttccagtgccacgtcaccgccacgtaggacgaggaccaagtcaaaccggtcacgtaagcgccatatcagccaaaaccaccatcagaaccactgagggacctgctttgcaccggttttgatagttgagggacctgttgtatctggttttttctggttgaaggacgaaaatcgaattaattgacaagttaagggagcttaagtgaacttattccttctccatatattgggccagatgactaaatgggccggacacagactttctttctgctgctctccctgtggtctactggtctcgtcgcagagcagcagcatggcagttggcctgaatgcaacgcagaatgcttactgtactacttgcttattgcagcatattcattcagggtttcagaaattcagtctcagaatgcaaacagttggattctctagaaatttcaggaccaacacatgtaatcatcgatatgaagcataaatcgcattgggttaaagttcaaagtcaaggatcacaaatttgacaacaaatcacggaaactatcaccagttgttcgagcgtagccagtttgcagtgccatatatactgccatctcttgtttccatcagaacctacaagctaggaggagtaccgattaaacttgctttgtattgcatcccaccaagatatagttatgaattcatgacgaggagcagcacaaggcttgcattgcatggctgcatcatagcttaccatactccataactgttactcctagcccatccatcatgatgcatatgccttgccatgctctcttcagacttcagatcatggattgattcatcgatcgtttcgtcagaaaccttagttccccaaaaaattttcctaaaaacatcacatcgaatttttgacacatgcatagagtattaaatatagatttaaaaaactaattacgcaattagaggaaagattgcgagacgaatcttttgagcctaattattagttcataattagccataagtgttacagtaacccgcatgtgctaatgacggattaattatgctcaaaagattcgtctcgtggtttccaggcgagttatgaaattagttttttcattcgtatccgaaaaccccttccggcatcctgtcaaacatccaatgtgacaccaaaaacatttttttctcgaactaaatatgcccttattttgatttcccatataggattacttcctagtgccattcaagcaacgatcactgttcagtaacagtacatcatgtcgcactctaaaaagcacataatttatctgaaactctgagtagatctgttgtttctttggagtaacagagattcagacaacagaatgatcaatgcagcacttacaggtaggaaaaagattggatttggggggaattgatgcatgcaagatgggagtagataatgctctgttcagaaagtcagaattccatgcccccacgcatgtgacatgtagcaataccaccatccatatccactgcctactcaagtgttcctcatcaactgccattttctccttattagataatggaataatcctatcaacagtccatggaacacagtaatttcacagtacctacctaccatgacaagtcataaatatttctaaaaacattccggtgttccaaatggcacattaaatcctgaattaatgtgcatgatggatcaatgggacagatctagtacatgattaatatttcaaaacaacaaatttatctgatctgtaaaattatactcctactcctgtttatttcgttacggttgtctgcatgcagtgtgatgcttgcctgtcatccagtgattattgcagaagcagcagcagcatcacattcacatcccacgttggcgccgacatcctgtgcagcagccacatgcgcatgccaaaaccgagaggtattaaaaaggagattaacttagcataaatccaagattaaatccgtttttgtatgcgttgagattggtgggaggctgggagaaagcacatgctcaccaaaccgtttttcagttaagccacagttgttgtgatgtgtgatgatctatatggaccatccatgcagggctaggctgcagccatccatgcatgcatgaaccaatgcaaatgcttttgataatatgcagatctgaactggttaattatttcccagaaagctactacagcctaacatctctcactctcaccatcatgggtgtcacttggttgctttgctgccagactgaaagttttaactgtccagaaactagaagcagtcgagtctgtctaattactcttgtattttggttatgtacttttgatttagatgtagaggctgggttttaatcaattttctaaaaaaatatatacagaaggtattgtacatatggatcaagtggttttacttaactcatctgaaagaatgaacgaattaagcaggtttgttcttggacagtactacagtgatgccttgcaaattgagcaaaggcaggcaaaacaagtacataaatttccccagattaatggagtgagacagctaatagtactattatggtactgttagtaccttgctgccactaattcgaggccattttttatctgactttttgtttcttcgagcacttgggttcagaaccgcatggtttttgtttttcgtttcgagaaaaagtggagctctgttccttgcttttcaagtgaacttctgcaatttccatcctgttctgcttcagaattttatttgtacatacatgaatgtgaaagatatcaaatgtgtacacatgtttgtagtcttgtagagagtatgatcaatgatatcaactagctgctgcattactagaaccacatgcagataaggtcgaactaaaccaaatcaatgataaaattttgagttattaaaactaagtactttggctggtgcaatgatatcgacggctccaatacacgacgacataatacaggcataaaaatactctggcaattagtttaccaaccggcaatgcaaattatacgacagtggttaggagatccctatcaattaatcatcggcagcgactgtattattctgacgcttgaccaaaatgggggctggcctgaacattaatcattttcaggaaaatgtacttatctgaaatctacaaaatatcaatgtgtttggttaaatttaaccctttctataacatggattagttggagtacattacaatctgaagtcaaactggagtactgcagagacagactgtcggtagtccgatttttgattctgcgtacagtcgttgaccaaattagattggaccatttcatggttactgcagtctgcaggagaaagaaaagaacacttgatctgcactcaagcttgggtgcttatcttaagtcacaaccaaccacatcttaatgacctgatgaatatgagatgagcttggtgcttttatgagaaattgacttctcccaggaggtcccaccatgtcagtttctaacccacaaattttgtacaaaaactaaataaattcttgcaaaactcctactattactacaattttcttagacaacagcacacaaaaccttactatatcaaatactctatccgatccaaaatataacaacctaatacaaaataagacacgtcgtactactacgaatctgaacaaaacccttgtctagattaatatttactagtatctttatcttaatttgatcatcccctaaatagagggcatcaagaccaaatacactaatccaacattctgaaattaatcctcatcgatcaaaggtgctccgtcgcttcatgttcaacaagttaattcacactttaaatgttgtatgggttgaactaatagaaatcaatcttgatttgttgtatgcatgtggggcattcacaatgcacatgtactctttacacaaataaaaaaagaagcaatttattaaataattattattttgaaaacatcttagatgatgattaaattgggatgaagggagtagaatatactcctatctctacttcgggtgttatattttaggttggaggaaatagagcttaagcttgtaatatgctccctctatcataaattgtttagaacacgatttttcttttgctttaaatccaagtatgccaggaaatatcgatgatcgatattttgaaagagcaatcgaatctcgttctaaaggtcggatatttatgacgtgtattagggcttttgcattgccattgtttacccaaatgttgtaagcataaaaccatgtcaagattgttttttaacttttgggtgaaaactttcacagttggagcagtaactaaaagaaaaaaaaaaggctttccctttctccaaattgtccttggaactccactttgccccattgaaaacgacgcctgacctcaacaatagcaccacccaggcacccacccactgacttcccgggccccacatgtacaatccctacaatcgagagagagagagagagagagagagagagagagagagctcgaagcttttcccaaataactttgccacagtgcctcctgcttcccccctgtgcttgcagacttgcagcgcagagctcagcgtagcgtgctctcgcctccacactccacaccacaccacagtcgcctctctcctctttcaccgagaagcgaagcgagagagagactggcaccgccgcaagaagccaaccggcgggggagggagaagcagagcaagcggcagaaagaagaatcattggttaggctctgcagaggagaggcggcactgcactggaggtgagaggctgagaacgagaggtagaagaagaatcgggagaaggatcgtcttcacgggaggagcaaggaggggataattaggctcggattgccattaggctgaggggggattcgcgaggcttgtgttgagaggcttgagaggtgtgtgctcgcgtccctctgcttcttcttcttcttctccatcttactgtattctttatgctgcttctagatttgtctcttgtatctgtgatgttgatggagttcgtcagaaatgtcccttcttttcttctcttcctcccatgatttcttcgagcagcatctttctatattctgttctgtttttcccccctctgaagtacgttttggaactatgatgattccataacaagttgctagtcgaagattgcttgttactctatcgatcaatggcagttctgcagctgctgcttaaaatgggttcttttgctcaagatttgattgtgctttctccttctgtatctctgttggtatatagttctgggacaggtccactttgattctatcatgggactcctatttgattgtgtttgaggtcctcactggatctgctcacaccttacttgtactcgtatagtatcccattcggattgaattaaatgcatttcctagaaaaaaaattgctctacttagtccttgctccttgcagcctccatttcgagtacacctctatttattcgatgcttgacttcattccaagcagtattgttgggcagctaggtgtacttgtcttctcctttctgcactcaaaatgttgtagttaatggcacctttcgtgctcattgagtttggtatgctttttatggttcagcaaaatgggagtagcaaattgttgtgctttggtttcaattccagtgacaatttccagccatattactagttagcatttactgacaaaatgcattggtttcgtgttcactgtgagccatcaaaacggtttgtgctaccgacatgttagcctggattgagtttcactgtaaagttgcaacctttattacatttggttgttggtgatttcattttcgttaggactacccaggttgtcgactattaactcattagacttttgtcactttcaagttctaataattctttgaagtcctctgtatgattactgtgatttctgaattgtgcttaacatttgcaggtaatgtgctttagagtcgacagcaatggcttcgctggtacccggggtccttctcaagctccttcagcacatgaacagcgatgttaaagttgccggcgagcaccgttcgtcccttcttcaggtggtcagcattgttccggcccttgcagggagtgatctgtttaccaaccagggtttctatctcaaggtgtccgattcctcgcacgcaacatacgtttccttaccagaagagcagcatgatctcatattgagcgacacaattcagttgggacagttcatccatgtagaccgtcttgaggcagccactccggtgccaatcttgaggggagtcaggccagttccaggtcggcatgcttgtgttggcagtccagaagatcttgtggtaacaaactccacttttctcggaagtaagaaggcacaacaatccatcaacgggtcaaaggatgccagtactttatcactagaaaaggagcagagcaaattggagaaattaaaaccttcagtgaaaaacaatggggcagaaatcaagaaaccacagttaaccaaatcaaactcttctctctcgaaacaagcattgaatagcattatagacaagaaggaagtagtcagctcaaagacaaaacctaccagtgctaggtcgacaccttcatctccgaccagcgtttattctctaccggcatcatttgagagattctcgaatgacataaagcagagaacaaaatcaaaaggagcagataagtcatcaccttctaggctttccttgttagagaaagctgcttctgttttgaaggctactacagcagggaggaagtcctctgcaggtaacttgcttagtaacaccatgtcaagtattgaatcgggaccaaaggccctgagaagaagctgggaagggaatgcagaagcaaagagcaaaggaaattcagattcaaaggcagccaaaactgagaagaagtctgagaatagaagcacatcggtacgtgcggttgttgtcaacgcttatcagttatatttgtctacaaatgtggcgtgatttactttattgagtatccttcatgtagtacttaagctattgccttaagcccttaacacattgtagcctttcagtaacatttgaattcatgtttgatcctttattgcccatcttttttttttccaaagttactaatctttgctggctcttttgttatcagactccaagacgcaaaccactagtagaagagaagccattgcataaggatgacagtaagattcagactcctccaaggaagagctcagcaagtgccccttcagatgattctgagaaaatagtgaataagccttcttctcctttgaggaggacgtctggagtttcaagcaacacaaatattacaaatctagtgaagattgcttcaaacagcaaaaagttgacagatgctagcgcttcatggacatcacttcctccttcacttgctaaattagggaaggtatgaatatgctcattcacatgttcgcataggttggctcattgatgtgttcactatggctgtttgctacaataggtctagcattgcaaaaccttttgcaattttgagggtgctaatttaatttttgtctttgcacaaatatatacttaacaaaagaaacgatggacaagccctgttttactatgtgaaatgatggctccagttcccctgggcatcaacaaagcaattttactataccattttagtcatactgtccagaggattgaaggatgaaagaattggagatcatttttctctgtagctgttgaatgcttcattaatgtcatattgaatatttaattgcatccaacttttcacaggagcttctgaagtacagggatgcagcacaaatggctgctgttgaagctatgcaggaagcttctgctgcagagaacttgcttcgatgtttaaggtaattttttcactgacatatcctttgtgatgttgcaactacaaaatctataatcagcaccatttcaaggtattgccaactcctgatatttcaatgatattgaattgtttctcttgagctattccttgacttcttagtctgatactgatactacctaagtactaaccattagtatttatttccaaattgtgttttgtatgcatagccgtatgcatgtgcatcatcgctgtagttattttgagaaattttgttaactttaaggtgaaaattcttcaagtcaactgcttgcgccacactatgctcattaacttgtttccagcctaaatatgtccttatggtgtgcgtaatatgtgcagctgatatgatctgccttggattttcttttttgtacttagttcaaatttgaacccaaagccaaagatttgaatccaagccctccctatccaaacagggccttgaggattttgttgcctgtcctagcatgttgtatgcttacaacaagcaattttatggataagtttcaagtcccacatggcatctaattattaacatggttgataatcgatggctctcttgatgtttatatcacatgggttctaaaataatcgatgaccaatcggcgtcaggtcgaaatacctcagctatagctgtcaagcaagttgcaatgatattaccaaccaccaattagctccctctccttttgatccatacaaaggcttgattatgtctgcacatgcttggaatttagatttcggattgagcttgtgttcctgagtgctctacggacagattgaacaagttcctggagtccatgctagcaatgcatggaacagccagctgttcttgtctgaataaagctaggctgtatagtgtttatcttctcaaacagtctgaactgctgattcctgtatcttgacaagcattgccagacaagaactcctaacaattcagtacttgtcactgcaatgtactatgaaataaagtagtttgcactttctgctcacacactggtgcttgcagtgctctgacagttctgtgcctagtcacaactcacaaatagtagtactatggtaatgtcaaatgtgaccttttaatctgatcaaaatgtgtgttttactgatggtcccatcactgttactgaataatgcatggctgattgtacagcacaaaagttcagatttctgcaacctttttaccatgcactgttgtagaatttgtgtactcctccctctgtttcaggttataagacgttttgacttttggtcaaagtcaaactattttaagtttgtagaaaaaagtagtaacatcttcgacccaagacaaatttataatgaaaatatattcaattattgatttcggattgagtttaaagcgtcgtatgacctgaaacggagggagtagttaggaatggtgcatttgttgccgaaacaacaactaagaaatgtcctgtcactgttgtgttgatctgaatgcttatcaaatgagcttttatctgatcaaaatgtgtgagttttactgatggatcattgttactgaatgctgcatacggttacttctacagcgcagaagttcagatttctgcaacatttttaccttgcttgtgtcgttactcgttacgttcgttgcagtaataacagctaagaacttacctttcactgttgtgttgatctggatgcagctcgtacgcggaggtgagctcgacggcggaggagcagaacccgcagccggcggtggagcaattcctggctctccatgcagccatgtcccgcgccaccgtcgtcaccgactcgctgaccaaggccacggcgacctcgacggcgacttcaccggaccgatcaacacccagtgaagccgcagccgtcgacgaggagtcccttgccgtcgcggtggagcgccggcgccgggcagcgtcctgggtgggcgccgggctcgccaccgacctctccgcgttctccctttacaacctcaagccgccacccgccattgctgcctccccgctggccgtcgtgctcgtcgacgagtcggcgagaccggcggcggcgacgaaggcgtcgccgcccgcgaagtcgcggctgttcccgcccaaggtcaaggggagggtgggacccgtcgctgcggcagtggcggcggcgcctgtccctccgccggagtgggagaggggaggcggcgcggaggagaggggcgagctggcgaggcggctgggggaggaggcgagggggtggttcctggcgttcgtcgagcggttcctcgacgccgacgtggccgccgccgccgcgccgtgggatcgcgaccgcgccgccaggatgctcccgcagctgaagcgcgtcaacgactggctcagcgagatagcgaagcccacggaaccgccgccgccgcaatccgacgccgacggcgaggaggccggcggcggcgcccccgccgttgcgaatggaggcggcaacaccgtgccggaggagacgatagagcggctgcggaagaagatctacgagtacctcctcaccaacgtcgactcggccgcctccgtgctgggcggcgccggcgcggcagcgaacgggaagagggtctgagcgacatgggccgtcagatcttgcacgaatctcgaggccagcatggggaggcttaactggcctcgcaaatggggtgagttgtggcccgctttcgagttctatctagaatttctgcattctctaaaagagcattctaaaatctaaatttgatgcggaaaatgaaaaagagaaggtaatttgtaatgataatgatgtatacagtaatacaattgattgtttcgattgttgaaatgaaaaaagaaaatgaaagagtaaattacactcgtaatacagggacaacaacttagcacgcaacccttgtcaattccttagattgtcttcctttcttcactttcccaactcatctctttcatttttcctacgccttttcaaattactaaacgtgtttttttttaaaaaaattatatacgaaagttgtcttaaaaatcatatcaattctttttttaaaaaatagctaatccttaatttattatgtgttaatgcatacattgttttacgtatggataggagggattcccaactcctttcgtttattagaacaaacttttcaactaataaacagatttgctagaaaacttacgcaagttttttttcccatctacacatgttgcgcgtaagattttagtgatagcttgtgtagtagttataacgtaattactgtcgaaacaagattttggcaataataaaagggggtgactatcaagctaagaaagtggatgggtttagagacaaggaattttatacaggtttaggccttcttattcaagaagtaataccctactcttgtccggggatgattccgccgagtgtattattgattgtatgattgggagaaaaaaaatcgtcccgagaggaacctggacccctccttatataggggaagggatccgtattataaagtacagtccatatcctaacggaacatgagattacagataaaatacaatcgtaaccgactaggatcccgagtattttcttaacatacaagtttagaatctaacccgagtcctcataaagatattctatctatatttggtaccatatatccagctggaatgtaaccgccatgtagatatggggtaaccataatcttcacagtagcccccgagaccttcgcagttgaccaaaatagtcttctcgaaacaaaaaacaataatccgagtgcttcaattcaacttgctccggcttgccgagtgctaaaagactgcgaagggcgaaaataaaacatggtgcatcgagtagatgcacctaattaggtgtagcccccgactatgtgattagttgaaaaactaaacatatagtcaagaaccgggtgactttatatcgaagcatgcatggtactcaataaaatacccagccgactacttctcacttgaatatatcaaggataaaaaatatgaaaagggccgaatgataaacactcaaaaggtccaaaaatagatatatttggtaggaatccgagtaagaaactcttaaaatgatccaccaaatatgataaaggtcatggtaattaagaagttcattagcctaggctataacccttaccataatcaaaataagcatataacatgataggagaatgactactaataaaccagtcatctcaaattaacccaatagcttttgtagcctaaaaaagcttacaaaaatggtataacacctttctgtcgggcaccttttcatgtgcatcataataattccaaagaattattgaatcgcgttaaaaaggattttaacagcatcgggccgcgtcattgtgagcacatattgccaaagcaaaaggcacctaagtccctagggatcacaatgggccacgctgaaaacataattgggctgaagtactgtacaggcccaagcccattagtactcccgataccctaaagacaccgaagtccaaacgtcgtttcgtcttccctgccgagactctcgccattccccactccgtgctacagtacagaaccgcaccgacgaagctagggttcatcaatctgctccaacccaccctcaaaaacttcacgaaatttctccccgcgtccaccgctccgattccccattcctctccagccatatctcggaccaaattaaaccatccagttcacattcatggcggaagaaagagaaagcttcgaaagtcagtgggcgccctccgatgtgacagaagataacctgaaggagatggtggcgcatggcgttctcccagcgaaggagattatcgggtggcgaccggcgttcggcgaagcattcccgacccccgacacacacgaaatcgtggtattcgctcatttcttctatggcggattttctcttccaacctctagattcttccgggggattctgaacttctacgggattagcttgcatcacttgaatccaaactccatagtgcatattgccaattttatccatgcctgcgaagcttttctgggcattaggcctcatttcgccttgttccgccgcatcttcttcctcaagccccagccaaacaaaagcaaaccatgcgttgttgggggagctggtttccaactcagaggaaccttgagccaaaaatatttctccatgcccttcaaaacctcaaacaaaggctggcatgcaaactggttctatgttcagaatcctgagcccgcactccccgagtactgctgtcttcctccggtttaccaggacacatggaactcattgcctatgggagatgaagctgctcaggcaatggaattgatggaacgcatgctaaaactgaaagaacaaggtttgcagggagaacagatcactcagcacttcatcaaaagtcgattagctccaatcaaagagaggtcccgcacaacttttgagtttgatggcaagcatgatccaaatcaggaagatccagattctcttgactttaaggtcatgaaagaaagaatgtacaagatcttctcaaacgctattgttgtcagctattcacatctgctgcccgttgtgccattcaacgcattcaaccctcctccaccggtatgcactcaaacatttcaaccttcctcaaaagtatgcttttaccctctgttaagctaattgaaagtttgaaatatcatgcccaggaatttgctttgatgaaatcggatcctccaattgctcaacgccgatcacctcgccagcagactggtcaggcgagtggaggaccaaaaattcgatctgacgctcgaccaagtgcttccgatccactgttgaaataatactaacagcataactcaaactcgtaggaagccgtctgacatagatccttccgaaaaggaccccgagccgactgacatagaggcaaacctttcaaaagaaaccgggccagctgcagaagatcgtccgagtgacaaacaaccggcaaccgacaatgtagaagccagcaacgagcccccgactgggaaccagtcggccgaaactgaagtcggtgctaaccaggagcccccgactagaaaccagtcggatgcagggtcaagccaaaagattcccgaagttgaagctcaaacgaacagtccgctcgggaaggatgctgacaatgaatcagaaaccagatctcctgtgaaggcaccaaagtccactcgtccccgaccgggaatcatcacaggtagacatgccatctgaaattattttgatccaacagactttatttggctgcttcatcttcgttcatggatacactagggccaataattggtgatgaagaagagatcctccggatacaagcagctgaggattcacaccctccgattctggtcaagtggtgggatgacaacatgcagcctcaagggatcgtgataaataagcaaaaagaggacgaagagttatgcctactgaagaaggcacttggtcaggcaacccgcattgtaaatgtaagccctctggtacctgatctcaaccatcttgtttgccatttaattcatgcgctaattaaactgtcttgcagaggatttatcttaggaacgaagccaaaacggtaaccttagagaggttagtccctcatctcgggaccctcgaagccaccaggaatcgactgcacgaagcgaaacaacttgccaggaagaatgaacatgatctgagggatcggatcgctgatctccaggaatcaaattttgaactgagtggctcatcaaaaggtacgcacaaactctgctcaactgactcatactgttatctttgcaatcttgattaaccgtaatcaatgtagtgcaagctgccaagatatctcagttggaaaagcagattcaaattctggaaaatgacaaggcagaactggcaaaacaaagagacctggctttaaaggaagttgaaggtatcaacaatcaatacctcaaaagccattatcctccatatgctgacttattaatgtgaatctgttgatgcagaccgcaagatcaaatctcaagctcaattcgacgtcctggttggcaagatcaaaaaacttgagggagcccgggatgaggttgctaacgctgctgccccaattgttcaaccgatgttcttcaataacaacggcccgagtgcacttgatgcttctgaaattttcgacaagctgagagttgctccggatacatatttcaagaacatcaaagaagctggaagtatgggagcaagtctggcgttggcgatgaccaaatccctttatccaagagttgatattgatgccattgatggctttgcagacgggatgagcgaagaagctgctcttgacctcatcagtgatgcgcagaaagcggctgacaaaattgctgctgatgtagttgagagattccaagatgtcgaccttcggccgactgggtctgataagtctgatgatgaaaaaactgatactgattaatgtaccaatgattttgacgattaatgatgatggaggcacaatttgtacaatactgatgaatttatgctatgcttaatatcttaacttagttcctgatttcttaaaagtttttgtcgaaccttgttgagcctaaaacccgcaaaagttgttaaaaaactttcagtcctcattgactaagccaagaaatcaaacagggcaatgatacatcaagtaagcaaattgaattgataaaaatcacactccattattattatagtagccccctgactgaaaacttcaagaaaaaacttgaagttagcagtcaaagaggaaagatacaaacgaaatgcctaagcgtaaaattgacgaaggtgttcaatattccaagaattgttgatgagagtaccgtcttcgcgcttgagtcgataagaacccggccgagtgacttcagcaattatgaacggtccttcccataagggagataatttatgccgatcctgtgttgtttgaattttccgtagaaccaggtcaccgactaaaaaggctcgcgatcgaacattccgattatgataacggcgcaacgcttgcaaatatcgagtcgactgaattaaagctgcttctcgggcttcttctagtcggttgatgttgtctactcggccctcttcatagccctcctcattgaagttccgaaatcgtagtgattcaaattccacttcactcggcaacattgcttctgcgccataaaccaaaaagaacggcgactggccggtagcccgactaggagtagtgcgtaaagaccaaagtacggacggcagctgatctacccacttgccagcataggggcgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaacgctccgccaatgaattgagtgccattatcagtgatgatccgattgggtaccccaaaccgatgcacaatgttgatgaaaaaatctctagctttatctgctgtgatcgtaatgaccggtttagcctcaatccacttggagaatttgtcgatagtcacaaagagatgcgtgtaaccgccgactgcccttttaaatgggccgaccatgtcaagcccccagaccgcaaacggccaggacaacgggatggtttgcaattcttgggctggcaaatgagtttgtctggcaaaaaattgacaaccttcgcatgtccacacaatcttgtccgcatcggacacagctgtaggccagaaaaaaccttgccggtaagctttgccgacaatggtccgtgcagcagcatgattaccacaaataccagaatgtatatccttcaacaattgtctcccttcctccaaagatacacagcgctgcagtattcctgatggacttttcttgtacagtttagcttcatgaataatgtaaagtctgctgcgcctggaaatccgctcggcttcatttttgtcttgagggagttcttgtttggtcaaaaattttatgaggggttctctccagtcggcttcaatcatgcttacgccttgagtatccatggcttcaattgcttcttttctgggcacggttggttcataaagatgctcaacgaacacatcagaaggggctgcttcccgttttgaactaaaattggccaatctatcggctgccttattgttatgtcgaaggacatgggtgagctcgaatccatcgaatttatcttccaacttgcgtacctcttgtcggtaagcggtcatattatcatctagacatgaccactctttcatgacttgattaacaaccaactgagagtctccacggacgattaatcggcgaatgcctaaagagattgcaatccttaatccatggagtagcgcctcgtattccgccacgttatgggacgcagaaaagtgtatccacaatacgtagctcaatctttctccagtcggggaaatcaagacgaccccagctccagtgcctgtgagcctctttgacccatcaaaatgcatagtccaatattccatcttttcctctggcatgtcttcttggcactcggtccactcggcaatgaaatcagctaaagcttgtgacttgatcgaagttcgtggcttgaacgatatgtccaaatacatcaactctaaggcccacttcgcgatccgtccatttgcttcgcgattgtgaagtatatccccgagtggaaacgatgtgactaccgtgaccgggtgactttgaaagtagtgagataatttcctgacggtaattagggcaccatatagtaacttttgaacctgaggatatcttgtcttggagtcggctaaaacctcgctaacgaaataaattggacgttagactttttgaacatggccttcctcttcacgctcgacaaccaggaccgcactcataacctgggaggtcgccgacacatataatagtagcggctcttgcggatgtggcgaggccaaaactggtggagtggtgaggagtttcttgaagtcttcaaaggctttctgtgcttcgggcccccactggaaattgtcagtcttcttcagcagcttgaagaaaggcatcccccgctcgccgagtcgtgaaacgaaccggctgagcgccgccatgcaaccagtcagcttttggacgtctttttgggagcttggcggtttcatgttgaggatggcgttgattttctccgggttggcatgtatgcctctttgagataccataaatccgagcaatttccccgacggtactccgaagatgcacttttccgggttcagtttcatcttgaaagcacgaatgcttgtaaaagtttcttctaaatccgcaatcaggtcatccttctgcttggtcttgacgactacatcatcaacataagcttcaacattgcgaccgatctgagttgaaaaacatctttgaatcatgcgttgataggtcgctcctacattcttcaatccaaagggcatggtgatgtagcagtaggccccaaagggcgtaataaacgaggtcttcaagcagtcggattcttttagttggatctgatgatatcccgagtaacagtccaggaagctaagtaactcgcagccggccgttgagtcaaccacctggtcaatgcgaggtaacccaaaagggtctttgggacaagatttgttgaggtcggtataatcgacacacatgcgccattgccccgtctttttccgaactaggactgggttagccagccagtcgggatgaaggacttccttaatgaagcctgctgctaacagcttggttaattcctccttgatcgcatccttcctgtcctgttcaaaacggcggagtcgttgcttgatgggtttggcgtcttccttaacatgtaaagagtgctcaatcacctctctagggataccaggcatatcggatggtttccacgcaaaaatatctttattattctgaagaaaggtgatgagcgcgctttcctatttacaatctaactcagcgcctattacatcagtcttatcaggatcggagggatctaggggaatctttttcgtcttggcatcactttcttcggtcttcgtcagcttggttgcaggcacttctcgctcgcttgccgtggtcgcagccagtcggatctcttcgcgggcgagagcagtctcgtgggtttgggccatctcgcaactttctttgtcgcatgtgacggcctgcttgatgtcgctccgtagtgatatgactcctcgaggaccaggcatcttcatcatcatgtaggtgtagtgtgggacggccataaatttagctaaagccggtcgtccaagtatagcatgatatgctgtctcgaaatcagcaacttcgaaacaaacattttctgtgcgaaaattctcccgagtgccgaaggtaactggaagagtgatctggccgagtggtgtagctgacaatcctgggataacaccgtggaagggtgcattactcggctttaattccgtgcgaggaatctgcatatcgtccagggtcttagcgaaaaggatgttgagtgcgctgccaccatcgatgagagtccgtcggagcttgacattgcgaaccactgggtctagtactagggggtatcgccccgggtggaccactcggtcgggatgatccgagcggtcgaacttaattgctatctctgaccaccgaagatattggggcatgttaggctgaaccgcatttatctcccgttctgtcagcttttgttttctcttagactcataagccaggggtccgccgaagatgtgattaagttctttgcgatgatcttgaaaaccagtcggggcatcgtcttcatcatctttcttctttgatgtgccttgatctccgtctgaaggtttacgtgcgttcttgacgtattgctctgcgaactgtttgtagacgaagcaatctttggccacgtggttggagttgggatgatgcggacattgggagttcattatcttgtcgaaggtgttgacgcggggacgttgtcgggaagatagagaggtggtcgccacaggttcttcgggcttacgcttgcgatccttgtggttgttacttccactccctcctacagtcggcgtgtccttctttggcttccaagtggtgcccgactgtttggacgtggtgatagcatcttcggctttggcatactcgttggctttttcgaacatctgcttaaccgtcctgggaggtttacgtccgaacttgccgactaggtcctcgtggcgaatgcctttagtgaaggcggtgatgatgacgtcgtcggtgatgtcggagatcttgttgcgttgttcggagaagcgtcggatgtaatctcgaagggattctccagacttctgaacgacgttgtagagatcaaactgtgtgccgaggcgttcgaaggtgccctagaagttagcgatgaagtaatcacgaagttccgcccatgatccgatcgtgccacggggtagtccgtggagccaggatcgggcggagtccgctagggccacaggtagatagtttgctcattgttatgtcgaaggacattttaattatactatcattatatctgaaagttttttttactaaaaatacttgcggcagatttttaagatattctcactaataaaattgtgccatccctctcactacacacagagcgggcaacgagacgcacatgcagttgctagctatcaacggtaccgagatagagtattattaggtactactccacagagtgttagtttagtgatattatacctcctaaatcccgattagcactagaaatacctcgacctcataataccttttgaagaaccgaaaatttcccttttcctactgtttctgattttacactaagcacattatgttcattcggcaacccttgtcggttccttagaacaactacatgacagaactaataaaattttgttttttttttaaactaggaagcagagctcccccaatttcattaagaaaaatgagagctacaaaagtctttacatgctacttaaagcagtctaataataaaattttgtactcaacacataacatacttgcccacaatctacagccgaaaagaattaatggtccctctagatcgatatactgtatggtaaatcatttgcttcatcatccttcttgtaaaagatgtggaaaaccagaagaggatgtatatatatatatattcctatgcatgctttcactcatcatcaagacctggtatgtacaataagttgacgtcgaacataactgggctgcttggagccactcttggccttccaggagctgaagtaaggcccttcggaaatgctagctgttcagatcaagaaaaacacgaaaaatcaaattatcaccctcctttcaaatctctgtgctaagaggggaaaaatgatgccatagcaatggctgcaattgtctggccccaaatttaccacatctttcattttctcttgcataatatttgttgacattggggagtttaggctacttaccgggccaggtatgtataatcgccgtagtcctccaaccttcattgacaatatcccttcatcaagtccctttatcacctaatgtttaccaccacaaatggatgaaagaaaattgaattgtttttaaagcattttagttagaaggcgcataatgtgttttccagagggtagtttggttactgatagtgtaccaaacattttcttgcaaaattacatatggtgaattcatgttttattaataatacgaactatacatttttcacgtagcattatgtatgttacattagtgtatttcatgtgcaatttacacattagacataccaagagttttaatttgaaaaccaaaaaccagacgttaaccgacatgttccaaaaacttgttagcagcttgttaccctcaattactagtttaataaaatattttggattcaatctttttccagataaaagtggtaagcggtcggttaccctttctcaaagggaccagttggtattttgttctgaaactaatattcaaaacctttgttcgtactctttaacatttaagttttaaatattaattcaaattgttctgggctggtataccgatagccagtcgatggcttaggatcggtaagtaccagtaaccagccgagattttgattcattgtacaaacacgatcaaatatataaactgtatatgactgtaaattgtatatttacagtcatctacagttcatatatttgatcagtttgtaattttattactcacatttcagtggtaatatttcagaacacaggctaccaagtaccaacaggaatatgtagggaaaaaaaataaatacctgtcctgaaccaacacggaatatgtagggctgccccttttccagagaactgtatacaacacagacacacaagaaaatttcagcttgcagcttgcaagtgtacttgaacagcatcaacttaatctcgcctatataaaagatggttagtttggcatcaaaagctcagttcgcacctgtcaaatatctgtccattcggtaccatggcaacataatttgcagcaacctaaatggtaatcaaagagagaaaaaaagaaacagattaagaacatgatcatgaacatctgcactgtgagaaatcaagtgagcacctggaagccaatgggtggacttgggccttcacccactttgatatccttgtactgaagaccagactctgtagtcaccatgggcaccttgggaatgcatcatgatgagttagttgctgagattagcattgattagatgattaacatttactaatctcatcgctaaacatgatcatgtatgtaatcatgcatagctcaagcagggttgaaaacttgaaatgttcctaaccagaaaacagatcgatcaccctggcaagaaagaaatttcaggtaaattttttttaaaaaaaatcgatcagagtaagtacattttcgaggtccttctcgcaggcggcgtcgcagagcttgggcttctcctcgggaggcagcccggcggcgagggcatcatcgaacgcggccaggccgagcgccagcgccgacgatacccccacggcgactccaagaacgctcctcctccgggaccgggtggcgctggtacagaccacgccgccgtcatccactccgcgctgctgcggcggcggcgccgttcccgcctcaccggcggcctcgcacctgcagcagcagcagaagcatcgccgcgccgctgaactcagcgccctgctgcccctgaacgccctgccgtcgggaagccacggtttggaggaagggagcgggcggcgggccgaggggaggaggagcggcgaggcggtggcggtggaggaggacgaagcggttgcagccatggtggaagaagaaggaagaggagaggaagacgaaggaattaagcaggtacggatcaggagacgtgggagaggaggagaatggatagcgcaacgacgcatcgcatcgcatactgggctttgcgcgcggtccgcctccaccactcgctgcgtcgggtcaaactgaaatctttcgggtgctgctggtccacgtgtcactcacagagggtttcgatctccatctcgcctgcaactgcaaaccacctcgctggctgcctcggcagcatttttcaccgtagtccacgaggtgtaaaataagaacgtattatgggatcccccatctctatcataagacagtcacaaaattaatttggagagaaacttcagctcgatcaggtcaagcggagattgtggtgcgtcatgctacctgtgaataatctcaagttctgaactctaaacaagtggttatcacaagttagaagaaatacagtaagaattctgaagattaatttgcctgtattcattggtgtcacggtgactctggtattggaacatttctttgcagtaggtagtagcaccatgccaagccatcagattatttttcataagagtgaaatgcacatacagtccttaaactggtacggatatatcatttaggtccctaaactctcaaaatgaatttttggatcccaaacttgtaatgagtgtcatataagtccaaacgggctccaactcgctccgtgagatgacgtggcatgccacggtaacgcttacgtgccagtggatccacatgtcagtcatataaaaaaataaataagagaggagagagagagagagaagaaaatgatgtttttaattttgaaaaaaacaaatgaaaaaagagaggagaaaaaaatatgtcatgtggttgacatatggggtccactgacacgtaggcgtcaccatgtcatgccacgtcagcacacggagcgggttggaacacttttggatctatatgacatccgagacaagttgagggataaaaaattcattttgagagttcagggacctagttaacacacccacgtaagtttaaagactgccgtgcactttactcttttcataattatactttcgataataacatgtgtaaactgtcagacagaaaacacatgatcagagagtaaaaacacaactgcatacattgcaaatttgcgattatgcagctcaatcgctggttcgtaatccctactaccaccgtagggtttattcttctgacataaaacataaaaacatggccagattgcagggcttggccgaattattgtacaaacatcatcatcctggtagtaatatatatagttgatgcgatcaaacaagctattcgagtcaccagacgttctaataaatactccctaaatatttgacaccgttgattttttttaaacatgtttgaccgtttgtcttattaaaaacttttgtgaaatatataaaactatatgtatacataaaagtatatttaacaaagaatcaaatgataggaaaagaattaataattacttaaattttttaaataagatgaacggtcaaacatatttaaaaaagtcaacgacgtcaaatattcaaggagggagggagtagtagtgtaaggtttttccaagtgatagaaagtgatgatgggactcctgacagcgtggtgccaatgatactctgctgatattgagcttcctctcacattatctaattaaactgagcttcctctcaagtacagcaaccaaccagttgcatatgttgtcagtgaactgaaaataggctctcctggaagctgcactgaatatgaaggtggttgaaacggtgcagaatccaaacgcaaatcccagcagagtaaacatgtatgtcagcgtgtcaaaaatctcatgatgtttgtgtttgtcgctgtccttgtggcagcttcttgtaagtggagccccacagagatcttcatttcccaaaaaagagtctccttcaaaagtcataagttggtttccatatggtatctttcctgagaggtggttgtaggatagattcaggaagctcaaaaataacagtgacttcatgctctgaggaattgggcctgatagatcattccatgagagatcaagtgattctaaccaggccagatttccgattgtttcaggaatacttccctcaatgtgattccttgatagatttaaggacgctagtctgtaaagatttcctatttcactgggtatctccccggttaaatggttctctgaaagatcaatactggtaaggaggaatgatatcacgaaagtaagtctgtaacctctgaaggttgcctgtaaagtatctttgtacacagaaaagtaagcgcccccaacgccataaaccatgaattggaaaaaaggcgatgagtcccattctagatttcgtgagagaaaggacgttagttttcccagagaacgtggtatagagccagagagtttgttgttactaagatccagatattgaagggcatgaagttgggataattcttcaggtatttcaccggaaaactgatttgaccctaaaatcagaagtagtagagtttgtaggccattgcctatccatgttggtatgtatcctgacaaattattctctccaacgtcaaggactaacaatcttttacatgactgcaatgaggtgggcaacaatccagataagctgttcttgctgagatgcaatgctgtaagggaacttagagagcccatagtggatggtatttcaccccaaaaattattgctggagaagtctatgacatacatactggaattcatacgccaacaatttggaagttcccctgaaagattgttattggatatgtcaatcagttccattgatattatgtcacatagatatgccgggattactccactgagagaattatgagagagcgacaggtattgcaattctttgtctccaaagctttgtggtaatgatccagacaagttgttgtgggatagatccagcactcgaacactatttggcatatcaggaatgtatccctcaagttgattatgcctaatgttcagagttatcagcatttttgatcgcaccaaacttgcaggcaactcaccagttatgttgttcatcgagacatttaagctagccattggcgaagagaagttccagatccaatctggcaatgcacccctgatgcctgcactgccaagatcaatcatcttgattctagtttgtgattgcagccaggttggaaactgtggtccaaccaggcaaccatgcagtcctagctttgtgagctgaaagggtggaaaccagctatgcttgactacaaccttgaaagaatttgatgctaaaactaaagcatccaatcttgataaattggtaaagtggagttctgataattcaccaataagtttgttgaaggaaatatccaagtatgtcaagttcgatagcctgctaatgctagttggtaatactccagataatgaattctcactgagatcaagaacttctagacttgccatgtgctcgcaccaaccagatagctgtccagttaatttgttatcagcaaggttaaggatctgcaacttcttcatgcagggaaacatgctccttgctgcttctgagagatttcctgacaaaatgtttctagaaagatctatgtgaactaagttgcataatctgctcattgaacgtggtattgctccattcagcttgttgttccctagtccaataaactgtagtgctgctagtttccctagctcatcaggaatcctgcctgaaagttcacaactagacaggtccaaatctgaaagggaagatagattccaaatccaatctggtaaggaagaattcagttcattattcttgagatcaattactttaagggcagtgaagttgatctgagaaacagaattaaggtccgtagctggaaggcttgcatcattcaagcgaagcacttccagcaaatgaagcatattcacagcctgcagccaatccacagaagcagcaaggtacaaccaactaaggtcgagatacctcagggaagttagcttcgaaacccactggaaatcgtccgcagtgatcacatgagaaccagatgagctcagatcaagaaagctgagccttgacaagttgccaagctgaggagggacagtcccaccaaaaccagcatgcgagagatcaagatacctcaacatcttgaaacagccgatgaattctgggatgggcaccccaccgaagtcactttgactcaggttgaggtacaccaatcttgtcagaccagacaacgatggattgatctgaccattgagagtgtactcgccgaggtccagcttgatgacatggccagtcttcttgctgcagctgacaccactccagctgcaacagttctcgccatgccatgagtgtagccgcccatcaggatccttgatactggtgttgaaggcaaccaaagcatccctctctgtggagatgcacgcagctatctccctgaaattgatggttaagcacaacagagccaaagccataagcaatccattcatagtattttccatgttggtggataaaactgtcagtactcagtagctggtggtagaatagagaagataggtcgagttgcacctaattggataaatggaagtgctgagatgaagacttgaccagttgacctgatgacctctggtcttcgctgctagtctagtctttctgcatttttagtcatctgaaaaacttgctttcctgtgtattaattgcattttgcagtaactggcctttttggcttgacggccagggaggaactgcaattaccgatcgagaaaagggtgtacacaagggatatgtttgctgagattaaagcagtaccacctgtacactctgggaggttacaaacttacaattactgcactctaatattttttttgattgaaaatactatcaggccttgcctatatattaaaggacaaagagcattctttactgcactcaatattataattcactcaagaaaaaccaatgttgtggtcagcctacccaggttcaattcaagtcgtaggattggctaggatgatgtagagctcatgtttagttttcagataaaaaaggcaagttcttactcaatttgcttttatacttggattcacaaattgatctcctcttcccgggaaaatctacatcttgctcattcatatttattggcctgaaatttctggtagatctaagcacggcattctcagcctgactaacatctcagaaaatgcaaatgttactgaaacataaaccaaccccctcctgctaagagcctaaggcactagggtagtgaagtgaactaaactacgaaaggattggcactaacgaatttatagcgggatgtacagtaatccggaaacagtaaatcgtagagaggaagaagcctgtgcggccataaacctgaaacccgaactcccaaacccctagttgcgtacctcgcagcggagaccactccacgctccgccgccggagacgtcagccggcaagccgccacggcgaacaggcagcacggtgttggagaccagtttgccgccgtatccgctccacgggtagctcggcgaggatgagggcagagcctactgtcggaagcggcgcttcggttgagggatcttcaggtgagggtacctgcggcggtgaccggtggagctacgcctggagcggcggccgccggcggcacatgctcgccctattctattcgagaatttttttcggttttagattttttttaaaaaaatatttacagaaataatctatcggctaaaaaaattacaaaaatagaccctgccgcccacctctggggcggcaagctgacgtggcaaacgggggaggaacgggcggtgacggagggagggtttttttgcaggaaaacccttgccgccctctggtggggcggcaaggggcccgaatacaaaaaagccagtcggggctggctattttgcaggcggccccttgccgccctctggccggacggcaggcctcgctgcctataaaaggcctgctgcccagcccccagccctcattcttctctccttaattccagtgaaaaaaaaagaagagaggggaggagaagagaagaaggggcgaagccctgccggattcagacgccgatttcaggtaatattcatagatcctatatgtgactattgagttaaatagtgtgtgttctttaaaaatttgtttgaataaatgcattatttttttgggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccagctgagaggagtgtaccttctataaaaggatggttaatgaggggcttgagagttgatccacagacaagtgacataacaatcaatgttatagtaagtcggacaactaagggtttttattgggaactaatgccagttcaaaactctcgagtgtggagatggtatttggaaaatgcattgcaacgcaagtggcctctagctttggttccgtttgttcacccgaaggatccaggtgtgcagatgaacatggatgatggcgagggaccaagtgctgaagtaaacgagacttctgtggaggaggtcaacgcacgagaggacgggggcgtagtagctccagtgggcattcaaccaggtggagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgatgttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacgcgtataaggggaaatggaaggattattggacagtgtcagtcgttaccaagcatacatgttttctacctggtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacatcaggatacacctcagttgttggacccggcgatagatcaccgacaccagtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgattgatggaggccagagacgcacacttttcacttgctgtgcggtgaggtagcccctaccctacaggacgtatcgtacttgttggggctaccgctcgcgggagacgctgttgggccagggaccacggctatggactggaaggatgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattacatatttagtccgcagttaaggtgcctaacattttatcgactgcttgcaggttgagcagctacaggcggaggccgacgagtactcctacagccgatgtttggaggcgtacttgctctggctttttggctgggtgatgttctgtggcggtcacgggcacgcggtcgacaagggactcgtgcactacgccaggagcatcgctgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcaaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcttgagtttgttatggagttcgaccgccttctgccgactgacgtcgtgtgggagccctacagtgccgcggctacccaggctcgtgcgctgttgggtctgtccacactctgcaccagggaccaggcgtactggatgactacggttccgatggtcttcgacatctgcgttgagcttcacgcccctttccgcagttcggcttccgtcagccctttccagtaccgtttccgaccaccgtcccagctgctgttcaccggtaagatcttgcactacgctttccgttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccaagttgcgagcactagagacctctatgccaggcaccgcgaccaggacttcgctcgtgctgtgagtaccctgcatcgcaccattcctttatgttttcatgtctttctcttcgtcaaattttacgaatatttacgtacaaattaaccatgcaggtcgacgacatcaaccgggtcgtcgttgatggttcaacgacgatccaacgtttaggcgcggggattccggtacccgtagaggagcacctgacgacgtacacgcggatggtggagtcgatgcgctcgcttctccgagtgctcacctgtcgtgccgacgacgttgctcgggcagacgcagctgtatagcggccacccgtacagactggtccccgtccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtcacaggcagccggcacgtcgagtcagggtccaccactggaccatgttgggacctcatcggaccgcttgctgccttccaccgtgctcttcgacatcactgacttcgacttcgcttcaggctcgtcagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcagcgcggggcagggccagtagagcagtcttctctttgtttacttgcttcactttccagtactgtatgcttgtgtaatgactacgttgttgttatatgtgcacgatacctttcggtgcatgcacgactactttctgccgcaccgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccggggtgttgaggatccaaactggcgtagcgatccttgtgtatacctactaccaccttggtgccagcgtcctctctgcctatgcggtgatcgatgccaactaatggcttcgaggaatcctgatattcaaggaaggcgcttttttaggtgccctaactatgaccgtgaggtattttattatctgcatatgcttattcattctgtatgggcaatcgctttattcttcgtaacactactctattcggcagacccgcactacggcttgtgcatacatcgagtggatcgatacaaaaaatcccgttctcgacctaaccacttgtttacaagaaggtcgctggtatttcgcatccgaaagtaatgagcaatacttacagagaaaagcggcttatgaacgacaatgtcgtgaacaacagagcgactggcgggtgctaactacggcactccctccatgggaagcttgtccaagatgcaggtgtggtgatcgttgtcaggtttttcgttccataaatcctacaacattgggttgaaggttctttgtttgtccaaatattcttgacgacgatttcatggtaagaatattttgattacatgaatccttattttctcacaacatttactaactttgcttgctttacatctattctttcctcctaggaaccaccaaggagatgtcaatacagagaatggatagacaccagaagggttctaactccacctagccgtgttgtgcagcttgaactaccagagcaatacagggttactaaagcgcggtttgagagaggagagggatcctcacgtatgggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagtcgtatcatgttcaaattgtactactatttcttcatgttacataattctccttgtttaagtccatataatgtttatacgacccagactgtgataggcctatataaattatccgagtactaatacgtcgaataaggtacaaaataatacctcacttaacatatgaaattacgcaacaaccaacttcaatacatttttataacaatattaacaagttttaccaataaatacttctttatttattattaacataacatagaaaaatcttttggccgtacttttttcatctggggacccagatgaaaaagtacggccgcaagctctttatgggcggccaaaattgcaattagccccttgccgccctctgtatgggcggcaagggcctaatcgcaattttggccgacggcgcggtcgacccaccgtctgccacgtcagcttgccgcccaccattagggcggcaggggctatttctgcaattttttttggtcgatagattatttctgtaaatatttaaaaaaaatctaaaaacgaaaaaaattctactattcgatattgggcttcccgttcatgggccttcaagttaagcagtttctacttggaaaaagtatactttgactccctcaactatcgcccgagtatgattcatatcctccaaccacaaaccgggtatataaccggtgcaaacaatgtccctcggtggttttggaggtggttttggctgacgtggcgcctacgtggtggtcttgactgaatctttgtcctacatggagcttacgtggcattaaaataaaaacaataattaaaaaaaatgtaggacacatatgtcattcacacaaaaaaatattgtgggacccactgacatgtggaacccatatgtcatcctccctcattcccttcttcctccccctctctctcccttatagctctcgggagcggcggcgggccgacggctgtggcgatggggacgaggcgaaggggagtggtggcggcggcgatggcggtggggtcgaggcagaggtcggggagcggcggcggctatggcggtcgggagcggcggcggcggcggtctgggagtggcggaggaaatcggcggccatgggga

SEQ ID NO: 20862 - DNA, 16068 bp, Oryza sativa
ggcagtgcgcagcatcctccccgcgaaccacatcttctgccttctgctcatcctccgaccgccgccgccgccaccgctcccctcggcctcgtccccaccgccaccgccaccgccgccgctcccaagagctataagggagagagagaagggagaaagagggggatgaaaaaggaaagagagggaggatgacatgtgggtcccacaatactttttttgtgtgtgtgaatgacataggggtcccacatatttttttatttttgttttttctaatgccacgtaagcatcacataggacaaagactcggtcaaaaccgccatgtaggcgccacgtcagccaaaaccaccgagggacattgtttgcaccagttttgatagatagaggagttgatatacccggttttgtggttggaggacatgaatcataatcggacgatagttgagggagtcaaagtatactttttcctttctacttctgggctgcaacttcatatgggccgtccaagcatacaggcttcagtttgttcattcacggattggagaaagtatacattgagtccctcaattatgatctgagcatgattcatgacctctaaccacgaaaccgggtatatcgacttctctaactatcaaaaccggtgcaaactttgtccctcggtggttttggaagcggttttggcctatgtggctttgttgacctggtcttcgtcatacgtggcatcgacgtgacgcttacatggcattagaataaaaaaataacaaaaaaaatgtggggtccatttgtcattcacacagaaaacaaattgggggacccactcacatgtggaccccacttgtcatcctccctgcatccccggtcattcctctctctctccatcccatcttcctcgttcctctcccccctctgtatgtccttatcgctgcgtcaccccgcaacaatgatagccccaacgtcgacaaccatggttatggctaaggcagctgcgtcagagaccaagggagacagagaaggacagccgccgaggccagagcagcaaggagggtgttgatgcgaaaaacacacactggcctggaagatctgcttaactcctgtgcaggtctaaaatcttgcttttaggttcgtgagcgtgccagttgatttgatcctgcaaccaacaagaataaaagacaagaaaaacgagattaaatccataaatgatagccgatcggctaggagccgatgacatatcgtccatcattgagccgatgttattggtgatagatcggcaatgaagaatgaagcaatataaaactaaatctactcgatcggctgtagatattaacgatatataatccttctctcaatgcatattttgattaagtgattgggatagatcgagcatcatgtcgagacagtataaatcacatagatccaaagatacaataagatgacgattatatgaacgtttataacatagctgatcaaatagatctagcatgtatcggctaatactccgataccactctatattaagatattaaaacagacgaacatattaagcaaaggcctaatatactctaatgcaataagatcttgatataaagggtatatttagcataacaatcaagcatataagatatgaaatagctaaatcaggtaagatcggctgaaaccccgacgatatctctttcagttatcataaaacatgctagatattatagttataaatattacttaatagatcgaactcaaccgatgcagcattaagcataaaaataaatacaagatctaggcaaggtgatgaaaacctctaagagatggtagatatgcgatacaatctagattaataacaagatttaactttatcggctgctctctagcagtaaaaaccagccgattgtgagttaaataacacaatcaacaaagattatgaagcatatatgataactcgatgaattaaataaacaagattagagtatcataaagatggaagcactaatcccgagaatgtaaaccgccatgacaagtttacctctagttgaagatcggaatcgatgcagctcaactcgaaagtaagaactcgtcgaaacaaacgaaagtgaaaaagggtggcgatgcgtcgagagtgttattgaaccgttatttctagatcacacgggttcgggtcatatttatacccgagatacatgataggtccttgccggacacaactcttatatctaacaaactctaagatacacataagtctttacggtagacttttacctaaacatatctctaaggaaattacataaaatataaaagatacaattgcctatctgagagcttatctccatcgtggcaatccttgtgaagcacattgaccgattccagaaacagttttataaccatctcaaaagaatcggctgcatcggctgtatcggccgtattggctgtcccctgtccgacccatctcagccgatgcagactccagccaatgccttcgcagccgatgcacactctgttcttcgaacgcaatcctttgctaaatccactttgattccagtaccaaacctgatttatatcttaccaaatttggtcgttaacagagggacggttgggcgcggagcgaggggagtgtcggtgaggcgatggcgaccaagggacagaggtcgatggggttgctgacggtgagggaggcgacgatgggcaccaataagaacgccatggggagcttcgtgctacacaacgacatgtgggagctcaggtctggcactaaccccggtgccatgctatggtccatgaagaggaagacggacgaggagaagaagaagagggatttggggtggtgctggcgcggatgaagaaagggggatttagggtggcgttggtgcgagtggtggcggaggacgaggaggcaacgcttcaactagcggcggcggtggcgacaaagtagacggctgcatgcttcctccttcaatttctccgtcgctcgatgttgtgaccgacgatcctccgctgccttcgcccccacgcccgtctccgccgccgacgctccggcccttgcccgcctgctgcccgtcgccgctccaacgcccgttccccacgaacaaccgaagggtaagagataaggggaagagagagtaaggaggaacaaggaaagggaggatgtcctgtgggtcccacaatatattttgtgaatgacaaatgggtcccacatatttttttgttattgtttattctaatgccatataagcgccacgtcaacgccacgtgggatgaaggccaggtcaataaagccacataggcgccacgtagaccaaaaccacatagagataaagtttgcaccggttttgatagttggatgagtcaatatactcggttttatggttggaggtcataaatcatacttggatcataattgagggagtcaaagtatactttttcctcatagattcaccaggcgaagtcatgggccagatcacagataagtctaaatcgaatgaatcacttaagagtgagataatttcattaaatatagtaggataaaaactgtacattgtgaaaatacaaaacaaaaaggagatgtaagatataatttgtgccaggcgtttcgctcctgctagagcccaagtcttggctcttccttgattttagcttcgagggaaattgttgagagcccttttatggtggaagactgtgttcggacctccaggttcccaactcctctcactcgtttttcgcgcgcacgcttttcaaactactaaacggtgcgtttttttaaaaaaaatgtttctatataaaagttgcttaaaaaatcaaattaatccatttttgaaaaaataaatagctaatacttaagtaatcacgcgctaatggaccgctctgtttttcgtgcgctgagttaccaacttcctctagcgaacacatcggaaggagcaaggttctaaactcctctcctaggttcctcatggtgggtttccagctatatccaccaaccgtggattgatgtcggttggtcccaattggtcgggttgatgtgcactctatactcctttaaaagcctcaagttatagtggtaagtcaccttgatattgcttttataaattgttccctaatattttttaatattatgaaatagtacaacatttagtttgaacaagtgaataacagatactaatcaaataaacaaccaagtgatactaagatatttgattaaaaattataaaatatatttgataaaaaatattttgttatggtatattataatattttttctcttttgcccatggtaaagcaagcgtatagtttaacatgaattatgcaatcaacttttttttttgccaagattaatgttcgttcaaattacttattttagttcatttttttgcccggattaatcaactcgatttctgtccaagttcgtctctattgacccatggtgatcatcgtggagatcagagttcatgctgggatttgttagtcagtgacacaaaaaaattcttcagtttgttagtcagtgacacaaaaattcttcagtttcccactctactgagcaagtgtagacgcatgcagagagtttttcagcctgtgctgcttcccggaaccccagcaaccatgaatttcaaagtccaatccacggccaaggacagcagcctgtcgccattcccattcggatatacggaacccacagaattcaacaacgaactcctacttcattgaccataacagaatgaagaatatattactcgccttttgacctgtccaacacagttgatgtcatgtgctaacagtgtgctagttcgttcgtttctttcaaaaaggaagctcacttgaaccttgctggtacagattacagaatgattagcagataaccacagtacggcaaacatgaggtattttttagtctgatacaatctttcgtagaaccgattcagacatgctctgagtttgatattttttgtattatctcttgcatgacaaaaacattgataaatgtccaagtgattacacaatcacatggaattttttttaaagaaaaacaagaattcagcatgcgttttccaagtccaatatcttgacttcccacaggtgacaggtttgctcccaaatctgcactgggtcaatgttttctccccacaagtttgctctttccaaatccatggctccacacaatctctccaccaactcatttcgatatttttctactgaacacatgcgtcaactgctccagccaacacgcaatcaaaatgcttacaaatcaaaccgcctctcgaactatatatagagcagagcaccaaccaaaagaccaaagtgtttcagagaaaatttcagacttcagtttggtgttaagctctctttgtctcggcctctgaatctctctgaactttctgatgtgttcgtggaggagacgagttcttgccgtgttcgtcgtcgtcatcgtggtgatcatggcggtcgccgcttcccgtgctgacgcggcgaggccggcgccggaggaggcggaggagcggctggtggactgcggcgaggggggatacgagtcgatggtgtacccggcgatggtggagaaggccaaggagacggtggagctgctgctggcgaggttgccggccggaccgagccccaagggacccggtcactgaagatcatagtgattacatgttctttttttttttcacttttgttcatagtttgatttctcaaaacagagaaacaaaagatattcttttttacctgtatatgatatcagtaggaatactggatgtaattagacagtgaatttactgattgctacgaaggttaggattctttgatatggctgctgtcattgtagtcatgtgttgtgtgttcttgcccattcgggagaatcggaatcaccaacgaaaactttagctctgtttcatgcctcgaacatatcgaaatatcgagggagtgaaagtctagaattaaatcattcaattggggctagaggtttgaacaatgatcaaaagaggggaaaaaaaggaagacaggtgacaaaaaaaaatttaaaaaatgcccccacgcaggatcgaactacggaccttcagtttacaagactgacgctctaccactgagctataagggcgcttcttgttgaatgattgtgtatttctaatttatacttattttatatttgtgtcgacaagatgcacaatttgttgaatagaatctctccgtagcttgaatgcataaaggttttcttctaaaagataaaatgaattgcatagatgtacagtcaggtatgatcatgtggcttttctgctgcattttttcttgaaacttcgtttatgggtacggatctaatcttcgcatatgcggtagatgagcaacgcggttatgagtttgcttatccaatggtgttttgattatctctctctccagatcaatatccaaacgacttaacctgacacggactcggagtcggactccgagtctgatttccacacgagttcgtgccctgataaattcagattctggcgctgatgagacctcaagcaattcggaagctagcgcatcgtcgccatcgatcagagggcattgccgccatagccaccttcgcttcttcgtcaccggcggccatggcgtccctgtacgctccgcggctgacgaggtggcgcgtcgcgacgtccggcggcggcgtcgtgcgcgactgcgtggagtacgacgggaagccgctcttcttccggcgcgaggactgccgccgcctcgtccccgacgacgaggaggacgcgcgcgagtgcctggagatcgccggcgaggtgttcccgctgatggaggacaggatggtgccggcggcggtccacggcggcggcggcgtccgcgaggcggtgcggtgcgtggagtacgtcgacgacgacgacggggccgtgctgctgctcacggtgacggcgacggaggggaaggagaaggaggtggcggtggtcgacggcggcgaggtgcgggtggtcgacggcggcggcttctacgaccccgactccggcacggtggagcacgtggtggacgtggagggcgcacgtgaggcgtacgtgctgctcgtctccgttcgcgaggagctcaaccgcatcgtccgcgtcaagaggctcaactgatcattattctactaaatccctaggaaatttgatttgtatttgatagattcttattgtttgtggggaagtttgtaacaagttttgtgcatcgaaaccctctgtcactctgggttctgatttgaagaatgatggttctaattaacttcgaatcatactgaaatcgtcacagttctagttagtacataccatgctaaaaggacatgtagtctagtggttgcagtgtcctgagtagcacccaagattctaagttcaaatatgcataggagcgaatttcagattgggttatttgagaactagttttctcttcgatagactaagtttatattaaaaaaaggctaaaaaagctacatatatccggttagatatagacgccgggtaaaaataccttctctaaaaaaatgctgctgttacatgcttgttttaccatagagacatgaagaaattatgaattcatattatttgatagaaccccacgaattcacagtgcttgtacgacttttatatattacaaataatttaagaatgcatatactcaaaagctttggaattttgttacatgtatccgtaatcaaaagacaccaacttaattactctgccactgtcaatgctcgtcccgcgcgcggcggctcagcggcttccagctcctgcagctggctcgcctgctgcgcgtgccggtagatcgccggcggcggcggcccggtggtgccgccggcgccccacatctcgatgtcgtcgtcggtggtcgtcgggctgtggtggtggtggtggtgcgccgccgctccggcgacgttgtggacgaggcagcgcgccacggcgcagatgagcagcctcgccgcaacgacgacggcgacgacgatgagcaccgccaggaagtagtccagcgccgaccggtgcacgcgctggcattcggcgacgctgatgcaaaccattgctcgcttgcttgctgcttatgctgttgtgcatgcaagaacaagaagtatgtgtgcgagaagttgcagggacagtgagtgaactagtagctgatgatatatttttgggggcgtgatgaaaagctggagaagatttggattcgttgcttgggttggcaagaggatagagagatgtttgaacctgtaccttccttggggcttttgggatctagtcgcatttcagacagcgattgatcaatggcttttcagaatgtctttctgggaatggatcagccacaacttttaaacatttagtacgggagatcgacggagaagctatgattttcttcatcgattaccaacttaattacatgcagttacaacatgtgagttttattcccagtcttcttcatgcaacagaatacagctgaattttgtaaaatccagctatgcgaagccgccattactgtagtttggatgtgaattttcatccctcaaggggacatcctctcgttgcttcgtaatttgcttgtcatctaaatagttataaaaaaataaaaaaaatattaatatagattaatatgaaatatatctctccataaatatacaagaccaaattcaacttccataagttgtaaaaaaaagaacaaattaaactgaaaatagttctcatacattcacagttatatttgttattataacttaacattatttgtgaagtgatatatttcatactaatttatcttgtaaaattttttaaaattttcataactatttaggtgatatacataaaaacattttccatgtagtttgtccaatgtaagaaatttaccatgaagctcaaaaccagtaaacaggtgtagtttgatccaaactccatcaccactgtaacgtacgatcattcgatcaaatggatgattagatgcaggtggagatcgatcagctagcgatctacggactggaggaggaggcgagagcttcacctccggtctcctcctcctcttctccgacctgatgggaagcgacggattcagatgccgcgtcctcctccttcccgtcttgaatccgctgcggaacgacgatccgctgcctcttctccttcctctcaccgcggcaggtggtgatggaggacgccgtgtcctcctcgtcgtcgtcgtcctcgtctccggcggcgtggcgcttaggagggcggttgagggggagggggtagccgggggggaggaagccggagaaggccccggacatgaagtcggccggcgagggtgaagccgccgccgccgcgggcctccgtcctgagcgtgacgcgctcgtagaggtcggccctggcgcgcgccacctcctcggcgtccgtgctctccctcaccaccttggatagcctgcgctccttctcctccgcctcccgccgcgcgaacacgttccggtggtactccatccgctccgtcaaagtttccctcgtcgcccactcgtctatcggcggcggcggcacccagatccaccgtagatactcgcgctgccccatcagcggcacgaacgtccgctccatctcaagattgatccctctctctttcgccttagattattggattggattctgaagatttttctcgcgatcacaagtttgtaataactgacttgctaatctgatgactcgaggctgactcaacgactccgtccgattccgatatacaccaatcctttcaggccgcccgctccagtttttggatcgaaattgtgcttgcagtgacaatattcatattactagcaaacgagatgtgattttcctcgaggaacaatatttttcatacgtacgtatccaccattcatttacacaggcaaaactgcctcgacctacaaaatgttttttttttttttggaaaccgatcgatcgtcctacaaaatgtcaaaacttccaaagaggacgtaccaacagttccaatctacccatctcattccttgggcgttcaaatagtcttctgcaaatgcaaatccagcggtatgtgagggcgccatcgttgaagtttgtcgaatggaagaaagcgtcatggagctcaatgaatcccactaaaacaagctgcacatctgaagcaccacatatgcctttggcaggaaatgtcaagaacttgatccagttcccatcactttgtggtaaacttcgattgggcggtcaaaaccagtaacagcgccctccagtttgtccgtaaccacctctaccgacctgaatccgatctgcaaggaacaatgcatggtgaggcaaaaattctgttgctggggccaagaactgaacatagaattcgtggctgacattagaacataccttgtctagaagtatctcccggaatttatctggatgtattaggatggtattgaagttctctttggcaacctgaaagatgtaacacaaaaaagagtgaggtattgcaactttgcacgataaaaaaaaaactgcggtcatggaagaatcaaatgtttaatgaggactaagatttctgccagtatgttcattctagtaatcttaagattgaaataacagggggttaagaaagcaggtccagtaagagtgaggccccaacatactgacgataaagccaagcaagcagctaaaaccacaaccgcaactgtagcttttacacaagcaaggggctgaaagtaaaataactctagccttcaacaactgacatagaaacacaataagcatttcaaacttcaacgcgatccagaaaataatcaactgggtgtcagagatcagtatggcattggggaaaatgatacctctgaaaccaatctgtttctcctatatgaggtccaaggttgaggctccataataaaaactccaccctgaaaaacaagagaatccagtgggaaaatagtttattattttttttcatcttatcattgacatctactttaccaaagcacaggaaacataaagacagatagataccggtcttagaagtctccagatcttcacaaataaagtaattatgccatcgtcaccccagttcaggtggatccatttggtcacactcaaactgcatgagaataaaagcatataaaaacgcatgtgtcaatatgacatccaatgtgggtaatgatggcaattttcacaaatatgttgcaatataaaaacgacaaagtgactattattaatgacagcagaaaatctatgagatctatattataatttgtaacttaccaaacaattgtatcatactgttctgaacttgtacacatgctgtccacaaaattctcgcgacgaaaagaaacaactttaaaaatatcatgatgactgccattagaaatatccccatttgatatctcaggtgccactttttccggacagctttcagacggtgaatctgatgacttgtgagccttggtgttttctacaaccaccttatccagtcgagacatccttcttaaattccagttggcagtttcgatcaaacctaacaggacaagatcaggatcagtatagcaagaaaatagctttacaaaatttataacaatatgtttgcctaggaaagacatgaaacattagttaacaaacctgaatcaatatcaactccaagaatgctttggcatttaaatttcgcagctgcacaaggttcacaaataaaatgagaaaccatactagtaataaaatttaactaacacagacatacaaagtatcttacagtaacacatatgaatagataaaagaatatatactgcaaatagtttaaattttaaataccgtctctgttaacattgatacagaattcccaattctatttataagaggtacaacaacgtaactgtacaaccatacaattatgaattagatatatcatttttgttcaaatggacaagacagatcatcaaccaaacaaaatagtactaaatattgcacaaagatgatttacctagaccaatcgttaccaaaccctggttgcatccaatatcaagacaatccttgctttcaaaccactctctcttaaatattttaagacgagggtcttcatcaacattacggtcaatctgtagaacattagaagaaaggatgtataagctaatagagagacatcagaagagagaatttatcagatgagaacaagataaggattgcagtatccggcgaaaacaagataaggattgcagtatccggccatcgaatgggatttatattgtactaagagaagtaccacatgcagcgctgcaagtagaatgtgaaataaacccttcccccctccttgtctgaagaaatctacagtacactttggcattggcaaatcttaaggaaacaacaagatctaactaggctccctgatacttcactccttccttcgccaccaggtgtacttatgatatgcagggtatgggggcacttcctcgacctacttatgttatgactaaataatcagtcaaagtaaattagacgattttgctttcctgaaatagtgaaatttgttgttcacttggatacccgacacaatcattctgataaacaacaaaatgctgaactaaggaaacggaatagaaacagaaatttgattatctacattctacatgcccccaataaaagaacctaaactggtctactgcaaaccacaacaaattaaatcagaaatgacaccactgtaactaaggtacattctaagcgagagcttcgactgatatccattcagcgttccaatccaaacccatgaaccatcccaatcccacgagcaccgcgaccaccatcgaggcattccatcgaacagttggtgcgctcatacacacagcaacgatctgcgcgcccgcaagagaagcgacagggggaggggtgggtgttcactcacccggtagccgtagtagttcctgtagttcccgtagacgaatacctccttcctcttccgcttctgcccctgacccccgtcgccgcggccgccgccgcctcctcctcccccacgccagttgctctgtttcctcttcgcctctcctttagcccccttggccgcggacggcgcgtcctccggcgcggtggtggtggccatgctcggagaagagacgcctctctcgccgccgccgccgcggcgcggttcgtgctggagctgaaacgagaggggaacagcgcgggacaaagcggcgagaaggagacgaaaccctcgccgccgacttaagaagaagaagaagttcagagatagcccttccaaaatagaggtccagttaggcccatcaatatttgggcctatcgatgtttgggccgtaacctctcatgcatgtgcaatttgatgattaaaggatttgcacaatgtacattgtataaacagagatatgctttgcattgtttaagatgaaggaagatttagttgtgaattactcgtgttctgattttttttctttggttgattttttttttctccaatccaacgcaagctaaattttttttactcatgctctgcccctcgcgccggcggccggcctgcccgccttcccgagtcccgacggcgccgcgacggcccactgcccctcgcgccggcggccggcctgcccgccttcccgagtctcgacggcgccgcgacggcgcagcggcgctctgcccctcgcgccggcggccggcctgcccgccttcccgagtcccgactcgcgccgtcgcggtcgcaccgcctccggcctccccgacgcgcatcggcgcgcgcgccctgcctcggcgcccgccgcctggccggcatcccgcatccggcggccctccccctccggtgagcactgcgccactgcttctccggcagtccggctctcctctccctcagtccctctactctcccccttgcagtagtcagcaggcagtactacctccttcaataatcaagttctttatatccatgattagccaattggggatatagtaatttgtatagattaccacaaaattgtgcgccacaatgaacctcatatgacttttttgcatggtgtgatggttgttaggagattgaggaatgaagaagtcaagcagtgtatttctttttcagaagcatgaagcaaaaaaagttgatgaaggggcaatttacattgtcatttaggtaaattttaaacttatttattattttctacttgtattgaactatttagagttatatacccgtatcgttttacagattttatatcgaatcatgatgtattgcatttagatttttttcgctaggcctaccctaggttcaaatcctgggtccgccactgcctaaattacccaaggacgcggtaaggaaattattggactcagctattgggcttcttcatgagcctgtaaaacattagtacaagtcgccacagaaatatccgattgttagggagttcggagaagaaaacaccgaaccccaaacgatcacagagcagactgcatgtcatgctttcttctgttcagtcatcacattgatcagtatttctctcttccctaatcactcaatgacgacatgctatgtctgaattcctttttgtggagttcccttctgagttctgaatgtattccctcgttgattgaatcgagtcagattttagtttttttttccttcttctttcagtgccggatagtcttcagtgcaaggaattaattaagagcagacaatagaaaattcagcgagagtgttcaccattagccgaccctcctccaatgcctctccgctgtgcaaacgcctgcaaggatcagtgtgttggatgcctgtactgtatgctgttcgattatcccgtttgcatgttgcgccttcttctggtaggcgaggccatcagctgaatcaaacatcactattggagcaatcaaacatcaccattggaggctggagctatagtttagtttcctgtttgtaaagaaaaagtgaagaatgttcgtgactgccgggggtcggagaataaaactccgaaccccaccggtgaccgagctgattgcatgtcgtgccttcttgtattcttcagaaaagccaaacgaccagctgatcaactatcagatcagactttttgtaattaagtaatttatttctcttgtgaatgtgttctctacgatttattttcgaagagaactctaaagaaatgcagggagttcctttttttcattatagaataacagtcactagtacgtaaccttccatctctaacggcctctaacatgcttagaattagcggactgtcataagaaagtcatctcaatcgggccgaaaaagcgcccgattgagataacgcaggtccgtcacggatgacacatatcatccgtgatggacaccaacttggggcccgattgagatatggaatgttatctcaatcgggtctaaactacggctcgtcactgatatgtgtcattcgtgacgggcctgagttttatttccatctaacatgtttgtgcgatcatatctcaacaactaggtgagagatatgtgaattttatgaacaatattactatcactttgtcggatgaaaaaatgaccaaaataaaagttatagatcttgatgagttatacaactttgttgttaatgactttttcagttgaaatcatttagaatttgaaattgttgtttgaagttgttatatttttaaattcaaattcaaactattcaaaaaatattatatagaaaaatgaccaaaataaaagctgtaaatgttgataagttatacaactctattgttgatgacctttccatttgaaatcatttagtatttgaaaatattgtttgaagttgtcatattttcaaattcaaattcaaactgttcaaaaaatgttatatagaaaaatgaccaaaataaaagttatagatcttgatgagttatacaactttgttgttgacaatatttccatttgaaatcatttactacccgaaaaattatttgaatttcttatattttaaaattcaaattttatatagttcaatcaaacccggatgaagaaatgaccaaaataaaattggtagatctcaatgagttgtacaactttgtttttgtttttgacagctttttcgtatgagttcatttagtatcataaaattcaattcgaaatttatttttgcctagaagtcttatttgtctcctcatcatgttaatacttgctaaatatatattaactcagttttgctggtgaaagggctgcaggaat

SEQ ID NO: 20863 - DNA, 23412 bp, Oryza sativa
  unsure (1)..(23412): unsure at all n locations
cggaatgggtgatcgaccggatgcacacgagtgaggataaagtacgcagaaaagactggcccgcgggcgtggctagcaagctataatttaggcccgttagagatgagagtcatccgtgacgggctatagtgttggcctgttagagatgagagtcatccgtgacgggctatagtgttggcccgattgagatgtgtgtcatccgtgacttaggcctattagagatgagagtcatccgtgacgggctatagtgttggcccgattgagatgtgtgtcatccgtgacggccggagaaattttctcacatcagtaacctttgctcagtgacggggtcctgtctgaaagatatgaggctttaggctcgttagagataactgatcccgttctagtaagttaatccaatttacaaaaggaaaccatgtcttaaaaccttacaaatgttcaattaatttggaagaaatccagcgaaaacctccacggagcaaataatgcaatagtcccaagcttaatttggaagaaatccagcgaaaacctccacggagcaaataacgcaattgtcccaagcggcatacccaccacaactgacgacaaccgacacaagtcaccgttgctaagattaaagccaaagaccaagcagctccaacttcctagggttatcctcaacccccacgatcaacaatgctgacaaaagggatatcagcgattaatcaaagtggaacatgaccttctaaacagagcctcaaataaggacataacgtcgaggacgttgtcattgcctcctggaactctaggactaggttttcatataaaagcaagagagagaattcagcacgacaacgcctccaacgaggaaagcggcacccatagttgttgccatcaccggtacctaccaaaactagggcaaggcttccgtctagtcacttcctatcaatcacaccctcctcaagtgtttcttctatgtggctagaataggaggatttaagcaagaaatggcagtgcaactatgcaagcaggcaacaccatcctacaccaagtaaaaataagggaaaacctagcctatagtgaaagagagaactcattgtcctctacgcatcctttgccgccgcgcacccggatctagccagagccgatcggtgcctctccgtgccctggcaactcatgcttgcaccactcgtgtgatcgtggcgttgctactatgtgcggccttaggccttgcgcccttcaactacctgaacccatgcaatcacgcctgcctaacctccacgctccacaccgactagccacctcgcggttgtgccgtctctctccacatattcatacctccttgttacaggccatcgccccttccgtactacgctgatcgggtcaagaaacaacagatccaaccggagggacattggatctagttgtctttgtgcactagccggccttagcacgagcaccttatcaagtatatgactaatagccaccttttcctcgtccaactcccctgcacaccattttgcctccttggccgcttaagtagtgaccttctccatgagtcacgagagccttatgacgtagtatgatgaaggaggaaaaaaggacgcctcgccactaccattgtccttggctccttgaagccaaatgggctccagctggactgctctagcagtagcgatggggaagaaagaaagatcgaggttgcgacactaggtggtcccatgggagtgacgcacgggcttttatttgtttctatatatttgagttcactataaaacactaaaagattacaccatatatagatttacaaaggacttttgctctaagcgactttagatacctttatttatatagaagaaaacaaagttcttgttgagaagtatgcgagtgatacctgcattttatagttcaaactttgtatatactagttggcaactcggtatgcaaacaagtagtgacgaaggcttttgctttgtatgatacgaaaagggctcctctaacacactactattctctaacacactactattctctaaggtaggtcgctgacatgtgaacccacggctatagaattcacatatcagttactcaaaagttactcaaagttagatgatctatatatgcaggatagctggggtgagatagcagcagcagtagaatacagctgttgtcttcatctcatgcagcttagctatgaagctaggtaacgtacgtagcggcacatattccgattcgcatagcatagcagagtagcaacgcggcacccgaaacacgttttacaccgcgcaaactctcctacaacctgtacccacccggattcctacgcgcctcccataaataattgctacgctctctcccgccgcatgcactaattaaaaagcccacacgcgacgcgacacgcccggcgagccgcgcgagcgcgacacacacagaggaggaggccgcgcgcgcgacgcgagctcgccctctgcgtgcgccgccgcgaggtcgccgccgccgccgccgccgtcgatcggcgcccgatcgatggggggctgctactccgcctacgcctcctcgcgcaagctgcgcggccgcatcagcaagatctccctcgtcatccccgacccggtccccgacgccgaggccgcctcgccgcgcaaggacggcgtcgatggcgacggcgacgacgtgaggggtggtggtggtggctgtgacgatggcggtgacgtcgtcgccatcgcgacgacgacggcggacgagttcgcgcggcggtacgtgctggggaaggagctggggcgcggggagttcggggtgacgcggcggtgcagcgacgcggcgaccggggaggcgctggcgtgcaagacgatccggaagcacaggcgcctggcgccgccgcgggtgaccgcggcgaagccggcggccgcgcacggggaggacgtgaagagggaggtggccatcatgcggcgcatgtcgtcggcgtcgtcgtcgcgcgggggcggcgccgcgtcgtccgccgccgtggtgcggctccgcgaggcatgcgaggacgccgccgacggctccgtccacctcgtcatggagctctgcgagggcggcgagctgttcgaccgcatcgtggcgcgcggacactactccgagcgcgccgccgccaacatcttccgcaccatcgtcgacgtcgtccaggtaataatcaagaacgaacactacacatcatcttcttcttctcccattgatgcatcaaatcaaacgagtaatcactaattaatcaccaacaatctgtgatcgatcggtcgatggatgcagctgtgccactcgaacggggtgatacaccgcgatctgaagccggagaacttcctgttcgcgaacaaatcggaggactcgccgctcaaggtcatcgacttcggcctctcggtgttcttcaagccaggcacgtcgatcttcagcaaaatttccacctctcatcgtccatgatttctgtcaaatcctccatggtttctgaaaccaatcaaatgttgatgcaggcgaccggttcacggaggtggtggggagcgcgtactacatggcgccggaggtattgcggcggagctacgggccggaggtggacgtgtggagcgccggcgtcatcctctacatcctcctctgcggcgtccctccattctggggaggtatatactcaccttaattacctttttttttaatatacaatgtcattgatttttaaagatatgtttgataatttttttgaaaaaaagattatgtgattaccgcttattttattgtgagtttattgttaattattctataagtatgacttaaacttttttttatagtttgcaaaagttttgaataatacgaatagtcaaatatttataaaaaaaataacgggatcatatcttaacttccttttttactatatatatgatactatttaactttttagtcatgttcaatcattttaccttataaaaatattaaatatttttcgtttgatttatcactaagaaactttaaacattatttatgttttaaagatttacatattttttttaataaaacgaattgtcaaatattaaaaaaaaagttaacggtatcatttattaaaaaaatacattaccaattcaccatgatgatgcaaatcatctcccctgtcaattcttgtcatgaaaaaaaactataactgtaatcttgtctgaacttgcaaatgtgcagacaacgacgagaagatcgcgcaggcgatcctccgcggcgccatcgacttcaacagggagccattgccgagggtctccgccaacgccaaggacctcgtcaggaggatgcttgatcctaacccatccacccgcctgacggccaaacaagttcttggtaagtaaacaacttaatcaaaccttctcaatgattcagatatacacatgattactggaaatcaaacatcattttgtttgtttcgtcgattggttttgaaacaaaaacagagcatccatggctgaagaacgcggacacggcgccgaacgtgtcgctgggcgacgccgtgcgggcgaggctgcagcagttctccgccatgaacaagttcaagaagaaggctctcggagtaagtcgtcgagttgtctcattgcttctgtgttgcgatgatcttgatgggtcgccggagctaacaacggcggtgtccggtgaaggtggtggcgcggaacctgccgggggaggaggtggacaagtacgtgcagatgttccaccacatggacaaggacaagaacgggcacctgtcgctcgacgaactcttggaaggcctccacatcaacggccagcccgtccccgagcccgagatcaggatgctactcgaagccgtaagctttctgctcatctcctcgatctcgatctcagaatcattttctttattaagataatggaagatttttatcgagctcattcaattacatggagaagatctcaaaaatcatttttcttgagtcttgatctcagaatcattttcttttaagataatggaagatttttatcgagctcattcaattacaccgaggagatctcaaaatcattatttttctgaagattttgttgagatcatccaattatatcgagaagatattactgtaaaccgttgaattgtgatggatgatcatactctcattttctcgatctcaaaatcgttttttaaaaaagataataaaatattttatcgagctcatccaattacatcgtgaagatataactgtaccgttgaattggggtggtcagaccctcgtattctcactctcaaaatcgcttttcaaagataatgcaagatttttatcgattgaacttattagctaatttattgattacttgtcgttttagacaagtaaacggtcttaaataaacaattatagccaccattttctattacaatatatatatatatatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgatatcatggtgccccatatgagtgtcctatatatatatatatatatatatatatatatatatatatatatatatatatatatatatatatatatattagaaaaaatattttattgtagtatttttaagactaatttctacatatggtctctacatttctacgatttaagaaagtttgaccaaattattatccaaaacaataaatatcatcaactcggaggtattacatcgaggatatagtaagaagatgagatgatgaatttgcaggcggacacggacgggaacgggacgctggactgcgacgagttcgtgacggtgtcggtgcacctgaagaagatgagcaacgacgagtacctggcggcggcgttcaactacttcgacaaggacggcagcgggttcatcgagctggacgagctgcgggaggaggtgggcccaaacgagcaggccatcctggagatcctccgcgacgtcgacaccgacaaggacggccgcatcagctaccaggagttcgagctcatgatgaagtccggcgccgactggaggaacgcctccaggcacttctccagggccaacttcagcaccctcagcaggaggctctgcaaggatactcttactccctgatgatcgatgatgcccaacaatctcatcaactttgtttcatcaaggcttataaactgcacatctttcaccttcaccagacagggataactagagagagatacaagaccaacttagagaaatgtattggagtggcaacacgatgcgatgctgcgcttggattgtgaaatgagaaatggaactgaaatggggatcgtaccggttttgctactctttcggtaaatgggtatttttgtttgctataatatgcacacaacatcaaaaattccatccatcaaaatatgcagctcgaacgacgaatctataagaaatcaggtactgctgagtaaacaccagtttcccacatgatttatcaaccatagattatgacgagctttggtaatttacatgaccgctcaatagataagagctacatctaccattctccagcttcacaggttggtcagtacagggggtggaactttacccaccacatcatctcatgtcatttaaacaaaaacagaacattgcccaccacattaacacaactacagaccataactaatatgtacataatataggctagaaagtaaaaaaaaaaaagactaccacatgtttgtaccccatccaccttcgctccatagtcggtcctgcattgttgctgcaatctagatacaaccagggaccttcactcacacatgtacgccattgctgccattggaagctcttcttcaacgccacataatttaggaacagaactacaatcaacaatcttctcatgagctttgagtaagcacccaccttctcaacagcttcgagatttatggggggcactggctttcagccagtttttcatctagtatctatgcttatcgcagacgctgcatgcatccaccgatgaagggttaataaacgtgcagcgctcacaaggccagccttcatctgagttgtccgaagatgttctaggaagctgcttctttgttttgcctttagtgactgctttcttggaggggatgttggtggcattgcttgatgtggtaccctgggcagtagagtgtacatcctccaagccagcctccagtgcttgaacaaggttctcaaaataattccgagtcacactgcagtggagacgaagcaaagtcaacatatcgtaaacaaagctcatatgacaataaagaataggcaaggaagctgctatccatgagcatagacagcatctcaagaccttgtaaaatgctagcaagtaaaaacatttgcgacaacaactaccaaaatcaaagaagcaagtctagggtcaacaagtaaagagcatagctgaaatgtccacctctttgactgtttgactactttacatgatggattaatactaaatcattaccaagagaaaggtgggcacaaacaaagttcatgtcctttattagaattataaaatctcaggcttctaaaattctcaaatggcatttaaattatggcataattagttacattcatgtgaacctacccaaggattgttaagaacaatgtaagaacgttcaaggataatttggaaggagcgcaacgccaaaatctttcagcacaagcaacacaccgtggagcggttattggaagacatcaaagaagaagtttcggtgtggacgtctggaggttattttcatattgtgtaagacatcaaatttttattgtagccttcagccttttctgtatggcttcgattgtttgggggacctgtccccaccctaatctcgacatcctactgtcgatataaagcccatttgtaatttgttccccttttccttaatgaaatttggtcgaccgaacctttcggccgacccggcaaaaaaaaaaaacgttcaaggatgaagaaaagcaaacccttgggttcatcctaaaaactagtactaattgaaacaagagtaactatcttaaagcatgcagtagttgaatatggccaaacccaaaaggatataggaaaaacaataactgtgaaataccttgtcagccccgcaagcttcacccggaagtcaccgaattcagcaattgatggtgcaggttcagtattatcagatctcacagtcaaaaatgattgcaggtctttctcagcacattggtgaagacgctccagaccagactcagcttcacctataaaagatataatatacataccacatgatttttggcaagcacgtggtagaacttaggattttattttggaatgcaacaaacaactaccttgcaggtactcgaaaaattcgctcttgaccttgtcgtccagataatagccataagcatatgtccatttgagtacccgcctgcattcaataatctgaaatagacatagtggaatggtgcatgcatcagacgcaggtgaattgtatagtatggagtgtcatttgggtcatgacatatttatgatatcaaacctgtgaccaagcttcaattatgaacttcagttgggtctccggtattccaaaaacatctgttaattttgcaagctgtagcacatagagaagaaatagagttagcagctatcaaatataaaatacgaatgaatggcgaagataaacaattatgtcttgccctaaatgcaacgcccccaacctaacatgatgcgaatgcttacttgttccttttctgccttttgcagatctgcttgtgccttctgcctcgactggcaatataagtgaatatgtcagtacagaaacttgcatactacagcagaaaaaattccaagttcagaatagaacaatgcagaacattcatcccaagcatgtacagtagattagaaactatatacccatcaggtatagaaaaacatctggaactgtatttttttatatcatgaactgataaggtaatacaacataaaaattaaaaaagagcatttattagcacttactaccttcatcccataatgttgataggatgacccatcttagaacaacgaatctggacatgaggaatgtccaaattcgttgtcctaggatgggtctcatcctatcctaggttgctacattctaggacggagggagtaagagataaacttggcaagtaatcttcaaataaagctgcagctagttgggctacactcggtaggtaagaatttaagtcaaaattagtatctgcccaagcatatggccaacacaacacttgccaagtaaaccagaaggttcaaaaacacagagtaagttatgagcacaagaatgactaaagctgcacgtatagttgttgtagaaagaaaaaaaaactcaaagagacatcaaacttgagcatgttgaacataccgtctgattagatgcccagcgctcatagtaatgcatgtatctctcaagtgaatttttggctctttccctccttgcttcagtctcatcatactgcattagaggtaattaagttaggaaaaagtaacccttatgattctatgaatgaatgaactaattgaacaaactgtcaatttggactcgacattgacttgtgggattgaaacatttaattctacagaagcaataacaaaatacacaagacatctagaaactgattccttctactaaatgcaattggatagtctcaagataaaacatacaactccctccttctttgctgattcatagcgattacaagcgtaaaatccaccagttctctccccatgttcagcccatgaacccagacataacctgaaatgttcaaagaaaacaaatgagaggtacatacactagtaatatggacataaatatttcagcaagcatagacattggactataccagcagaactcaaatttgcaaggtggagtgcaagtcatatgcatgcatccctggtttttctctattggtcgtttgcattttgggcacggcttagaattagccagtatcctgaaaaggatcatcaacaacatgataaaccatctgacatgattagatgatttcaagcaacataaagaccttaaatacatttgagcattcatggactagccatgaactgaagattggtatacaattctaacagcattgtataataggcaaacattcctgtaatgtaaacatggcaaaaacgcttgagcagcataatgttctcactagagcctccacaagtttttccataaaaagaagtcatcaattgataaaaatggagtcaatgccaagtatttaacataaattaagaggtgtttattatgaggtttaagccacagtgccacatataatacatgttttccgtcataatatattgttaaaaaacaatgcatcagcccttgcagccctgactcagcaaagagttaatagtgttcacagttccttgcatcctcaaatcttctgcttccagaccaccagtcacacatgaggatgtccacaaagtttgatgtttctgaatacataacatctgaatatacgtacgtaaattaaatgcacaatttttttcaccacctcagtttttactcataaccatgaggaaagttagaagatagctgcaatattggcatcaaggataggttaaaaaaagaagtaaatatacaacacaaatgtttgaacatagatttatctccacaaaaattaatgaattccttatctatacactatccgtacactatggcttaataaagttttgagcctgaaccataccagttcatattttcagattctgcgctattctttaatatccacctagaaacagtctcacagttcactggtcgatgagcttcctccgtgcactgcaaacatcaccaaagcattgatgaagctccacacttttcatcactagcaataaaaaaaagtagaattaaatcgtcaggaaaatggagccagaaatactaacgttccaacaaaaactgaatttgcaattgcatgagacatcatagttcccatcgctgacaaattccactgcacatgtacagtcaggagctggacaccatttagtctgcaggaaatgccataggttatacaaaaggttaacagaaagagcacagctcatcatttcaaatcgttagaaaaataaacaataaaaaataggtactccacaaagaactatcaagtggagtaattagttagcttgttcaaacatattaccttcttgctatcttcaacatatgcacgtaagataaatcgtgcatatctcactttatcatcatctttagctaacttattaatcatgttctgaagaaccatagcaccacaagatggatcagggcatcgcaatgacaaacatcctggaccatcacttattgcagcactaatataacctgaaaggttgaatttatattatcataaattttcattattctgagggaaaaataaaataactgcaacacaggaacagatcttgatcatgtttaccaaaaacaacaactacaagtctacaagatagtctatacatgagcactgatggtgaaactatctaagctagtgttggaattgcaaaaaggaagttatgcacaaaagcatgcacagagagagagagagagagagagaccttcccagcattcatggcaataaaaatgatcacaatcagcagaactcatcacatcagaagaatacccttcaaaacatattccacaagttagctgcaaccaaaacagctgtcagatgtaagaaacagtgtatatgtagccacagccaaaggtttgatcagatatgacatgtggccagcacaacaaacaagtgataacaatatactggcatttgaataaataatacaaacctttctagagttaggaagatcaattccatttaaaagtaatccaacaatatcacgaactttttcttcatccgcaaaccattcatcgcttaacttgctgatgttcctgaacagagaactcataaagattaacaaagaacaaatacaaacctgtacccttatttctagattccaaaagtggaagatcagcttattccaatcgtcaagtagttagaaaatcccacatcataccacttgcataccagcaatgacacgtaaactaaattgccagcatatacaaaatctggaggtactacctaagacttcacagtgataattttcaagaaattatcaaagggaagcttgcagacagcaccttgaaaagtgtaacagagtaaaaacaaactgcatgtgcatcaagggcaacttggatagctcaggacaccatgtataacaaatgtcccctcacaccccagaatactctnactccctccgtcccaaaatctcttatattatgggacggagggagtataatgataaaagaatattcaatgaatgacggttaacaaacttaccatttgtagtgatgaagaagaacacacgcctcctcccttcgaatcgatagtacagcagataccttgcctatatcttcctcttgacgctcatttatatccttttcagttaatacaatgtatctctgtccatagttaccaaacatgggccagtttttagagacactcaaggatatccagtgaaacaagatgacatagaagtgccaatcaacatgaacgaaaacaaccaaacacagtaccagcttggaaattatggaaagaaagcacagaaagctctctagaaacatatggtatttcatcgtgatgcatgcgattaattatccgccttttaacctttgtatttaagctatcaaactagcaacacattatcaagcatataatggttaacatagatcatgatttggctacgtctgttgatgcccaggtgtgaaccttgcttggatcagcacaaacaaaacccaggaaagcagtacatcatcaccgatccatgagttccattacaaagactaaactctctaccatgttattccttaagcgtaaacctgtgctcactaatcaatattcaccatgtatagcatcaatattgattgagcagataacaatctaagcatcttagcactaatgtaatcatcaacttgtcggcttgcgcacaatgcgaacaggtataaaacacccaaggctgtcctaacagcggaagatagatcacatctaggtgcggaagcagaacattccttaatttcccaaagagcagatgtgaatcacaaacaactactacacatccgagtacatgacaagcaccctggaccatcaatcttatcaacatatttcagtcgcgttagctgactggtacatcaaaattaagaactgccgcaaaagctcatcccgatcctcatttcagaaaaaaagaaaaaaaaaagaaaaggacgccataagctcatcctaatccttatttcagcaaaacgacgccattctcgagaccgttcgacgctaccaatctagcacccctgatcttccaggtcctgatctacgttcagctcgccttgcctccccgctaagctacaccgaaggggggtgtaatctcgagttgtatgaaaacttttttttcccaaaatcttaatgaaatcgaccgtcgcgcttcctgctaaaaaaaagaaaaaagaaaaaaaaacaccaccaccagtccaccacctgatctgcttccgaccaaaaaaatcctcacctgctcgcggcgggacaccacctcgtcgctcccctccgcctcgcggccctcgtagtcgccgcccaccagctcctcatccccctcctcctcctcctccccatcgctatctcccccgcccccgccgccgctcccatcatcgtcctcacccatgtcatcactgtagtcgtaatagtcctcgtcatccaacatctcttcgtcgctggacatgggcatctcggcgtcggagtccatcaccccgaccaccgaatcgggcgatcggggaggggaggggggcggcggggctagggttccggcgaggtccgcggccggtggacggagaattggggaaggaaagagtcggagttgcgtgggcgagtcggcaggcacacaggatggggtgttttttatataccagtgtggtacacttttgggaactgtgaagcaataagaggaggggattcagtaattttgggatgtaataatcaagattaggaggttggaagatgcaatttgcacttctcagttctcactagtatcagcgccctgtgtggaagattagcccatagctaattttaagagctaatgtttagtcatgaattgatatgctaaacattagcctagggtggtatgtttggatccatagactaattcaaggctaaaaggtggagagagagtagaaagggaggagagagaaggagagagaaagctgctttttaatggtccccacacaaaattagccccattagcggctaatgttttgaggggggctaattcacattagctcaaaattagcccacctgtttggatccttgagggctaatttaaggctaaaaggtgagggctaaacattagcaaatggaaccaaatagggcccaggctagcaaagttgtgttctttcagttttggtgtgacttttggcatgcctttagggcccgtttagttccccaaaattttttcccaaaaacatcacatcgaatctttggacacatgcatgaagcattaaatatagataaatagaaaaactaattgcacagttatggaggaaatcacgagacgaatcttttaagcctaattagtccgtgattagccataagtgctacagtaacccacatgtgctaataacggcttaattagtctcaaaagattcgtctcgcggtttctagacgagttctgaaattagttttttcattcgtgtccgaaaaccccttccgacatccggtcaaacgttcgatgtgacacccaaaaattttcttttccccaactaaacacacccttagtctaagttatgaggttttgttcaacagaattgcttgagaacttccataagtttttatcctcaaatttgctgatttctagccatcggacttcctcaagatttttgcatgtttcaaatatgtcatgcgtaagatctcggttctaaccaaccaaaacatggttaaatccaagttttatataagttatatcatagttaaagtatagttacaatacagttacactttaattatactatagttacatttgaaagtttttcactcagaaaacttaaaaaaaaaacttatggtaattttttagataccccttattcgatatctaaaatttgtataccaaagacttttctattggtagtaaatctaaaactaaaatttgatgatagaacaaaacaatcacaagagtatgagagtaacaatcgagcaaatacaaacttttgtaatctaaaattgtacatagatagaattaagcaaaaccaaaattgagaaaattcgtcgaaagaaatacctcgatattttgtagtgcagacatgtagatctagttgttcgcaccatgtgccaaccatggcaagggatctgacgcctcggtcgacccatgttcccctccccctccatctccctcaccccatcttcggatatccaaattctcaccccctcatcttcgatgatttctaggaaactaggccgtggttacgtccatataaggtttcaagtttgcgacacgggtgtggacggggatcgagaggatgggctaggtgtcaaaggaggtaggggcgactatgaaagtagtgttatcgtagccataacatcaaaggatgacaatgggcgccatggatgggatgaaacgaaagtggtggtaaatggtggtcgctggagataggaaagaaaacatagcggggatattagctggttttggagaagtcggcgacgagggggttaacaaagtggaggattggatggggtggggtggtggggaagggagatggtggacagagaggaggggatgcgatggatgttagagataaggtttgtcctatgcacaagttttgactaattcaataataaaatgtgtcggcgtatatgtatgtaattccttttttatttctcttgaaatgattttattttgtttttcaagacccatctattgtgattactttaacacaattttataaacaatatattgattgaccactatttacaaatgaaaaaaatgcaacggaaccaaaactttggaacacataatttaattggctttatcatttatcatagtttggaatagtagcatttatggtaggttggagttaatagcatttattatggtagttgaaaaagtagcccttacatgaagaatgaggtcatcaaacttagaaacaactttcttgctacctaaacctgataactcaccttacatgttactcaatataagcagtttgtttgtaactgagtaatttaaagtgaccttttagaattgagaaatttatactagcagtatacttgtggattttctatgtagtatacaacaaagaggggtgatttgggatgttaataatcacaattaaaaggtttctcccttctaaaaagttgtatttattctattttggtattgatatacatatatatctataatatatagattttggcatgatttaaatctaagtcacgagcttttgttcaacatccaaagtcaccttctatttcagtgctgatatacatatatctatggctttttttttatcaatttagtctaagttatggcattctgatcgactccaaaaatcatatatcaagatgtcttattctctagcagtgaatctaaaactaaaattgaaaaggggttcttgtagaaaaaaaaaaagctgacgtgagagcatagactgacaatcgagccgacatgagctttgtaatctaaaattgtacatagatagaatgaaaagatagaaaatgagaaaacacatggaaagagtatgttgcaaatatgtagacccctagagtcaacctaggtaagggatccgatacctcgttgaccctatctcaaatcaccaaattcgccttcatatccgatgaaatcttggaacctaagtggcggcacatccagataaagttttgagtttgggagtgcgggtgtggaggggaattgggaggagggcccgggtatcaaaggtggtagggacaactatgtaagtagcctcagtgtagctgtaagataagggtggacagttgtaacacctgaaaattcgaccgataaaaaatctaaactctaaaaatatgggccttcaaaaactttttaaataaattgcatcatgccaattttattcgacgattttattggattttgatttcggaattcatcgatcacaaataggggaaaattaattaggaattaaccctgaaattagatttggttaaagaaataaataaattataatttaaaataaagattatgtaaggataggaataaataaaatatcatcacggccatatttgtattaattagatttaaatgcaatggaacaagaattaaccctaattaaaaattcaaataaattataccaataaaatatgagtaatattaatctagggtgaattcattagttgagataacacaaatattgagtaaacttcatttatgcaagatttagaaattatagaatcaaatttatatgggaaataaactaaaatgggataaataggaaaaagacactattcattgcactctaggtgttcgacgaggttccctagccccttcccctcccctgccatgcgcgcctcgcgccccgagccgtcgccatcgccgcctgccgccgtgccgctgtcacctgccacgccgcgcgccgctcggccgtcgccgtcgcgcctcgcgcctcgtaccgccgcgcgccgtcgccgtcgctgccgcgtcgccgtcgctgttgctatcgcgtcatcgcgccccgcgccgcgccgcccgctgtcgcgtcgccgctgccgcccgtcgcgtcgccttgcgccccgtgccgccgctgccgcgctgtcgccgtcgcgtcccacctcgcgccacgcgccaccgctgccgccccgtcaccgcccgtcccgtcgccgcgcgcgttccatcgccgcctcgagcccgcgccgctgtcgccgtcgccgtcccatcaccgcgcgccgagcctcgcgcgccgccccgagccccgcgccccgtcgcatcaggccgccgcccctcccctctccttccccccctcttccctataaatactcccccctccatttcccccactccattttcctcttcctcccctctctccctccaccgcgtcgccgtcctcgtgccgccgcgccgccgccctcggtgccgccgcgccgcaccgtgtgccgcgccgggtgtcgctgtcgccttgcgccgccgtcgtcgccaccgccgcgctgccgccgtcgtcgccgccgttgagccttcttccccccccctcgcgtccaccaccgccgtcgctcgggtggacaagagccgagagagagaggaaaggagaggccggtagggaggaagaagaaaagaggagagaggaagagaaggaaaagaaagaaaggagccgggaggagagaaaagagagaaaaagagagaaaaagaaaagaaaagagagaaaagaggagagaaaaagaaaagaaaaaaaaaatagaaattagaggaagattagggaagtttagaaaattgaaaataattagaatttaattatggattaattatagtcgtagaattgcaaaatttaatataaattatggattattcttggcaatttctataagaaatcaattcgcggtaataatttagatgtagttaattactaaacaaatagatgaattcttatagattattatagattatttttgggtaatcctttaagtaatcggttcacggtagaaattcggatttaattactagggattttacccgtgtattatatttaatcatttagtcatagactaaattaattcgtataatatttctaggatttcgtccgatatttagctcgcgatagaaatttctaacctattatatggatataatgctcgggtagattaaattaaaaacttatgacaacaaaatatttatacccgcaaaatagtttgaatcgaaattgggtttgccttagttcgcgaatagtaaagttaatataaagaaatcgactttcgcattcgactttcatttggatttatttggatttttatttgaattctaaccgaattcaaatcaattttcgcacgtaactatagaacccgagggagttgcggatccaagtgaaggctaagacctgcaagactttgagcaggcaagtcatcactattctttgaacatgttgatcccaattgcgaaattattttgtttacaaataaaatcgcatgcaatgatgaacatcctacttgtgagtatgccatgccttgattattgtttacccttaaatccttgtaactatgatttacgaataagtccctagtcaactatgacaaatgcttagaaatgctactctagatttatgcatactcatatttatcaaatgctatatgcttgggcaattacctttgggaaggtaattgagatgcggtatgtggagatatgagcgccacattgccataatgttgatgacatgatttgtgaaaggagaaataaaactaaacaactgttttcgactggggcggacggaggatttgggtggtatccggaaaatgctagtaccgtccccagtcaattaaggaccgagccatgaagttaagcatgaaacgacccccgtacaaccgcacttctcgtatgggtatagacctagcggagtagatagctgagcagaggcagtatccatgcgtagtggtcttcttttaggtgtgtgatgcggcaagcagtctgctggcggatgcccggttcggatggccaggtggatggcagatgcccattccggatggtcagaggttggcttggcaatactacgtgaggatacccataagagaacaatcatgatggactgggttcaacgacaagaaacaacgtaggaatgtgtgtgtttttcccttcccgggagcgccagaactcttctcactgctagaaacgtatgacgcctagagtgcatgagggctaaagttcatggagcgggtactgccaatgcgaggttatcgaaaagctttgccgtgacgcgtctcatgtgttgggacgaggctcatatgttgggcagtcgcggagtgcgggtaaagtgtacatccactgcagtgtgagtaaaccaaatctattcgaataaccgtgctcgcggttattgagcaccgggacatgtattacacttggctagactctaaattcttaacctgtgtgggatgggatattgcatgatgatttctacactgatggagccacttcctgagaggcgggaatgtgggcgtcctcagaaaaccatgacgactcaatggcgggaagctatccttgggatcacaatggatggtggatagaaccgtcattgtttaatatgaacactggtactaaaatttgatcagtctgtgctaggtcttaggcttgtgaaaagaattacaaaacttgctttgcgcaaaagaaccatagccatcctttgaatacccctgtcatatgcattgttgctgtggtggtttgctgagtacggttggtactcacccttgcaatatacaaacttaatcagaggtcggagatgaagcttcggaggatccctacgcttactatcaggagggtgatgaagacgatggcgctcagtaggtcttagttacggtcgttgcctgtggcaatggcgtgccgctgccttgactccgctgccttacctacttctgtttttggaatgtattccggaccgctcagttcgatgatttaagactatgcctgtgggcttatgatgtaataattcgtactagacactcgtgtatgtgcacttggtatttcagctatgaattcgtgtgtaccagactacttgatccagggaaatggtactgtttacacggttgattcctgttataaaaacgggggtccactacagtgggcagtggtaggtggggtgaaaaggaagtagcggctaggagcatcaggtggtgctggagtatgtatctgatggcgatcgttggacatgggaaggaaagcaccacatatgtgaagtcagtagaaaaggttagggaggccgtggattcaataggggcaaggtggaggtagggagattgcggcaaaaagaggggggaggggtgggatgaatggatgttagagaggaagggaggcttagggttcgttctatgcacaagtttcgactaatttggagaagaaaatgtgtcggcgtgtatatatatagtttctttcttttcttgaaatggttttattttgttgttctagacccctctattgtgattagtttagtgaagttttattaacaaatagtggcggatttaggccatttctgtggggtcggctgaccccacaactttttgaaaaacatcctataaaccttgattttcatgtataaatccaaaagaatttagagaaatgttcccacttaaatacaaaccactagtaattgaccccacagatttaaattcctctccgccactaataacaatgtattagttgaccgctattcagaaaagaaaatttatggtgaaaccaaaactttggaagatatgctttatttggttttagcatttatggtagtttggaatagtagcatttacatttagagtgaggtcatcaaactcggaaacaactttcttgggacctaaactcataacataccactgccctacgtgttactcgagataagcggcttgtttggtaagcagttggctgagacatgaaaatttaaattttgtacaatcatatggaacaatataattttgtgaaaaaggaaaggtgaaacaatgcagagtttagaacaaggccttagcataaatactgaagatttgtgctccatcgttatttctttttctatagtacggtcaagacatgcatgttctttttggaccaaagtattgattttatactgagataccatgttctatattcgttggatgttcttctcttttcttcgaaagcctgatgctgagttgcctccacgtgcaaagtgttcttccaagagaagttttaagtgctaatttcagccccaatttcactcatgacacacgtacgatggaatcatcatggaactggaattgttgcgtaggtcctcgcaatcctttgttgtaaatttatccgtcattgcaagtttgaacatactgcataacgacatgtggccaaactttttattaatcaacgtctacgttaaggttttccatgcaaaaacgatgcctttttattttcaaatcttttgagatggaaaaggaaaagttgatgccttcaccttttggtagaagcttgtactgatgatcatggcctcaagtacatgcaatggcaatctacaggtcccttgaaaaggcaacaatggtcggtgtttatttggaccaatcgtatgagattacatcatgccatgagtttcacgattcataagattgcaggatctgacaccaatttcagattgcctgtcactgtcatgcttatgcatgcaccaacatcaggtgtgaagcaagccatcagactatcaggctatcacaatcaggtcgggtaaactggttattatctagtgacaacatcagtggctacttgttcttcaaacaatggtcacagtttcacaatgtaggttcatttgataatgatcagtacttcagtgtagcatcaaagaggaaaaaggaaaactgagattgaagctgattgaaatgtcacaaaatggctcaacaagaacaatgatacagaaaattccctatttatttgggtcgatctttttctaacttactacaagatattgtaatctctacaatacaatgcgctaaccggaaataatggtgctacttttgcaccgaacgtgttctcaagagtttctattggtgttctacattgatgcagcttcctcacatctctcagtgtctgcagctggtgcttcatcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20864 - DNA, 697 bp, Oryza sativa
aaactcataacataccactgccttacgtgttactcgagataagcggcttgtttggtaagcagttggctgagacatgaaaatttaaattttgtacaatcatatggacaatataattttgtgaaaaaggaaaggtgaaacaatgcagagtttagaacaaggccttagcataaatactgaagatttgtgctccatcgttatttctttttctatagtacggtcaagacatgcatgttctttttggaccaaagtattgattttatactgagataccatgttctatattcgttggatgttcttctcttttcttcgaaagcctgatgctgagttgcctccacgtgcaaagtgttcttccaagagaagttttaagtgctaatttcagccccaatttcactcatgacacacgtacgatggaatcatcatggaactggaattgttgcgtcaagatcaaacgcagctctccttcacaccatcccggatcttgagaccgatctggcatgagtaacacctacccgcactttggcggtagaaaccggctacgctagggagaaggggaaggatcagaaggaatagttaccatcttccacgcgagtccctagagccaacggatgttcctctcgcgcggccgcggcggcggcggcagcggcgacgacgaggcggcggcggcggggagggaagacacactttgggctgcaggaat

SEQ ID NO: 20865 - DNA, 849 bp, Oryza sativa
tgttgggccttcgctgcccgtgtaataattatatttacgcttccgtttgttaaactctgaattgtatcaacttttggtgtaccttgcctcctgggacaaggaacaatacacgcacgtcaggaacgcctgttgggtgatttccggtcgtgacaagttggtatcagagcctcccttgaccctaggacgagccgtagatcccaagccttagcaatatttttgaaaattaaaaatcttttgttatttgtgaaaacccgctattctctctctgtcttgctgcttcatttatcgccaaaatctgatctctaaaatgctgtttttcttttgtttttgtttgtagatggccggcagcgtcacccgtcgtggtttggacatgactggcttcgtcctggagctgcggggcatgtgcgtggtcttggggtatccacatggagtggattaccaggccaggccgctcccggagcaggagggtgaggatgcagagcctcacgctgggtgggaggtcactgcagtgatcctctctggctctcccgagcggacttcgctggcagtcaccgcgggtggggattcttctcccgccgcttgccagaacgccgctctcctcgccatcggcaccctccaccagcgctacccggacgagttgcagcactcgccctatcgctaccaccctcgtcgcggaggagcccgcgacttcgccaccttccgagatgctagcttggaggatgacgctaccgtcgtgcatctggcacgcatggtggaggcatacgacgcggctcgtatcgacttccatcagatggtgcgtcgcgggatggttgagaacaacctgaagatcgtggagcggcgtcaggagaa

SEQ ID NO: 20866 - DNA, 4800 bp, Oryza sativa
ttagttttaatcgttagctctctctgtttgctggtgctgtgtggggttttcagatggtgacgaccaggagaaatgttagcaccggtgaaggcaaccaacccgaaggcagcaaccccaacccccaaggcaatccacctccaccaccaccaccagacaccaacgccattctcacccaaatcctcgcccagcaagccaacatgatgaccgctttcctccaccacctccaaaatccgccacaacagaatgctccaccaccacctccacaacactctaagctcgccgagttcctccgcatccgcccacccaccttctctagctccaacaatcccgtggatgcgttggattggttgcatgccgtggggaagaagctggacactgtgcagtgcagtgatgaagagaaagtcatcttcgccgcccatcagctgcaggggcccgcatctctatggtgggaccatttccaggctacgcagccagaggggcaaccgattacttgggcccgcttcaccgccgctttccggagaacccatgtgcccgccggagtcgtggctcttaagaagagggagttccgggagttgaagcaaggcaaccgctccgtgatggagtatttgcacgagttcaacagtctggcccggtacgctccggaggatgtgcgggaagatgaggagaagcaagagaagttcttggcgggaatggaccctgagctgtccgttcgcctagtctctggggactatccggacttccaacgtctggtggacaagagcatccgcttggaggccaagcacaaggagctggagacgcacaagcgccgcttggcgaacttccgcaatcagcagggcgctaaccagagggtccgctacaccaatccctatccagggggatcctcctcgcagcagcaacaacagcagcagcaacctcgctccgcgcctcgacctcaattcgtggtgcgcgtcccacagccgcagcagcagcagagtcagcaagggactcgtgtagcccgtcctcctacgccagttgtgcagcccgttcaaggccgcagggacgctcaaggtcagcagcgtttgtgcttcaactgcttcgagcccgggcactttgcggataaatgcccaaagccaaggcgtcagcaaggccaagcgcctccccgctccaacaacggtggcaaggacgtcattcggggtcgtgtgaaccacgtgacggccgaggacgtgctgacaactccagacgtcatcgttggtacgttcctcgttcattccatcccagctactattttgttcgactctggagcttcccactcgtttatatctgtgccattcgtggggaaaaatcagttgggggtagaaaggcttaggaaccctctactcatcaccacccctggaggggttatgacagcaaagtactatagccctgccgttcctatagaaattcaagggattccttttccctcggatctgattctgctagacaccaagaatttggatgtgattcttgggatgaattggttggctcaattccagggagtagtggattgcgcgagacgcactgtcactctgtaccgaggaccggaacaaccggttgttttctttgcacccccaacctctgtcagaagttcaaaactgcatcaaatagaactatcagaaatccccattgtcagagagttcggagatgtgtttccggaagaactacctggtatgccgcctaagcgagagattgagttccggatagatcttgctcctggaaccactcctctgcacaagcgaccctaccgtatggcagcaaatgaactggccgaagttaagaaacagttggaagagttgaaagaaaaggggtacatacgtccgagtacttccccttggggtgctcctgtgatctttgtggagaagaaagacaagacgaagaggatgtgcgttgactaccgagctctcaatgaggtcaccatcaaaaacaagtaccctcttccccggatcgatgatctgttcgaccagcttaaaggtgccactgtattctccaagattgaccttcgttccggatatcaccaattacgtattcgtgaagaagatattccgaagaccgcattcaccacgcgatatgggctgtatgaattcacggtgatgtcgttcggtctaaccaatgcacctgcattcttcatgaacttgatgaacaaagtgttcatggaatacttggacaagtttgttgtggttttcattgatgacatcctgatatactcacagtcagaagaagaccatcagcaccatctccgtctggtgttgggaaagctgcgggaacatcaattatatgccaagcttagcaagtgtgagttctggttgtccgaagtaaaattcttggggcacgtgatatctgctaaaggagttgccgtggaccccgaaacagtgaccgccgtcactgaatggaagcaacccaagacagtcactcaaattcgcagtttcctgggtttggcaggatattaccggagattcatcgagaacttctccaaaatcgctcgacccatgacacagttgttgaagaaagaagagaaatttgtgtggagcccgcaatgcgagaaggcattccaaactctcaaagaaaagctggtctcctcgccagtgttaatcctgccagatactcgcaaggatttcatggtgtactgtgatgcttcgcgccaaggattggggtgcgtactcatgcaggacggtcatgtggtagcctatgcctcacgccagctacgacctcatgaaggcaactaccctacacatgacttggaattagcagcggtggttcatgctctaaaaatctggcggcactatctcattgggaatcgctgtgaaatatatacagatcataagagtctgaaatacatcttcacccagtcggatctgaaccttcggcaaaggagatggttagaactcatcaaggattacgatgtgggaattcactatcatcctggtaaggccaacgtggtcgccgacgctctaagtcgaaaaagccattgcaacactctcaacgtccgtggcattccacccgagcttaaccaacagatggaagccctgaacctaagcatagttggtcgtgggttcttggccgcgttggaagccaagcctaccttgctcgaccaaatccgcgaggctcagaagaatgatccggacatgcatggactcctcaagaatatgagacagggtaaagccgctggtttcacggaggatgaacacggaaccctatggaacggaaagcgggtatgcgttccagatagcagagaacttaaacagttgatacttcaggaagctcacgaaagtccttattccattcacccgggcagtacgaagatgtacctagacttgaaggagaaatactggtgggttagcatgaagcgggaaattgcagagttcgtggctctatgtgatgtgtgccagcgtgtcaaggcagaacaccaacgaccggccggacttctccaacctctccaagtaccagaatggaaatgggatgaaattgggatggatttcatcaccggacttccaaaaacccaaggtggatatgattctatatgggtaattgtggatcgactaacaaaggtagctcgatttattcctgtgaagaccacctatggagggaacaaactagcggaactctacttcgctaggatcgtgagtctccatggtatccccaagaaaatcgtatctgataggggaagccaattcacctctcacttttggaagaagctccaagaagagctgggtacccgtttaaatttcagcaccgcctatcacccgcagacagatggacagaccgagcgtctaaatcagatcctagaagatatgcttcgcgcgtgtgtcctagattttgggaagacttgggataagagtctcccctatgccgagttctcctacaacaacagctatcaagccagcatacaaatggcaccttatgaagcgttgtacgggcgcaaatgccggacaccgctattgtgggaccaagtcggagaaagccaagtgttcggaactgatatcctgagggaagctgaagctaaagtcagaatcattcgggataatctaaaggtggcacagtcccggcagaaaagttatgcagataaccgacgccgtgacctggaattcgcagtggacgattttgtgtaccttcgggtcacgccattgcgaggggtacacaggtttcagacaaaagggaagctcgcacctcggtatgtgggtcccttccgtatcatcgctcgacgcggagaagtcgcttatcagctagagttgcccgcctccttgggtaacgtgcacgatgtgttccatgtgtcgcaactcaagagatgtcttcgagtgccatccgagcaggccgactcagagcaaattgaagttcgcgaagatttgacctacgtggagaggccagtgaaaatcctggacaccagggagcgcaggaccaggaaccgggtaatccgtttttgcaaggtccagtggagcaaccatgccgaagaagaagctacttgggagcgtgaagacgagctgaaggcagcccatcccgacctcttcgccagttcttccgaatctcggggtcgagattccgtttaaggggggtaggtttgtcgcgtcccaaaacgaccctaaaattcatcctcaaaattgtgctgagaataattaaaatcaatgtgaaagccttcaacaattaaaatgtgcacagataaaagtcaatgaggcttggaggatttttgtatatttcctaaaagcctaaaacgtgtaaataaattttagtggaattttcagagcacaaataataattgaaaagaaataaacatagttaaaaaggtttataaaa

SEQ ID NO: 20867 - DNA, 1810 bp, Oryza sativa
cggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttgtatgaggggtattgtcataactcctttccgaggtaccgtggtggtattgaggcacatggtgacatgatgtggggttgtgtcttgtgggtacagtggtacagctctgatcagagtaaaactattcgaatagccgtgcccgcggttatgggcgggtcgaacaatgtctttcgtgattagtttcacacttctcaccttagtaagagatgcttaaattggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttattaaattctcaaatgtttgctaaatgctgcctttgcaaatgaaaccctattatgccctcctttgttatcctgtgcacttgcatatttgctgcgtggcttgctgagtatgtcatatactctccttgcaatcattcatcagaagaagagttcttcattgaggctgatggagtggaggattaggtgtagccttggtcaagctgcctgtggagtggagccgtctgcgccgtttattttattttctgctgcttagatctttattgattgagaggaactatctacctccgtaatgacattttatacgcttaataattagagtaataactgtactctattatcaatttgttattgtgtgcctcggctgattcctggacgagggttcacacacatgtaagcgtttggaattttggatagaaattccaggcgtgacaagttggtatcagagcccctttgaccctaggttatgccaaatggttacccatagaagccttctaaaaatattggaaaagtagaactgttctcctctctttctcttttaattaaaccaaactaatggcacatgcacttcataatctcttttaatggttctcattcaaaatttattccagtgttattagtactgtacatctattactgtactaatggctcattttccagcaaaagttttacaatgatgtttcatttaatcttactgcaataaaataaatttagcaagttgattttataactttcttttatttcttttgaaacttgttattcaaaagtacaaaacttgtgacctcattttcaactatttcaactcatcttgcaagtttggtttactttatttacttaccttttgctttgattttcaaactttattcaaaattaatccaaaaacttgtgctattaattggataaatgttttaactccctcctttcacttgtctttagatgccgcgctacaagcctgagtacttgtttggtgttgagggttttgtccaggagttgcgtactatgtcctttgtcattggatttgggactgcccctttttatgcctagattcgtcatgatcgtcatgaagagaagtgccgagtcaaagttaccttgaacagtaacagtgaagatatcccatcagtgatgttcgaagctggaggaaggaactacatccatgcatgtcaggaagtggcaaggatcgccataggagagctccgtgatcgctacagtgatcagttggccgacactgagtatcgttaccatcctcgtcaaccgcagggaagtgaccgtggcagttaccttgagactgaaggaatt

SEQ ID NO: 20868 - DNA, 1311 bp, Oryza sativa
tttaggaccccagtccatgccacaaggaggttcttcgtctgttgttcgtccgcagcgttagttcttcaacaacaatgctggcaataacatccgcaatcaagctccacgtcctgttgcagcttcgacacagcaacaacctgccaagagggagcaaggcagcaagcctatggtatgcttcaactgtggagacccaggacattatgctgacaagtgtccgaagccccgacgcgtgaaggttgtccctgcccagagcaactctgctgtaccagcatcaaaggcccgtgtcaatcatgttgcagctgcagaagctcaagatgctccagatgtgattttgggtacgttccttgttaactcagttcctgcaacagtacttttcgattctggtgctacacattcatttctatctatgagttttgcgggaaatcatgggatggaagtagaagatcttagacgtcctttgatggttagtaccccaagcaatcaagcactctctttgcaacgtagcccctatgtcagaatagaaattcaaggggtaccatttctggccaatcttatattgttagaatccaaagaccttgatgtcattctagggatggactggttagctagacataaaggtgtgatagactgtgctaacagaaaagtaactctcaccagcaatgatggtcgagttgtaactgttcatgcattgtcttctgagtttttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatagaatggtagccaatgagttggcagaagtcaagaggcaagtagatgatttgcttcagaaaggatacatcagaccgagttcatctccatggggagctccggttattttttgtggaaaagaaagatcatacccagaggatgtgtgtggactatcgtgcattaaatgatgtgactattaagaataagtacccgctacccagaattgatgatttgtttgatcagcttaaaggtgccaccgttttctccaagatagatcttcgatcagggtatcatcagttgagaatcaaagaggaagatatacctaagacagcttttaccactaggtatgggttgttcgaatgtactgttatgtcttttggacttaccaatgctcctgctttcttcatgaacttgatgaatatggtgtttatggaatatctagacaagttcgtggtggtctttattgatg

SEQ ID NO: 20869 - DNA, 1282 bp, Oryza sativa
  unsure (1)..(1282): unsure at all n locations
gccccagcagatcctccgatcatcatcataagtagtgatgaagaagaagaatccaagcgcaaccattccaagattgagtgggtagcaactcaagatgatgaagacgagccgaacgagccttcaatcgaccttcgatgctcggaagaacaagagtagcttgttaagtcgttgtcttagatcgttgtgttagtttgcttcttttaagcttgcttgtgtgtgtgtgggtcttgcatgtgatttacatcagtggtgggatataagtacatgcgtttgtttgctttttgagtgttaggaagttggtgagtttagtggtgtgagagtcttcagtttgtaataatgaaactcagttaagatcaataaaagttaaagtaattctctgtcctaagtagttttcccccggtttctcttcttgtgccctatccatgccagatggtgaacactcgcagcaacaggaatggtcccaatctcaacaaccccaataacaataacaatggagagaatccaacccttgctcaagttcttgctcaacagactcagcttatgaacatgatgatgcagcaacttcagaaccagcagaaccaaggaaataaccatgcaccccctcagaataagttagcagaatttcttcgtgtaaggccgcctgttttctctagtaccactaatcctgttgaagctggcgattggttgcatgccatagagaagaagttggatttgcttcagtgcactgatcaggagaaggtctcatttgcatcacatcagttgcatggccctgcctctgaatggtgggatcacttccgcctgaataggactactgctgaacctatcacttggcttgaattcaccgctgctttccggaagacacatataccatcgggagtggtgtctctcaagaagaaggagttcaggtcgctcactcaaggatctcgctctgttacggagtatttgcacgagttcaatcgtctagctcgttatgctccggaagatgtacgcaatgatgaagagcgtcaagagaagttcttggaaggacttaatgatgagctttcttacccactcatgactggagattatcatgatttccagaagttagtggataaggctattcgtcaggaggacaagtataaccgcatggagcagaagaaacgccggattgctcacttcaaggcacaacaggggagtnnnnnnnnnnnnnnnnnnnntttaggaccccagtccatgccacaaggaggttcttcgtctgttgttcgtccgcagcgttagttcttcaacaacaatgctggcaata

SEQ ID NO: 20870 - DNA, 7862 bp, Oryza sativa
ctagacaagtttgtggtggtctttattgatgacattcttatctactctaagaccaaagaagagcatgaagaacatcttcgccttgcattggaaaagttatgagaacatcaactgtatgctaagtttagcaagtgtgaattttggttgtctgaagtgaagttccttggtcacgtcatctcagcaggaggagttgccgttgatcctagtaatgtggaatccgtaaccaactggaaacaaccaaagacagtttcagagatccgcagtttcctaggcctcgcaggatattatcggaggtttatagagaatttttccaagattgctaagcccatgacacgactgcttcagaaagatgtgaagtacaagtggtcagaagaatgtgagcagagttttcaagagttgaaaagtcgcttgatatcagctcctattttgattttgcctgatccaaagaagggtttccaagtgtattgcgatgcatccaaacttgggttaggttgtgttctgatgcaagatgggaaggtggttgcctatgcatctcgtcagttacgtccgcatgagaaaaactaccctactcatgatcttgaattggctgcagtagttcatgcgttgaagatttggcgtcattatcttttcggtactcgtacagaggtatatatcgatcacaagagcttaaagtatatctttactcagtcggatctgaacatgagacaaaggagatggttggaattaattaaggattatgacatgggaattcattatcacccgggaaaggctaatgtagtagcagacgctcttagcaggaaaggctattgcaatgctacggaaggacgacagttgccattggaattatgcaaggaatttgaaagattgaatttgggaattgtcagtataggtttcgttgcagccttagaagcgaagcccactctaattgatcaagttagagaagctcaaactaatgatcctgatatccaagaaattaagaagaatatgagaagaggaaaagctattggtttcttggaggatgagcacggaactgtatggttgggtgaaagaatctgtgtccccgacaacaaagatttaaaagatgcaattctgaaagaagctcatgatactttatactccatacaccctggtagtactaagatgtactaggatctcaaggaaaggttttggtgggcaagtatgaagcgtgaaatcgcagaatacgtagcagtatgtgatgtttgtcagcgagtcaaggcagaacatcagaaacccgccggtttgttgcagccttcaaagattcctgaatggaaatgggaagaaatcggtatggattttatcactggtttgcccagaacgtcattaggccaggactctatttgggtgatagtcgatagacttactaaagtggcacacttcattccggtaaagacaacttattccggaagtcgcttagcggaattgtatatggcaaggattgtgtgtttgcatggcgttcctaagaaaatagtgtccgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcagaattttcgtacaacaacagttatcaagctagtcttcagatggctccgtacgaagcactgtatggtcggaagtgccgcactccgcttttgtgggatcaagcgggagaacgtcaggttttcgggacggatatcctaagggaagcagaagaaaaggtgaaaatcattcaagaaagattgcgagtggcccagtctcgtcataagagttatgccgataatcgccgcagagatttgagttttgaagaaggagattatgtgtatcttcgtgtcacgcctcttcgaggagttcatcattttcacaccaacggaaaattggcaccgcgttttgtaggaccttataagattgtcagtcgaagaggagaggttgcttatcagttggagttacctcaatctttggcaggagtccataatgtgttccatgtgtcgcaactgaaaaagtgtttaagggtacctaccgaagaagctaatcatgaacagatagaagttcaagaggatctgacctatgttgagaaaccaatccgtattttggaaatagatgagagaagaaccagaaatcgagttatctgcttttgcaaagtccaatggagtaatcactcggaagaagaatcaacttgggaacgagaagatgaattgaagtcagctcatccgcatttgttcgccagttcttccgaatctcgaggacgagattctgtttaaggggggtaggtttgtcacaccctgaaaattcaaaatatataaattgttgtttaaatggaatttttagaatttattttaaaagcctagaagagaagatttaattttaattaataaattccaatataaaatggggccaaataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaagtcctttctctctctcctcggcccagtccggcccagtccgccgccgcgcgcgcgcgtccgcccgctgacaggtggggcccacctatcagggtcgtcgtcaacctccggccgccgccgcccgaaaccctagtttcgcgccgccgctgttcccttccaaatccggccgttcctttccttcttcggccgaatcaaaagaggggaaatgatcctcgagatctcctctaccttttctcctttggaaacatcggctaattcgttttggaagttcgtggaatcgagttcgattcggatcggcctctttccttcgaaccctaaaccttccttctcgtcgccagctgccgtgggccttcgccgtcgcctccgagcccctttaaaaggttccccggtgtctcctctacccgtcgccgccttcgccttcgcctctcgtcgtcggaaacgccctagcgccgtgtgccctagcgtcgccgtcgccgccgtcgctccagccgtgcgcccccgccgttccagtcattgtcgtcgctcgggaagaccgccgtcggggtcgccaagtcgtcgccgtcctcgtccgccgcttcgccaccgccaaagaccaccagagcaccgtcgccgtcgtcaagccgaagagcgccgccgtttcaacctcgtcgccgtcgccgtccgttggtcttccgccgtcgctttggtcgccggtgagatcgccgtgctgtccgctacccgttggtgccctccgttcgtgctgaagcaccgccgttcgccggcgagcgtgcgccgtccgagccgtccgagccgccgccgccggtggtgacgtcatcgccgaggtcatcggggccgttcgctgtgagccggtcgtggaccgttcgatctcggccgtccgttttagatcaagtcgatctcggccgtccgttcgcgtgaaccgccgccgtgcgcccggtccaccgaaaccctagcccgctgacgcaataatccttcttttccttttcaaaaataattcattattgcgtcataattcaattaaaatcttcaaaaattcataagtaattcatcttagctccgatttagttggttcaagtctctaaatttttctaaaattgagatctacatgctaaaaatatccacatgtactgttcatgtttgtttatgtgctgttttggtgattttgcttctttctgtttagattccgtcgtttacggagagtccgtttttgcagaagaagaatttgaagagttccaaggccagcaaggcaagccaaacagatcccaaacaaccctttgagcatgttgatcccgtttaaagctactgtttcttttcaactattgcatttatttttgaatgtcattgggtggaattaacctattgtttgttatagcccttttgttcttgattactttattccttgataccttgggttattataatttgactagttgagctttatttatattggttcaactagatattagatataattgcttagccctgcttagaaacattagctcacttttgggataacttatgaatcactattacttaatgatggcttaataatagttcacgatggtcaatcgtgattggttaattaattaatgtgccaactaaaacctgataatggtgggttgtgagcacatggttttgatggtcgtgctcatgacaattaaggaccggttcatgagtttcggttgtgaaacattaaccatgccagccacaagccagcatgggcaacggctttaccttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtccttcgtgattagtctcacacttctcaccatagtaaatgatgctataattggtaataatctgattagctcctggtttggaatggtatattcctggtttggagatagaactgtgcagccgggatggttgttcagaatggttgggcctatgcaaccgggtatgttgtatagcgttggattaacattgtctaatacttaactgttttattaaattctgaaatgtttgctaaatgctgcttctgcaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagccgtctgcgccgtttattttattttccgctgcttagatctttattgattgagaggaactatctacctctgtaatgacattttattcgcttattaattagagtaataattgtactctattatcaatttgttattgtgtgcctcggctgattcctggatgagggttcacacacatgtaagcgtttggaattttggatagaaattccgggcgtgacagcacgcctcctctcgaagccgcagctcctccgcgcgacgagccaccaaagcctctgcggctattgacagaaaacacgaggcctgggagatctgcttaactccagtgcaggtccaaaactcgccttcggatgtgtgagcgtgccagttgatttgatcctgcaatcaacaagaaacaaagacaaagaaaccgaaattaaatccataaatgatagccgatcggctaaatgccgatgacgtatcatttatctttgagccgatgtcatatgtaaatcgatcggcaagtgttaagtaaacaaatcagaactaaatctactcgatcggctgtagacatcaataatatataatccttatatcgatatatacttgaatcaagtgattgggatagatcggtcaccttgccgagacagtataaatcacttaaatcgaaatatatattattaatgagattatatatatatatatatattcatagcatagccgatgaaatagatctagcatgtatcggctaataccccgataccacttcgtattaagatattaaagcaagtagaatataccaaacagaagcctaatatacttaaatgcaacaagatcttaacataaagggcagatctaacatgtcaaacgatcatataggataaaagcagttagatcaggtaagatcggctgaaactccgatactaccctaatcggcaaccagtaggcaggctagatattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcaagaacacaaaccgccataacaagttttacctcttgttgaagatcgaaaccgatgcagctcaacccgaaagcaagaactcgttgaaataaaactaaagcaaaaagggtggcgatgcgccgaaattgtattgaacgtgtgtgttatccattacatagggctcggggcctatttatacccgagaattataagatatgtccatattggacacgactcttatccctaacaaactctaagataccataagtttttgcggcagacttttgcccacatttatctctaaggaatttacataaaatatcctaattaatagatacaattgccttcccaggactctatccatgcgtggcaatcatcttgaagcacatcaattcgaacccgatgtcgtacacaagtcatattatcggaatcggctgtatcacttaacacagtctgactcagacttagccgatctcaatcgtagccgatccggactccagctgattcttactctgtttccgcaacaacccttatcttcgattccgcttcgatccattttcatctcccatgctgatattaccaaatttggtcgttaacacatgccccccaagtccgggatatttgataatgttccggatttgccgtgtatcgactccaagcaagtttcgcactctaccgttttcccaaccgttactctagtgctttaaatactaaccgttatccccgagaaatctcacaccgtgacttccgttttcaccgcttaagcgaaactttaccctctctctctccggcgattcctccaatgcgcaaggcaattcccaggcgactccatccccagccagatctccgcctgcgacgatgtcaacctccgcgagcccatctgccgcaccatcggccaaatacgctgaggtaagtccccatcggctagatcccccttttcatcattagatcggttttctctcgcctcatactgctttctttttctcggttactttgaacttgtagcatctctccaatttagtcgcagttccaagcttgtcacatgaaaaccactactttctcggcccagtcggcaaccctgaccccactgagttcatcatcggtgaaaccaataggattcctttcagactatccaatccagatctaggtcattggaagaacacctttaaatcttggccgtctctagaaaaaacttcacccgagaaaagttggattacatggttcaagcgtatgtcagctagcaaacgagttcactggaacgaaatcggaatcggccaagcacttgacctaaccatagcaaactcagccaaagaagaacctctaatggcagctgcttcttacttttggtccaacactatcaatgccttcttattcaaccaagggccgatgaccctaactctcatagtcatcattatgatcacgggtctagatgtcacttcatcggctaaccccatgagtctgaacacaaaaaaccaatatgacttcaagaccaagagtataggaggttggtcaggttatgtgcaggg

SEQ ID NO: 20871 - DNA, 1776 bp, Oryza sativa
cctgtcatcggctatgatgcccccaagacttcagctcttcttcaagggcttatcagagaaccagccgatgccggtaagaaaaggaaaaccagatcatcggctgtagatactttagccccagctccaaagaagaagatcaaaaagaaagctaaaccagctgatgatctgcctgccctagatccatctattaaacaagctctggatgaagaagaaatcggagaggatgttgatcaagctgtagccgaaataagcgatactgaaagaacaccatcggcttcacctaagcaggtccctcaaactccttctgctccaactcattttacaagagtaagaaaccttctataaccacttttgtaatcatctcactttatggccgattgctcacatacttggtaactgcagaaaaggaaggctgctgtgaagaagaaatcggctccaatgacatctaaaccagctccactggtacaataaccttaattctttcattagttaatctcagccgattttatataacacttgtctattttcaacctccttcccctcctattcaacaagcatcaagcgatcggaccccatcagctgtagggagtcatcacatagaagaagaagttcaaccaactgctccagctatcccagtaaatttcttataaccaacatatgcagatcggctatgcctatttgatctctaactctctttaaatcatcactgcaggtcttagccgatcttttcttttttgatatcagagattatcttgatgaagagacagaggttgacaacactagcaaggctctagctcctttgtctgatgatgtgaagaaaactcttgaagatatctctcatcggctagagacatcatcactagatagcctagtagtcgactgtggatcaattaggactcggcttcacgaagtttacgctcaaatcctcgatgagttagccgatatccttactacagctgtttatcttgagcaacatcaatttaagctggaaaaggccaagctgagattagccgagcatcaagagcgcaaagacattgaagcaacaatccaggccaatcggcaatttgttcatgaagaaaaagccaagctcgatcaattatctaaaggcccgatcaaatccaatattgaccggcttgaagctcgcaagatggaactcttagcacaacttcaagaatgcaatgctgaactggatctagagcacaagaggttagccgatctcccacagtctatcgaagaacaaaaagcaaggttaaaatcagctatcaagaatgttgctaatatgaccaaatctttgaaggtcattcctggaaccgacgctcaagatgcccaagccatagaagaagtagaacagattaggcaaagagctatatcggctatccagcgatacttatctgaataatctttgtgtaatatgacttggaattttgtaatcggctaagacattcggattaatatgatgtgtaagctttgctcaaaaatctcaaaaattttgcactgtattgtgatatatatatatgcccccctagttttacaatgtcaagagcattgataaaaatacgaaacaactaagggcgatataacaatatcggccattgtatatcagcaaaccacgactgattacaatagaaccactaagggcgatataacaatatcggccattgtacatcggcaaaccacaaccgattacaataaaacaactaagggcgatattacaatatcggccatctcaaggcgatgcaaatacatcggctatcatgtatcggcaatactagccga

SEQ ID NO: 20872 - DNA, 12945 bp, Oryza sativa
  unsure (1)..(12945): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctagaccgctggctcatggatttattttcgtgtttcaccatgttcataacccgcgataatgaatatgttgattagtcatgcatttacttttgataatcatatatctttcggttttaaattgacagattattttattattataacttaccaattgaaagcaacatataatacttgtagatccttttcgagatggtttgagtggcggctttttttatatggcgtaaaaagtatggtgtagaatatagaccttttaaccaaaagtccaaaatgcacgcactagccaagttattgcacttatatgctcatttctcaagtttttgcgctagatcgcacccacctacctttatgtaccgtagacgtaatttactcgaaaggaaaaaataaaatggtggcactatttagcagaactgttaactaggagtaataaaataaaacattaatcttacccttgcaaccttggtccttgtcgtaggggttaccctcgtaaccttgcttgcacttgcagtagtatccgggaccgttggtggagttgacgcactcgctgctgtcgctcacacatgcgtacccagccggtttcttctcctgcacatccagtggagggcaggtaatggagtcgcggatggccctctttcggagaccaaaaatcccagcaacttacccgcacgaacgccaaaaacacacttatctggattcgtcttcatgcctaccgagcacaggttgtcgaatgtatcttgaaggccagacgcatggtcgaatgccttgcggctttttacgatgatgtcgtcgacatatgcttcaacattccgccccaactgtgaacaaaggactttgcagatgagcctagagaaagtagccccagcatttctcagtccaaaaggcatcctaatgtggcagaaggtgctgaatagtgtgatgaaagttgtcttcagtatgtctctgggttcgtaaagatttgatgatacccggagtaggcatccaaaaaactcataagtacacagcccacggtcgaatcaaccaattgatcaatccttgggagtgggaagtcatctttcgaacaagccttgttcagatccgtgaaatcaacacacatccgccacttgccattggacttcttgactaacactgggttcgccaaccactccgggtggttgatctcccgaatcacaccagccttgagcagcttttagacttctgtcttcactgcctgttggcggtctatcgacattttgcgtagcttctacttctttggcttgcatatagctttactactagatggtgtatgatgaggtcgggccaaacgcccacaacctcgtttgatccccagacgaagatgttgatgtttttcttgagcacggccaagatgttattcgtttcttcttcacttatatcgccgcctagggaaaccacctttgttggttcagcctcgtcaacttggaccttgatcaccttgccatgtggggacggcttcggcacgattcttgctcgctcaccatcttcagcttgtacattgtctacttctctacttatcactgttgtttcgctccctagcacggccaaagactgcagccccttgactacgattaccccggccggaccaggcatcttcagcttgaggtagttgtggtgcgcgatagcttcaaacttgttcaacgtggcggtgccgaagatggcgttgtagttgtacgaaatatcaatgacaccgaagagaatcatctgctcgtgtctgttgggacccgcgccgaacgccggagctaagtgaacttggcctaggacttgcaccgcttcgcccccaaagccgtgaagcaaagtgagcgcctgagagagagccaaggtcaggaaccccatcctagtgtatgcttcggcgaagatgacatatgccgaactgccgccatccacaaggattcgacgtactttaaatctagctatctctgccgaaatgatcagcgggtcttggtgtaggaacaagaccccctcggcgtttctctgttgtgcaccgcccgaagctgcgtttttctttgcagcttcacagctgtgagggtggatctgctcttgttatcacttggataacactttgcgggatgtcttgctgttgttcggcctgagggattatgtcctgaacaggttcacagggcacctcttcggccttcacttgctgtggtcttggctcctgttggttgccttgctgccgaatgtttcggcattgctcggtggagtgcaaagagcgcccgtggaacatgcagtagagatccttcttggccttcttgcgaaagggttgctggtgattggtgtcctggtgtgtgtcaagcaccttgtggagggtctacacctcttcgactgccactcacaacctttccacgttcggctctggtctttttacacgtcatgggagcttggctgggtcttgggggcagcaccttcttcgtcggctgcacttggcgattcgccagcggcatggcttcagctgcttgcatcaccgcttgcgcagctgcagcggaagcggcggccttgtcatagtcggcttgtatctccagccttcgctttgtgtcctcttcgccacgtgcatggccgtcgatgatgcgaaacaagcgctcgatggtctggggctctttccttgctattcttcttgtgaggtcgcttggaaggagccctgccgaagcagcattgatgacggacgcctctgtgatgtcttgcacttggcagcgtgcttgcgagaagtgtcgaatgtactccttgttgtttctccgtcttctagcaaatgccgaagaggtcttgctgcgttttcggctcctcataggtgcctcagaagttaagaacaaagacttcacagagttgctcccatgagtatataatattagatagcaaattgaaataccaagagcgggcgatcccgtcaagcgcaacatgtattaccttcgccttggtattgtcattgccgtgagccacttcgattgccgactcgtagattgacaagaactcacttgggtctgattcacgcgagtatattgcaacgggtgggtacttgaattggggtgggatgggatgattcttgagcacccaacttaacggtggcctcttttcgcccccgcctctcatcgttgcaccttggaaagatgagttcaagctcggttatgggatggcgaatggcgaagtcatcgcctgcacccgtggttgggccatcgctttcggctagggtccggttctgaacagtgctccttgcatgttggctgaaactacctgtgtcaccatgcctaggtcgaactgtggtgcttggatccaggccacgccctgattcgactggttcgcttgctgtgtggagccgaaaccggtgattatcccataaacatcagttgttgatgcttgggtcatggtgttctgttcgaagctcagtgcttgctaccaggctattgtcccttgacttggttgattgattgccgcgccgaattgacttatcggttgccaggtcggagccccctggcttgactgattcgcttggtgcattgcaccgaattgacggctgccagaccggggcaccttgacttgcttccaacggcattcgccgatggggttggtttcgaaattgtgtggggttgattgagctgttgaaggaaagcttggaactgagcttgtaaggtcaaagatgcttctatggcggcgtgctgtgcttcgacatgcttcgccggttgtacttgtgtcactgccggctgaacgggcatcgtgaaggtgtaaggggccggttgcactgtaacggtcggagcggctttggcaacgtacagcggagcttgatagacttgtccgtacatggccgaagccggcggagcatggggttgtgcagcatggccgaaaccttgggtggtgaccatcgctgtcgaagtcgggtggggggccgatggggctggcttgacttgttttgccgcttcataggcttgatgctgcagttgcatttggcgaagcatgtcttgtaacttgttcatgttctgacgcatcgtccccatctcggcttcggcttgcacttcaaggtcgatgccttctagggtcatggtcgccgcttgttgagtcgaagctgttgcttgctttttgatgggtctgttcgtgctgggccagcacaagtatggcccagaagggtgggagcgggagcagacctatccacctaccttgccatggctcatggaggttccgctgtctttgccatggatgccagccccagccagctgccaccaccaccatggatacctgtcgacgccacgagtttagtctactccatgacgtgctcgttgctttgctcctggactcttggtcatggagtccttgccagctggctagagaaccgttccacggtgaaagaactagggcctggcccggcctcggccccggcccactgccaattattttggtgtggcattaattgatcattgccaaacaaaaaatttaagagtcggctgggattttcggccccatcattttatgcttattatccgtaccacatattattaactaaaaaattaatttgtaggtgaaatttttatgtacatgttattagcaatttaaaaataaatatataaactatgatgaaaagggcacaaaatcaactctaaaattaagctttaaaatttagaatttggcttataagcataagcctgagcaaaacgatgggttgcttgtttggtttgttctacttaaagttatatattttgacatacaccaaagccaaataacttggaatgcttttttgggttaattcgatccatgccattgcaaatatgtcatttatgataaatgtgttggagtttaaaacacttaattggttaaatcttagcctagacatgatcaccttctacttatgcggaaattaattgatttactgacctaaaaatgaagccattgttcttctgctttcttcttcttctagagatgcctcacgaaccccttccagtgcctaatcgatcggacgattgacttagggtttagggttagatagagttaggttgttaatttgcctccctccttctctttctttatatagcgacatcggtggggctcagggttttttctcaagctaaattcgaatctattttgtaccgatcacacaaaacagatttctcttctttggtttcttgttaggataggaaaaccagtgggattttattcttcctagctaaccggcattagccaagaaaatcatccaacattctccccttgattttgagactaactgacgagtttactaaataaaatacctccccaagacaatgtgtcacaagcgtcactgagacaacactatggtacgcaaataaactcaagcttaacttagtgggtattgattgaaaattaagttcccctcatccaggatcttaataaggctctaatttacacatgtgctagctagaacatatcttagttaaacttaattttactagcctttagagtatggagccatgagcaaatgctcagcttaataattagaccctgggacatatctttcacaaccatatgtgaaaacacatgttgttactagaatagaaaactgtgtttaattagtgcacaacttatagcatagtataattttgagtggtttatgagcgctatttaccactcttagttcagggaaattttcttaaacatatgactgaatcataacatgctacaaaatccaactgcatcgtcgactatgcaataagagattattttggaccttttccatggttattgctcccctatgtgtggacatagcttaatctaaattagcttaataatctttataaatatccacacatctcacaaaataagtgtgtccaaatatctctaaactttagagaccaaatagacttttagaaatataagcatgttacttaaagttgccttgtaaataatacaaagcattcttaataccagtggtctagtctagatttaattaaatactgtcaagattcccagtattatgccaaatctgtatgcatctagatttgagctaatatcaagcttctgtcagctgaatcataaatgattatctttataatttaatttcaaatgactgaattaactaatccaatgaggagacacccttcttcctcgtgtacggctcagaggctatgctccccacggagctacgacatcagagcacacgagtgcagaagtactccgacgaggagcaggaggagcagcgaagtgacgatgtgaatctactcgaggaacatcgagaaagagttgccgtcagagcaggcagctactagtaggcccttctccaatatcacgagaagcgcatcagagcacgtacactttcgatcggagattatgtcctccgacgggttcaaagccaagcagggcacaacaagctctcacccaagtgggaagaactatacacgatcacttaaagtcttgcggctgggcgcattcaagattgcagacggcgatggtcgcgagttaacaaactcctggaacattgatcaattacgtaaattttatgtataaatcaatagtatacatatttgtaagatatcttacgacttcaataaagttgatttcaggtaaagaacatcgtcaaagtgttccttcccaacgatcccttaccacgacaacacctagagttgaaacctatcctcatgtccctttacgccgccctggcaaggcctctgaggaacctaagtgaacttcggctggggacgcccagagcggagaaggccttgtcagattatgcagggacaaacgaccatgtaagatctggtcatgtaagagttctcaccgggcgtattaaccaagccgtgtgatcagaaattgagttttccaacttcacggctgagggctagggtcagtgctttttcaaccaaggcaggtcaagggtcgaagagccttatcccccgagaacaattctccgacgacaaggctgggggatagggagagtgtatggctcaaatgactaatcaaagtcgcagaacgagaaaacactcatacacaacatacccaaaataagaaaacttagtatattacatgcttccttgagatgtttttctacaggatacaaaagctactaggacggccaacgccaatacatggagcagaaaaccttctcggcaagcgacgccatcaactgcgcaagaccgtcaatctccacggatgtcctccgagaacgagagaacccttcacgaaggaactcgaggtgcaactgcgagcggttatcttggatgcaagccagcacatgtcccccggcgtagcggctcgctcgacgacactcctgcttcagggcctcgtcgatgcgcttgccaatcccttagagctgtgcgtaggcccccttcatccacgagatataaccagcagcggactccatgggatctccgcggggaactcggagctccctgcaaacttccgccatggccgtgcagcaacccttgaggtacgagttgaaccacacctcgcgacctcggagagtttccatggcctggtccttcttcgcctccacgatggtcctttcgagttcggccacctcgagtttggtcttccaatactggattcgacgatctcggtctgccaacacgttcttgaaatttgcccaacacagaaaagattaagtcaagctactcttctctttcgagaacacagctaattaagtcaatccgaacacgaggagcgaaggaaatcaagacacaaacctaaggacgtcatcaccatgttcgtctccacggacgggctttgatcgatttccacctccggcacgtgaggctcaagcgtgagcgccggaatgactactgacgtatcgggctgcccgcactgctggacatcctcgacttcaacatatctacaatgacaaaggtactcgggatcacatgctaaggaaacaagggaaacaactgtttaaataaaagcagttcgaacccacagaaagttttacaacatgtagataaaggagtacagaggaaaataaaaatcctactcttgaaaaagggggaggacgaactcccccaagtcactgacttcctccatcgtgtccttacgcgcgtcatcggcggccccccgatccaaagcctctttaaggtctaagtcgcgatgcgctagcctcataaacgcaaggacatggcacgccccagtgtaaataccgttagacgtctcctcaccaagcctagccgtgtggctggaggggatctcctccatcgccttagccagttccgtgagcgacgatgtcagcaaccactcgtcgggatgcgctgggatcgaagttgtgacaccgaactccccggcgagttggtgcacgccggtgaacgatgtccgcagcgaacctcggatggctgtcagatggccctcgagctccgacatacggtgctcgagtccacgccgctacgtctcgttgccagctaccagctccttcatcttttggaggtcctcgcgggactccgccagatcacatgccagctgatcggcacaatgatttgccgacgacgccgctgcactggcctcctcgatctcgcggcccacgccgcgggcgcccgcttgaaggatgcactccatcttagcctggagctgcccccaggtgagggtgtcggcggacagaggccggacgggcacgaggcgagcgataggactacatggcgccgcctcctggtccttagtactggccatgacttccgtcgaggtcgccacagggggcgcactagaagcagcatcagccccactgtgcgccgctttcaccagtgccatcctgcgaagattttttctccatgaggctaggtgatcaaaactttgagaataaaaaaacctcaaaaacatttacttacttctcgccgaccgtcaccaacctctgctttcgctgaggcggtggagacgcacccaagtcctgagtaagataatatgatgtgaggttaagtcgttctgactacgtactcaaggacgaaagagaagcttaccgctgggctcatcgccttccggcgggtcccgggtacagaggagaacttcctccccctcttcggaacattgctgccacttgtggtgtgtcacgcccaaaacgaccctaaaatatatcctttaaattacgcctagaataattaaaatccgtgtgaaagcctccaaaaaataaaatgtgcaaagtaaaagtcaaacaaggcttagaggatttttgtatatttcctaaaagcctaaaatgcgtaaataaattttagtggaattttcagagcacaaataataattattaagaaataaacaaagttgaaaaagttttataaaaagaaaaaccctaaaagtcccccttcccttccttgggccggcccggcccatctctctcccccctctctctctcctctcccccgcggcccattcggcctccctccccgcgcgcgcgccgctgacgggcgggcccacccgccaccctcgctgacgggtggggcccacccatcatccccgtcctcccgccactcccgccgctccgcccgcgccaagcgacgccgccgccgccaaatccgccgcatcccgccgtccccgcgtgcaataaagtggggggaaatactccccgtgatcccctctccctttccccccatttttccctctctctcttgcgttcaaacgggtggatttgcccccgcaaatctcgccggctgctctctcccccttccaaccctatttaaaccctccccgcacctcctccgtccggttccgcctctcgccgcccttcctcctcgccggattcaagctcgcgacgtcgctctctctctccgccgtcgccgccgagctccggtctgccaccgtcgtcgccccgaaccgcctcccacctcggcgccgcctccttcggcttcgccacatcctcgccgacctcgtccacctctccgtttcggtcgccgaccgccggagcgccgccgtccgcgtcgacccgagccgcgccaccgcctccctccgctccgggcgcctcctccgtcgccctggggtgagccgtggaccatcgcctcctttcccccttccctcccctctctcggccgccgctccgcagcatctatggccgcgccggcgaccatcggggcgcgggcgcgccgcctcccgccgaccgcgccggcgtggccgttctcgggcgcgccgagtggctgccgcgtggggcccggccatcagccgcccgcgccctcgggtgtggctgacgtgtggggcccacggcgccggccggtgcaagcccgggtgcgcccggtccaccgtggaccgtgaggctgccgcgtgggccccactcccgtggacccggtccgcgcgcccctccccctcggctaacgcaataaaccctttttaaattaaattttaaatgaagaaaatcgcaaatatttatttaaagagcatataaacttcaaatgcccataacttggccatttgaactcggaattggaccattcaagtctctaatttttccttaagaagtcaagaacccattttagtgctttgttactgcttgttatatggagtttattagagtaaaagcccttttattttccgttggttgtgtagacgctgcagctttggaagatccgctcttcgtgtaggttgaagccgacgtttgggaaagcgagcaaggcaagtcacatcatccttgaacatattgaatcctagtttataaaattattttgatttaaattattgtattatcgctttatttaaattcccgcgttatcactgttttatctagccatgcctatttacctttgttatgaccttattattgttattgttattattaccttgttcaccctagaataaacaaaacctcaactagtggacactttactcatggtaccactagtatgaatttaggtagatgcttcgctggttagttaggcaacattaggtggttttacaactctagactttgggaatattctcatcacctggacactacggaatggttggattattgtggaattggattcatacccccccctctattcaatatccataaaatggttttaggctgggcttggggtgcctggttttgatagtagcacctcggccatataaggaccggtcttcgggcctctgttgcaaagcactaccgtacttccaaatgtctagtgggtaaggcttagtttgtggctcaatctggttataaacaaaagtacacggatggagatggacgaagtcaggggtcgatggacatttctagggcaaatgaaggctacacgagctgcggcccggtagtcgagatgtcgtggcacagggccggtgtcctgctgctaggggctcagtcctgcctacctgtcccgggtgttccggccgtaggtggggttgggtcggtactcttgtctatggctaggatgggttggaaactatgtcatgtcttccgtccgtataccatggtggtatgtggcacgtgattacatgtgaggaagatgtgtcttgtgggtaaagatatacacctcttatcagagtataatctattcgaatagccgcgccctcggttatgggcaagccgagcaatgtacacatgttagtgttttaattcttaaaacctgcttaacaactaaaacgtggaatggttggcctgggttggcttgggacgagctgggacccagggtcgggttgccacttcggtctgaatcatcgtaggccttgggttaaggcagattcgtgtgggttgacggcccttattaataatctggtatagctctaggatcgtatttataaaatagctttgagcaactaagtgtcttttaatgctgtttactgcaaatcctaacccttatattataacccccttgtactcccttgcatttattctgcacttatgggtgtgtcttgttgagtacggtggttgtactcagtcttgctcaatttttcccaaacccagaagaggagcccctggatgatgaaggctttggtgtttagctcgtgcctgccgtcaagcgcctgtggtcatcgccctagtcttccgctgtttcccgtttgtctttgtgtgtgttgggctttcgccgcccatgtaataaattaattatttacgcttccgcttattaaactctgaattgtatcaacttttggtgtaccttgcctcctgggacaaggaataatgcacgcacgtaaggaacgcccgttgggttatttctggtcgtgacaagttggtatcagagcccccttgaccctaggacgagctttagatcccaagccttagcaatattttcgaaataaaattcctttcttatttgtgaaaatcctctagtctctctctgtcccgctgcttcatttatcgtcaaaatctgatctttaaaatgttgctattctcttttgtttttgtttgtagatggccggcagcatcaaccatcgtggcttggacctgactggcttcgttttggagctgcggggcatgtgcgttgtcctggggtatccgcatggagtggactaccagggcaagcagctctcgaagcaggagggtgacgatgcagagccccacgctgcttgggaggtcactgcagtgatcctcactggctcacccgagaggacttcgttggcagtcaccgcgggtggagattccttctccgccgcttgccagaacgccgcactcctcaccatcggcactcttcaccagcgctacccggatgagttgcagcactcgccctaccgctaccaccctcgtcgcggaggagcccgcgactacgccaccttcagggatgctagctcggaggatgacgctaccatcatgcacctagcgcgcatcgtggaggcgtacgatgtggctcgtatcgacttccatcagatggtgcgccgtgggttggtcgagaacaacatgaagatcctgga

SEQ ID NO: 20873 - DNA, 2398 bp, Oryza sativa
gtgctgctaccggtgaaggcagtcacccgaaaggcagcaactacaacaaccatggcagcccacctccacctcctcacccgcctccaccaccaccaccagacaccaactctatcctcacccaaatcctcgcccagcaggccaacatgatggctgctttcctccatcacatccaaaatccgccacagcataatgctccacctccaccaccacccccgcaacattctaaacttgccgagttcctccgcatccgtccgcctaccttctctagctccaataaccccgtggatgctttggattggttgcatgccgtggggaaaaagttagacaccgtgcagtgcaacgatgaggagaaagtcatctttgccgctcaccaactgcaggggcccgcatctctatggtgggaccacttctaggctacgcagccagaaggacagcctattacttgggcccgcttcaccgccgctttccggaggacccatgtgcccgccggagtcatgacccttaagaaaagggaattccgagagttgaagcaaggcaactgctctgtgatggagtatttgcatgagtttaacaacctggcccggtacgccccggaggatgttcgtgaagatgaggagaagcaggagaagttcttggcaggaatggaccctgagctgtccgtgcatatggtctccggggattatccggatttccagcgtttggcggacaagagcatccgcttggaagccaagcacaaggaactggagtcacacaagcgtcgcttggcaaatttccgcaatcaacagggggctaaccaaaggatccgctacaccaatccctatccagggggatcctcctcgtagcagcagcagcagcaaccacgctccgcgctccgacctcaattcgtggtgcgcgtcccacagccgcagcaacagcagagccagcaagggacccgtgcgccccgtcctcctacgccagccgtgcagcctggacaaggccgcagagacgttcatggtcagcagcgtctgtgcttcaactacttcgagcccgggcactttgcggataaatgcccaaagccgaggcgccagcaaggccaagcgcctccccgccccaacaacggtggtaaggatgtcattcggggtcgtgtgaaccacgtgactgccgaggatatgctgacaactccaggcgttatcgtgggtacgttcctcattcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgttcctatagaaatccagggaatcctttttccctcagatttgattcttctggacaccaagaacttggatgtgatccttgggatgaaatggttggctcaattccaaggagtagtggattgcgcaagacgcactgtcactctgtaccgagggccggaacaaccggttgttttctttgcgcccccaacctctgccagtagttcagaacttcatcagataggactgtcagaaatccccatcgtcagagagttcggagacgtgtttccggaagaactactcggtatgccgcccaagcgagagattgagttccggatagatcttgctccaggaaccactcctctgtacaagcgaccctaccgtatggcagcaaatgaactggccgaagtcaagaaatagttggaagagttaaaagaaaaggggtatatacggccgagcacttccccctagagtgctcccgtgatttttgtggagaagaaagacaagacaaagcggatgtgcgttgactacagagctctcaatgaagttactatcaaaaacaagtaccctcttccccggatcgatgatctcttcgatcagcttaaaggtgccactgtcttttctaaaattgatcttcgttccggatatcaccaattgcgtatccgtgaagaagatattccgaagaccgcattcacctcgcgttatggactgtatgaattcacggtgatgtcgttcggtctgaccaatgctcctgccttcttcatgaacttaatggacaaagtgttcatggaaaacttggataagtttgtggtggtctttattgacgacatcctgatgtactcacaatcagaggaagaccatcagcagcatctccgtctggtgttgggaaagttgcgggaacatcaattgtatgccaagcttagcaagtgtgagttctggttgtccgaagtcaaattcttagggcacgtgatatccgctaaaggagtgctgtggaccccgaaacggtgaccgccgtcactaattggaagcaacccaagacagttactcaggttcgcagctttttgagtatggca

SEQ ID NO: 20874 - DNA, 708 bp, Oryza sativa
ccatgatttggagttatccgctgtggttcatgctctaaagatctggcggcactatctcattgtgaatcgctgtgaaatatatattgatcataagagtttgaaatacatcctcactcagtcggatctgaatcttcggtagagaagatggttagaactcatcaaggattatgatgtgggaatccactatcatcctagtaaggccaacgtggtcgccgacgctctaagtcgaaaaagccattgcaacactcttggcgtccgtggcattccaccgaaacttaatcaacagatggaagccctgaacctaagcatagttggtcgtggattcttggctacactggaagccaagcctaccttgctcgatcaaatccacgaggctcagaagaatgatccggatatgcgtggactcctcaagaatatgaaacaaggtaaagccactggtttcacagaggatgaacatggaacccaatggaacggaaatcgggtatgcgttccagacgacagggaacttaaaacagttgatacttcaggaagctcacgaaagtccttattccatccatcctggcagtacgaagatgtacttagacttgaaagaaaaatactggtgggttagtatgaagcgggaaattgcagagttcgtggccctttgtgatgtgtgctagcatgtcaaggcagagcaccaacgaccggccggacttgggctgcaggaat

SEQ ID NO: 20875 - DNA, 2181 bp, Oryza sativa
aaggaaaaaggattttccctggaattaaaaattgcactttggtgatttttaatgggttacaattgtttctagagctctgaaaattccattaaaaatcctgttaatgaatttcgacatgtagaactcaagaaaaattccacatgtcaaatccgattattatttgcattattttcttagggttttctcctgatttcacctgcattttcttagggtcttttataaattacaatttggcttgggaggaaaacttggggtgtgacatcagcgcaccttcagaggcggacgacattcctgtcccactctgagagaaggactcgaccgaacgcgccgccgcgattaaagtgagtgtactcgatgattcctttacatctttcttctcgagatcgcgttgtgacttcatattgtgcaggctctccctctgacggacgccatcggaccactcgtggatcactaggtggtgacgtcgttgaaggagggggtcaccaaggaggcatcagacgctgttgctgccaccatgtcacgactggaaataacccaacaggcattccttatgtgcgtgcattattccttgtcccaggaggcaaggtacaccaaaagttgatacaattcagagtttaataagcggaagcgtaaataattaatttattacatgggcggcgaaagcccagcatacacaaagacaaacgggaaacagcggaagactagggcgatgaccacaggcgcttgacggcaggcacgagctaaacaccaaagccttcatcatccaggggctcctcttctgggtttgggaaaaattgagcaagactgagtacaaccaccgtactcaacaagacacacccataagtgcagaataaatgcaagggagtacaagggggttataatataagggttaggatttgcagtaaacagcattaaaagacacttagttgctcaaagctattttataaatacgatcctagagctataccagattattaataagggccgtgaacccacacgaacctgccttaacccaaggcctacgatgattcagaccgaagtggcaacccgaccctgggtcccagctcgtcccaagccaacccaggccaaccattccacgttttagttgttaagcaggttttaagaattaaaacactaacttgggtacattgctcggcttgcccataaccgagggcgcggctattcgaacagattatactctgatcagaggtgtacatcacgtgtaaccatgtgccacataccaccacggtatacggacggaagacgtgacatagtttccaacccatcctagccatagacaagagtaccgacccaaccccacctacggccggaaccccccggacaggtaggcaggactgagcccctagcagcaggacaccagccctgtgccatgacatctcgactaccgggccgcagctcgtgtagccgtcatttgtcctagagatgtccatcgacccccgacttcgtccatctccatccatgtacttttgtttgtaaccagactgagccacaaactaagcattacccactagacatgtggaagtacggtagtgctttgcaacagaggcccgaagaccgatccttatatggccgaggtgctactatcaaaaccatgcaccccgagcccagcctaaaaccatcttggggattttgaatagaaggagcggtgtgaatccaattccacaataatccaacaattccaaagtgtccagatgatatgaagattcccaaagtctagagttggaaaaccacctaatgttacctaattaaatagcgaagcatctacctaaaatcatactagtgataccatgagtagggtgtccactagttggggttttgtttattctagggtgaacaaggaaataataacaataacaatattaaggtcataacaaaggtaaataggcatggctaaataaagcagtgataacgcgggaatttaaataaagtgataatgcaataatttaaatcaacataattttacaaaataggattcaatatgttcaaagatgatgtgacttgccttgctcgctttcccaaacgccggcttcaacttccacgaagagcggatcttccgaagctgcgcgtctacacgaccaacagaaaagaaaaggcttttactctaataaactccaaatgacaagcaggaacaaagcacaaaaatgggttcttgacttctta

SEQ ID NO: 20876 - DNA, 900 bp, Oryza sativa
aatcaaggtcgtgaacccacatgaacctgccttaacccaaggcctatgatgattcagaccgaactggcaacccgaccctgggtcccagctcgtcccaagccaacccaggccaaccattccacattttagttgttaagaaggttttaagaattaaaacactaacttgggtacattgctcggctagcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccacctatggccggaacctccgggacaggtaggcaggattgagcccctagcagcaggacaccagccctgtgccgtgacatctcgactaccgggccgcagctcgtgtagccttcatttatccttgagatgtccatcgacccccgacttcgtccatctccatccgtgtacttttgtttattaccaggctgagccacaaactaagccttacccactagacatgtggaagtacggtagtgctttgcaacagaggcccgaagaccggtccttatatggccgaggtgctactatcaaaaccatgcaccccgagcccagcctaaaaccatcttggggattttgaatagaaggagcggtgtgaatccaattccacaataatccaacaattccaaagtgtccagatgatatgaagattcccaaagtctagagttggaaaaccacctaatgttacctaattaaatagcgaagcatctacctaaaatcatactagtgataccatgagtagggtgtccactagttggggttttgtttattctaggg

SEQ ID NO: 20877 - DNA, 3244 bp, Oryza sativa
ttttttcaatttttagggtgtgacacgcgggcggctgacggccgggccccacatggcagccgcggggcgcgcccgaaagcggcctcgccggcacagtcgacgggaggtggcgcgcccgcgcccctatggtcgctggcggcggccataggcacggcggagcggcggccgagagaggggagggaagggggaaacgaaatgggcggtccacggctcaccccgggtcgacggcgacgacgggaacggcgaccggaacggaggaaggcagcggcgcggcacgggttgacggggacggcggcgttccgacggtcggcgggcgaaacggaggggtggacgaggtcggcgaggttgcggcgaacccgaagaaggcaacgtcgaagcgggagaaggtcccggggcgacgacagcggtggaccggagctcggcggcgatggcggagagagagaatgacggtgcgaactcgattccgacggggagagagagcggcgagtggtggaaacggcagagggaggcacggggagtgtttatatagggttgggagggggagagagcggccggatgtgggggaatcggccgcggaagatccggccgccattgatgcgccggcgaggtttagggggaaacgttttcgaacgaatccgagggagagagagagggaaaagtggggggaaagagggagggaatcacggggaatatttcccccctcttgattgcacacggggcggacgggagcggcgggattcgcagcggcggcggcgctagggcacaggcgaggcggcgggagcggcgggaggaaggggatgacgggtgggccccacccgtcagcgagggtggcgggcgggcccgtccgtcagcggcacgcgcgcgcggggaggaggccggatgggccgcgggggagaggagagagagggagggaggtgggccgagccagcccaagaggggaaagactttttagggtttttctttttataaaatcattttaactttttttatttcttcttaattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaaccaccactgtcaccgtcgtcggccagcctgagtaatgttaaggaaaagatccagaagctcggtttgactgacgtccatgaaggaaacgttgtgcccattgatccagagaagttcactcccgaacagaaggaagacttcaatgcaatgatgcaacaagcacaagatcaatttttaagttcattcatgcagactcgcaagggcacatttgttcagaagtacaaggtgaaggtggttcttgaggatcctgggatcggttcttctaaagagggagaaaagaaacaagttccagacggatcagcccagccgagtgacaaaggcgttacagatgggtcgacccaggagaaccagggtgactacttccatggagtacatggagttcaaggtgacggcactcagggaccacaagggggaaatcttaatcagaatgacaatgcattccaagattttttcaataactttcaagatcgagttgactatgttgtgtatagtgctttgattaatcaatctggagtgttgactaataccttgtcaaatataatgaaatcggtagccgatggttcaatagctgaacatcaggctgcaggcccagtttatttgcaagggggtacttttccaaattattgaactttgatcaccgatgttcatccacttactcagggaattcctcctgttgcatcatcagctcagccgatggcaccagcatcagctccagcacctgcagcgccgtcgtcggctccaggccaattaatcaatcgtcaattattggtaagagagcaatctcagcatcctagaccgaatgtgactcagctaacacaagaccagattgcatctaggtgtttctacctcctcagaatgctgttaattcagctcagcagcagccgattcagcaaacaccgcccaggcaacaggttgtgcagcctattcaacaaacatctccaatccagcaggtcgtgcaaccagttcagcagacgccagcaaggcgactggctttacagccgattcagcagacgccgttgagacagtaggtcgttcagccgattcagcagcaaggctcaatgaatgtgttgcctggatttgcaacacctggtggtcagcctgtgcagtacactacaaatcaggttgtcccggaacacctggttcatcatgtgcaaccagatggttcagtggtacctcaagttattcctgagcatttggcgcgtggtactcagccaaaccttcacaattaccaggggggcaatttgagttatgaatatcagcctccatcacctcaagttcagtaccaacaggcaggatcggttcaacctcaatttgttcatcaatacaatcagtttgagctgtcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaagtaaatattagtggaattttcagagcacaaataataattaagaagaaataaacaaagttaaaatggttttataaaaagaaaaaccctaaaaagtcctttttccccctccccctcttgggccggctcggcccacctccctccctctctctcctctcccccgcggcccaatcggcctcctcccctcgcgcgtgccgctgacgggcgggcccgcccgccaccatcgctgacgggtggggcccacccgtcatcccctaccttctgccgcccccgccgcctcgcccgtgcgctagcgccgccgccgccgcgaatcccgccgctcccgtccgtcccgcgcgcaatcaagaggggggaaatattccccgtgattccctccctctttcccccccgtttttccctctctctctccctcggattcgttcgaaatctttcccctaaacctcgccggcgcatcaatggcggccggatcttccgcggccgattcccccacatccggccgctctctccccctcccaaccctatataaacaatgtcgcgacccaaaacg

SEQ ID NO: 20878 - DNA, 35400 bp, Oryza sativa
atatcgtaagggaagcagaagaaaaggtaaagatcattcaagaaagattgcgtgtggctcagtcgcgtcataagagttatgccgacaatcgccgcagagatttgagttttgaagaaggagattatgtgtatcttcgtgtcacgcctctacggggagttcatcgttttcataccaaaggaaaattggcactgcgttttgtgggaccttataagattgtcagtagaagaggagaggttgcttatcagttagagttacctcaatctttggcaggagtccataatgtgttccatgtgtcgcaattgaaaaagtgtttaagggtacctaccgaagaagctaatcttgaacagatagaagtccaagaggatctgacctatgtggagaaaccaatccgtatcttggaaacaaatgagagaaaaaccaggaatcgagttatccgtttttgcaaagtccagtggagtaatcactcggaagaagagtcaacttgggaacgagaagatgaattgaagtcagctcatccgtatctgttcgccagttcttccgaatctcgaggacgagattctgtttaaggggggtaggtttgtcacaccctaaaaattcaaaaaaatataaattgttgtttaaatggaatttctagaatttattttaaaagtcttgaaaagaaaatataattttaattaataaattccaatataaaatggggccagataaaatttcattaaatactttgcttaattttataattcctagatttttccggggtttaattgagctaagaaagtatttttaataaatggaattgcatttaagaaataatttaaattgaaaaagtttttaaaaagtcttcttttggctttgggctgaaagtcggcccaaaaccttctctctctctccccggcccaagtcggcccagtccgcagccgcccgcgcgcgcgcgcgtttggacgctgacaggtgggtcccacctgtcaggcccatcgtcttcctcgggccgaaaccctagcgcgccgccaccgagccgccgccgctgtttccttccaatccggccgcccctttccgtttccggccaaatcaatagaggggaaacactctccgggatctcctctaccttttctcctttggaatcatcagctaattcgttttggaagttcgtggaatcgagttcaattcggatcggcctctttccttcaagcccgagctttccttcctcgtcgccggcagccatgggccttcgccttcgcctccgagcccctttaaaagcctccccagtgtctcctccacccgccgccaccctcgccttcgcctctcgtcgtcagagtcgctctagcgccgtgcaaccttgcgccgctgccgccgccgccgctccagccgtgtgccgccgtcgattcagccgtcgccgtcgctcgggaaggacgtcatcgtggtcgccaagtcgtcgccgtcctcgtccgccgcttcgccatcgtcggagaccgccggagcatcgtcgccgtcgtcaagccgaagaactccgccgtttcctcttcgtcgccggcgccgtccgttgcttctccgccgtcgttttggtcgtcggtgagttcgccgtgctgtccgctacccgttggtgcccttcgtttgtgtcctagcgccgccgttcgccggcgagcgtgcgccgcccgagccgtccgctccgccgagccgccgccgccgtcggtgacgtcattgctgacgtcatcaaggtcgtccgccgtgaaccgccgtggacccgatcgatctcggccgtccgtttggattggatcgaatctcggccgtccgttcgcgtgaaccgccgcccgtgcgcccggtccaccgaaaccctagcccgctgacgcaataaatcccctttttcttttcaaaaataattcattattgcgtcataattcaatttaaaccgatttaagtgttttaatctgatttaatctttaaaaattcataactaattcatcttagctccaatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgccggagaagagtttgaagagttccaaggccagcaaggcaagtcacacagatcccaaacaaccctttgagcatattgatcctatttaaagctattgtttctattcaaatattgcatttattttcgaatgtcattgggtggatttaacctattgtttgttatagcccttttgttcttgattactttattccttgataccttgggttattataacttgactagttgagctttatttattggttcaactagatattagatataattgcttagccctgcttagaaacattagctcactattgggataacttatgattcactattatttcatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacatttatcgtgccaaccacaagctagcatgggcaacggctttatcttttgtatagcatggttcattgcggggcactagactgagaagtggcggagataagcccacgggggtcgctggggagtccatgccttgtttataagggggtgattatgatccaggaaggtgcgctgcagtggattgtgttgtatgaggtgtattgtcataactcctttccgaggtaccgtggtggtattgaggccttgggttaaggcaggttcgtgtgggttcacggccttgataaataatatggtatagttctagaatcgtgtttacaaaatagctttgagcaactaagtacctttaaatgctgtttactgcaaaccctaaccctttatagtataactcctttgtactcccttgcatttattctacacttgtgggtgtgtcttgttgagtacggtggttgtactcagtcttgctcaatttttcccaaccccagaagaggagcccctagaagatgaaggctttggtgtctagctcgtgcctgccgtcaagcgcctgtggtagtcgccctagtcttccgctgtttctcgtttgtctctgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaagttggtatcagagccacccttgaccctaggacgagccgtagatcccaagccttagcaatatcttcaataataaaaatcctttgtatttgtgaaaatcctctagtctctctctgtcttgctgcttcatttatcgccaaaatctgacctttaaaatgttgttttcctttttgtttttgtttgtagatggccggcagcgtcagccgtcgtggtttggacatgactggcttcgtcttggagctacggggcatgtgcgttgtcctggggtatccgcctggagtggactaccaggccaggccgcttccggagcaggagggtgacgatgcagagccccacgctgcgtgggaggttactgcagtgatcctcactggctctcccgagcggacttcgctggcagtcaccgcgggtggagattccttccccgccgcttgccagaacgccgctctcctcgccatcggcactcttcaccagcgctacccggacgagttgcagcactcgccctaccgctaccaccctcgctgcggaggagcccgcgacttcgccaccttccgggatgctagctcggaggatgacgctaccatcgtgcacctggcgcgcatggtggaggcgtacgacgcggctcgtatcgacttccaacagatggtgcgccgtgggatggtcgagaacaacatgaagatcctggagctgcgtcaggagaatctgcagctgaagaaggacctacacgcgttggaggcgcagctgtgtcagcttaaggtcgcccagggtgaggtctgtcgtcccaagcgccgccgcgtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgtcctggcccgtcgcagcgatagacgagcagttagtaggcttgcgcgtgtgttctttctcgtttgtcttcttgttggagttgtgtggggcatggttatgccggtgtatggcataactgtgtcggagcctgtctttattttatttgtctaagcaatttgaactttaatgaaccaatttaatagcagtaataaatttaagaattaaggtagtcgtgggtggttagctttaattgtcagctctctctctgtttgctggttctgtgtggggttttcagatggtgatgaccaggagaagtgctaataccggtgatggcaaccaacctgagggcagcaaccacaacaaccatggcagcccacccccacctcctcctccgcctccaccaccaccaccagataccaacgctattctcacccaaatcctcgcccagcaggccaacatgatgactgctttcctccaccacctccaaaatccgccacaacataatgctccaccaccacctccccaacactcaaaactcgctgagttcctccgcatccgcccacctaccttctccagctccaacaaccccgtggatgcgttggattggttgcatgccgtggggaaaaagctagacactgtgcagtgcagcgatgaggagaaagtcgtcttcgccgcccaccagctgcaggggcccgcatctctatggtgggaccatttgcaggctacgcagccagagaggcagcctattacttgggcccgtttcaccgccgatttccggaggacccatgtgcccgccggagtcgtggcccttaagaaaagagaattccgagagttgaagcaaggcaaccgctccgtgatggagtatttgcatgagttcaacaacctggcccgttcgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgctacgagcccgggcactttgcggataaatgcccaaagccgaggcgccagcaaggcaaagcgcctccccgctccaacaatggtggtaacgatgtcattcggggtcgtgtgaaccacgtgacggccgagaacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctgctcatcaccacccctggagtggttatgacagcaaagtattatagccctgccgtccctatagaaattcaggggattccttttccctcggatcttattctgctagacaccaagaacttggatgtgatccttgggatgaattggttggctcaattccaaggagtagtggattgcgcgagacgcactgtcactctgtaccgagggccggaacaaccggttgttttctttgcgcccccaacctctgtcagtagttcagaacttcatcagataggactgtcagaaatccccatcgtcagagagttcggagacgtgtttccggaagaactactcggtatgccacccaagcgagagattgagttccggatagatcttgctccaggaaccactcctctgtacaagcgaccctaccgtatggcagcaaatgaactggctgaagtcaagaaacagttggaagagttgaaaggaaaggggtatatacgtccgagtacttcccccaggggtgctcctgtgatttttgtggagaagaaagacaagacgaagaggatgtgcgttgactacagaactctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattccgaagaccgcattcaccacacgatacggactgtatgaattcacggtgatgtcgtttggtttaaccaatgcacctgccttcttcatgaacttaatgaacaaagtgttcatggaatacttggataagtttgttgtggttttcattgatgacattttggtatactcacaatcagaggaagaccatcagcaccatctccgtctggtgttgggaaagttgcgggaacattaattgtatgccaaacttagcaattgtgagttctggttgtccgaagtcaaattcttagggcacatgatatctgctaaaggagctgctgtggaccccgaaacagtgaccgccgtcactgattggaagcaacccaagaccgtcactcaaattcgcagtttcttaggtttggcaggatactatcggaggttcatcgagaacttctcccaaatcgctcgacccatgacacagttgttgaagaaagaagagaaatttgtgtggagcccgcaatgcgagaaggcgtttcaaactctcaaggaaatgctggtttcctcgccagtgttagtcttgccagatactcgtaaggatttcatggtgtattgtgacgcttcgcgccaaggactgaggtgcgtgctcatgcaggaaggacatgtggtagcctatgcctcacgccagttacggccccatgaaggcaactaccctacccatgatttggagttagccgcggtggttcatgctctaaaaatctggcggcactatctcattgggaatcgctgtgaaatatatactgatcataagagtttgaaatacatcttcacccagtcggatctgaatcttcggcagaggagatggttagaactcatcaaggattatgatgtgggaattcactatcatcctggtagggctaacgtggttgccaacgctctaagccgaaaaagccattgcaacactcttaacatccgtggcattccacccgaacttaatcaacagatggcagccctgaaactaagcatagttagccgtggattcttggctgcgttggaagccaagcctaccttgctcgatcaaatccgcgaggctcagaagaatgatccggacatgcatggactcctcaagaatatgaaacagggtaaagccgctggtttcacagaggatgaacatggaaccctatggaacggaaatcgggtatgcgttccagataacagagaacttaaacagctgatacttcaggaagcccacgaaagtccttattccatccaccctggcagtacgaagatgtacttagacttgaaggagaaatactggtgggtcagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcggttaaccaaggtagctcgatttattcctgtgaagaccacctatggagggaacaaattagccgagctctacttcgctaggatcgtgagtctccatggcgttcccaagaaaatcgtatctgattggggaagccaattcacctctcacttttggaagaagctccaagaagagctgggtacccgattaaatttcagcaccgcatatcacccgcagacggatggacagaccgagtgtctaaatcagatcctagaagatatgcttcgcgcatgtgtcctagatttcgggaagacctgggataagagtctcccctacgccgagttctcctacaataacagctaccaagccagtatacaaatggcaccttatgaagcgttgtatgggcgcaaatgccggacaccgctcttgtgggaccaagttggggaaagccaagtgttcgggactgatatcttgagagaagctgaagcgaaggtcagaaccattcgggataatcttaaggtggcacagtcccggcagaaaagttatgcatataaccgtcgccgtgacctggaattcgcaatggatgactttgtgtatcttcgggtcacgccattgcgaggtgtacacaggtttcagacaaaagggaagctcgcacctcggttcgtgggtcctttccgtatcattgctcggcgcggagaagtcgcttaccagctggagctgcccgcctctttgggcaacgtgcatgatgtgttccatgtgtcgcaactcaagaaatgccttcgagtgccatccgagcaggccgactcagagcaaattgaagttcgcgaagacttgacctacgtggagaggccagtgaaaatcctggacaccatggaacgcaggaccaggaaccgggtaatccgtttttgcaaggtccagtggagcaaccacgccgaggaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaatgcgtaaataaattttagtggaattttcagagcacaaataataattaagaagaaataaacaaagttaaaatggttttataaaaagaaaaaccctaaaaagtcctttttccccctccccttcttgggccggctcggcccacctccctccctctctctcctctcccccgcggcccaatcggcctcctccccgcgcgcgtgccgctgacgggcaggcccgcccgccaccctcgctgacgggtggggcccacccgtcatcccctaccttccgccgcccccgccgcctcgcccgtgcgctagcgccgccgccgccgcgaatcccgccgctcccgtccgtcccgcgcgcaatcaagaggggggaaatattccccgtgattccctccctctttcccccccgtttttccctctctctctccctcggattcgttcgaaatctttccccctaaacctcgccggcgcatcaatggcggccggatcttccgcggccgattcccccacatccggccgctctctccccctcccaaccctatataaacaatgtcgcgtcccaaaacgactctaaaatacatcctcaaaattatgccgagaataattaaaattcatgtgaaagcctccaacaattaaaatgtgcaaatttaaaagtcaaataaggcttggaggatttttgtatatttcctaaaagcctaaaatgcgtaaataaattttagtggaattttcagagcacaaataataattgagaagaaataaacaaagttaaaaaggttttataaaaagaaaaatccctaaaagtcttctttcccccccttttcccctcttgggccggctcggcccaattccctccctctctctcctctccccgcggcccatcggcctcctccccgcgcgcgcgccgctgacaggcgggcccgcccgccaccctcgctgacgggtggggcccacctgtcatccccttcctcgcgccgcgcccgccgcccgcccgtgccctagcgccgccgccgccgccgaatccgccgcatcccgccttccccgcgcgccataaagagggggaaatcactccccgtgattccctccctctttccccccactttcccctctctctctccctcggattcgctcggatttattcccgaaatcctcgccggcgtcattgatggagccgagatcgccgcgccggtttccttcctctccggccgccctctctcgctcccgacgctatataatcgttcctcgtgcttcgctcctccgtttccgccactcgccgcactctctccccgtcggattcgagctcgcgccgttgtcctctctctccgccgtcgccgccgagctccgattcgccgcccgtcgtcgccccggatctcctcccgtctcggcgtcacctccttcggcttcgccgcgtccccgtcaacctcgtccaccccttcgtttcgcctgccgaccgtcggagcgccgccgtcctcgtcgatccgaaccgcaccgccgcctctcgccgcttcggtcgccgtttttgtcgccgccgtcgacccggggtgagccgaggaccgccgcttcgcttccctcttctctcctctctctcgggcgccaccccgccgcgccggtggtcgccggcggtgaccatcggggcgcgggcgcgccgcctcccgtcggccgtgccggcgaggccgccttcgggcgcgccccgcggctgccatgtggggcccggccgtcagccgcccgcgcccgcgggtgcggctgacgcgtgggacccatggcgccggccagtgtgagccgcgtgcacccggtccaccgtggaccgtgaggttgccgcgtgggccccactcccgtggacccggtccgcgcgcccctcccctcggctgacgcaataaatccgattttaaattaaaaatttaaatgaagaaattcgcaaatattcatttaaagaacatataaacttcaaatggccataacttggtcatttgaactcggaattggaccgttcaagtctctaatttttccttaagaagtcaagaacccatttttgtgctttgtttctgcttgttatatggattttattagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattaccgctttatttaaattcccgcgttatcactgttttatctagccatgcctatttacctttgttatgaccttattattattgttgttgttattattaccttgttcaccctagaataaacaaaaccccaactagtggacactctactcatagtaccactagtataattttaggtagatgcttcgcaatttaattaggtaacattaggcggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatacaaggaccggtcttcgggcctctgttgcaaagcactaccgtacttccacatgtctagtgggtaaggcttagtttgtgggtcagtctggttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctacctgcctgtcccgggggttccggccgtaggtgggattgggtcggtactcttgtctatggctaggatgggttggaaactatgtcacgtcttccgtctgtataccgtggtggtatgtggcacgtggtcgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcataggccttgggttaaggcaggttcatgtgggttcacgaccttgattaataatactgtgtagctttaggatcgtgtttacaaaatagctttgggcaactaagtgacttttaaatgttgtttactgcaaaacttaacctctatattattatccccttgtaccccttgcattaattatgcatctccggtgtggcttgctgagtactgtggttgtactcattcttgctctatctttctccccccttcagtaagagaagctttggagaagaagtcttaggtggagtcttggcttataccccagttgagcgcctgtgaagatggacccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcattcgggaaaatgaaattttctcagtcgcgacaaggtttctcagccatgagggaagctgccttctgacttctaatcggtcccactgggcgtgccaaaagcgtgttgacagaaaacacgaggcctgggagatctacttaactccagtgcaggtccaaaactcgccttcagatgtgtgagcatgccagttgatttgatcctgcaatcaacaagaaacaaagacaaagaaaccgtaattaaatccataaatgatagccgatcggctaaatgccaataacatatcatttatctttgagccgatgtcatatgtaaatcgatcggcaagtgttaagtaaacaaatcagaactaaatctactcaatcggctgtagacatcaataatatataatccttatatcgatatatacttgaatcaagtgattgggatagatcggtcaccttgccgagacagtataaatcacttaaatcgaaatatatattattaatgagattatatatatatattcatagcatagccgatcaaatagatctagcatgtattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcgagaacacaaaccgccataacaagttttaccttttgttgaagatcgaaacccatgcagctcaacccgaaagcaagaacttgtcgaaataaaactaaagcaaaaagggtggtgatgcgccaaaattgtattgaacgtgtgtgttatccattacatagggctcggggcctatttatacccaagaattataagatatgtccatattggacacgactcttatccctaacaaactctaagataccataagtctttgtggcagacttttgcccacatttatctctaaggaatttacataaaatatcctaattaatagatacaattgccttcccaggactctatccatgcgtggcaatcatcttgaagcacatcaattcgaacccgttgtcgtacgcaagtcgtattattggaatcggctacatcacttaacctagtctgactcagacttagccgatcccaatcgtagccgatccggactccagccgattcttactctgtttccgcaacaacccttatcttcgattccgcttcgatccatcttcatctccgatgctgatattaccaaagttggtcgttaacagcggtgagggtggtccggttgcgatcggctgcggcctcctcatggaggcggagggaggactccgcctcagccgccgttctctcgtgggcggccaaagtggtctcacgctggtctagcatgcacgcccgcttctccagtgcctgggtacgctcctctagcacccgagcatgctcctctagctcccgggcctgctacgcctgttcccggcggtgcccatcctgttcgcgctggttgcggtcaaggacctcgatccgtggatggaaaatggcggtatcaaccccaccatggcgaaggacaggaggtgcacggatcgctctgggtaccgcggccgcggttgcgactcccccaccctcacggcggcgtcctccggcatgatcttgcgggtgaggctaaggtacctctctgccgtgatgcgtaaagccgggagcacagcgtcaccagcgtcttggcccgtggtagccggcgggaaaacggcgaggagtatggtgtatggaacagcgtggagcgagagaagcgttagggcttgaggagcgagtatgcgggtgagcagtcggcgagaggaaggagacgaactctctccctccctgcccttttatccccagctccccgcctcgcccgcgctcgcctcctcgtttcacgcccttgcggctgccccctcgattcccgcgtctgcggttgccttctcgactctcgcgtccacccatcacaccaccccactgaacccgcgccccgcatttagtgcgcctgtcatcggcacactcggcgcggggcgtgcgatgttcacgggcgcggttaggcgggcccaccatcggtcccatcacgtgcctagcaggtgagggagtcgaggcggcgtgggtgacgattctggacgtggtctagccgaccccccgattttcgcgccctaggcacccccagcatcagcgtggttaatggtggtcaaatcaccattctggctaaagcgccagcctggccgctcgccgacaaccctctgaattccccgccgggcccacaaccacagcacgggaagtcgtgaggcgccacgtcagactgtcctttgggggccaatgttcgacgcggtaccgggggctactgtcggagatatggtcccgggggtatacaaagtgaggggaagttaccttcccatctagccgcgtggctctacagcttggccttactcccgcacctcgcgagtggcagaagcggccggggggcctcggggtgccacgtcatgcccctcgggccctcgcgctgcctcgccccgaggccctcgcccaaccgccatttggtggggggagcgagcggggaggcgacccaggctgaacagccatcaatgcgtgacgccccaactgtccctcaccgcgtttaatgcggtaggggcagacgtgcggtgccgcctgactaacccacgtcaatcaggcgggaccagtctgtgaccggcctattgccggtcacgtccgattggacgggtggccgtgcccccacgtcgcctctgtatccggcggagtggaggtaggtatgtcccgtcccatcggagtgtcattcggagttccctccgtgagaggacgaccaccacaagtcttcacccatttatgagggaatgacagggctgttccccgtgtcaggtggggggtggcgctgtgtcctgctcaaggacggactgctgcttagcctccaggcgaaggcacgggtcatgacccggtcaaggtaaagtgggtcgccctcccatggaagagtagagtagaggcggtgcatgtggtatccccttgaactataaaaggaggaccttgcctaccgagaaaggggacgacactcagtagacctgaactctaggaaagcgaagagcaagaacgctctccggagttaggatcccttgtaacattcaaccactagtcccacacacaggagtagggtattacgctcgatagcggcccgaacctgtgtaatcttggcgttcgcatgcgatttaggagcattcaaggcggatacgcaatctcgagaggcgagccctttcccccggccgaactcacaaaagggggatctcacgatctcccgctagagaggatcatctcctcgacacccgacgacttggctcctgcacgctccggctccgtaggctgtggtgggtgtgttggtggtgatattcgatgaccttaggtcctgcccagggggtccctgatataccgcgggtcagttgatctcttagtaggacttggagatatcggacccctcacaatatggtaaagacccagtcttgtccgagtagaactccttccatccgtagataccatccttatcacgtgatagatttccttaatgtatacttgtcacgaccggaaatcacccaacaggcgttcctgacgtgcgtgtattgttccttgtcccaggaggcaaggtacaccaaaagttgatacaattcagagtttaacaaacggaagcgtaaatataattattacacgggcagcgaaggcccaacacacaaagacaaacgagaaacagcggaagactagggcgacgaccacaggcacttgccggcaggcacgagctagacaccaaagccttcatcttccaggaactcctcatctgggcttgggaaaaattgagcaagactgagtacaaccaccgtactcaacaagacacacccgcagatgcaaaataaatgcaagggagtacaagggaattataatataaagggttagggttgcggtaaacagcatttaaagacgtttagttgctcaaagctatttgataagcacgattctagaactatacaatgttattaatcaaggccgtgaacccacacgaacctgccttaacccaaggcctatgatgattcagaccgaactggcaacccgaccctgggtcccagctcgtcccaagccaacccaggccaaccattccatattttagttgttaagcaggttttaagaattaaaacactaacttgggtacattgctcggcttgcccatatccgagggctcggctattcgaatagattatactctgatcagaggtgtacatctttacccacaagacacatctttctcacgtgcaaccatgtgccacataccaccacggtatacagacgaaagacgtgacatagtttccaacccatcctagccatagacaagagtaccgacccaatcccgcctacggccggaacccccgggacaggcaggcaggactgagcccctagcagcagggcaccaaccctctgccattcgacatctcgactaccgggccgcagctcgtgtagccttcatttgccctggagaatgtccatcgacccccgacttcatccatctccaatccgtgtacttctgtttacgactagactgagccacaaactaagccttacccactagacatgtggaagtacggtagtgctttgcaacagaggcccgaagaccggtccttatatggccgaggtgctactatcaaaaccatgcacctcgagcccagcctaaaaccattttggggattttgaataaagggggatggtgtgaatccaattccacaataaaccaaccattccaaagtgtccaggtgatatgaatatttcccaaagtctaaagttataaaaccacctaatgttacctaattaaattgcgaagcatctacctaaaattatactagtggtactatgagtagagggtccactagttggagttttgtttaatctagggtgaacaaggtattaataacaaaaacaataataataaggtcataacaaaggtaagtaggcatggctaaataaaacagtgataacgcgggaatttaaataaagcgataatgcaataatttaaatcaacataattttataaactgggattcaatatgatcaagatgatgtgtcttgccttgctcgccttcccaaacgtcggcttcgacttccacgaagagcggatcttccgaagctgcagcgtctacacgaccaacggaaaagaaaaggcttaaacactaaataactccatataacagcagaaacaaagcacaaaaatgggttctttacatcttgaggaaaaattagagacttgaacggtccaattccgagttcaaatggccaagatatggccatttgaagtttatatgctctttaaatggatatttgcgaatttcttcatttaatttttagttaaaaaaaatcctatttattgcgtcagccgagggagcgggcgcgcgggccgggtccacgggaagtggggcccacgcgtcagccccacggtccacggtggaccgggcgcacgcggctggcggcggtcggcgccgtgggtcccgcgcgtcagccgcacccgcgggcgcgggcggcggacggccgggcccacctggcagccgcgagggcgcgcccgaaggcggcctcgccggcacggccgacgggagcggcgcgcccgcgccccgatggtcaccgccggcgaccatcggcgcggcggagcggcgcccgagacagaggagggaagggggaaggcgaacggcggtcctcggctcaccccgggacaacgacgacgacgagaacggcggccggagcggaggaaagcggcggagcgggtcgggatgacgatgacgacgacgctccgacggtcggcgggcgaagcggagcggcggacggggtcgacggggatgcggcgatgccgagggaggtggcgccgagccgggaggaagcccggagtggcgacggcggcggaacggaactcggcggcgatggcggagagggcggagcacggcgcgagcacgaatccgacggcgagagcgagcggtgagcggcggaaacggaagagcggagcacggggagggtttaaatagcgccggggaagggaaagagcggccggagagggaggaatcggtcgcggaggatccggccgccattgattgcgccggcgagggtttcgggaaggaaatcggacgaatccgagggagagagagagggaaaagcgggggaaacgggagagggaatcacggggagtgattcccctctctttaatgcgcgcggggacggcgggagcgagcggatttggcggcggcggcggcgctagggcacgggcgcggcggcgggcgcggcgggaggaggaagacgacgggtgggccccacccgtcagcgagggcaggcgggcgggcccgcccgtcagcggcgcgcgcgcggggaggagccgatgggccgcgggggaagagagagagagagggagggattgggccgagccggcccaagaagagaaaaggggggggggaaaagaacttcttttaagattttctttttataaacctttttaactatgtttatttcttttcaattattatttgtgctctgaaaattccactaaaatttatttacacgttttaggcttttaggaaatatacaaaaatcctccaagcctcatttgacttttatctgtgcacattttaattgttgaaggctttcacattgattttaattattctcagcacaattttgaggatgaaatttagggtcgttttgggacgcgacaatacggaaactatccatatacgcgtgggtataccgtattagtatataacgtacagccaaggatagagggtataccttatccgtaaccttgacagtagcccccgacttctgcttaaatgagctcatgttatcgatcgcaacttctgatgtcggaattgttgtcgctctcatctggtcgatctcggtgtgaaaactgtagagacaaagagccatcgacaacaccgcatgaagttcaacggccatgagtgaatttaaattgaagtctgaaaaactaccccacgcaacggacccagaattttccggcagcaatctctctcctttccttggaatacgcaccatcggaagcacgtttacttaaagggattttggggatccatttgaagtccgtttgcaagaaaactctcctgccttctagcactcttcgtcttctccgctccccacaaaaaaaaaccctagctcacttccttcatcctattctccggcgatcctccggcagcaatggaccttgagaaatcttcctcgaacaccgcatccatgaagaagctacaggacgacggtgccctccccggtcgcgggaccatgcagagggaggctagaggtacagaacctaaacccatctttcaccgcatggttgtaattgaacattatgtttcttgtggttttcttcctccgccttccgagtttcttcttcttgtcttgaatttctacggcctttctttgcttcagtttaaccccaactccatcgcctttttgagcatcttctctcatctttgcgaggcctaaattggggtagtgcctttccttgacctcttccatttttattacgagctgcgttggatggaatccatcagggtatctggatgcgtcggattccgacttcgggatggcctgaagtcgcgttacatccccttcagtgccccacttctcgcagcaagtggcaaacgagatggttctacctccagatagagaacttggaccccgtccttgttattcctgaggaccagccagaaaagatcccagagtggactgctaaacccgccttgactccctccctccaatcctttatcgacatcattgatgatctccgaaaacgggggttgtcgggatatgaagtcgctgccgacttcgtaggtcggcggattcaaccgctacaggcccgtgcccatccggccttcgattactctgggccagatgacgtgacccgggtctctcctcggggtatttatcctcgtatttctaaatttgtttcaagtgcatctgtttcctctaacttatcgagttctcgttctcgatttacaggtctggacagtgacactgtggggcgccgcatcggccagataatgatcagctgtcacgcccagaaattcccgaatagaattccaagcagaatgtgcaataaaatccccgtccaggaccagccagggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcctcggagaacccttcatctggtccgaactcaaactctggggttgggaaaagtagagcaagactgagtactacccactgtactcagcaagtcataccggaatagaggtatgatgcagggaatcatcaaagaaaagctaaagtggttcctttgcataaagcgagcatttataaacagagatttcaagatttaaacagttgtaataagtaattaagcagtattaatcatccactgtccaacgctacaccacgttgcaacaggcccaaccatccacctaaactatccaaattaaaggattacactaaggtgagactaatcatggtgaatctggttgaccgcccatgaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagtgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccagagcggtggtattaaaccaacattatcatataaacttatagtctaggttttaaatgagattccccattgtgtgctagttgaactaggcatggctaagcaattcctagtccaaagtctaatcatgttataacccaggctaacaaaggagaatgatatccaaaagcatggctataacaataggtaaccatcccatagtactattataaaacaatgcaatatttgaaagaaaacaatagagcatttgcaatataggatcaacatgttcaagtgacaagcatgacttgccttgctctgctgctggagggacctcggcgactatctcgaagtacaccgaagcgtcggaggaatcggaatctagcgacatacaaagcaaacattgcaaacaggctataagactactgaaacagagaacaaaaccatttttaatggattctacacatttttcttgatttactgagacttgaatggacttaaacggagctcggatgaattagttatgaattttagaaggttcactgtgtttattactataaaagaaaaaccttaaacaatttattgcgcaatattaaccagggctgacgtcagcacgggcggcgcggcgccgacatgcgggacccaccggtcagcggcacggggaggagagaggaggcgtcggcccgcgggcccaccggtcagcggcacggggagggcggtctaccgtggaccgggaccacgcgggtgatccaccgccgatccacgggaccgacggcccggatcgccctcgggccgatcggacggacggcggcggcggcagcccccgggctcggatcggcatcaaagccgatcggccgacccggggctagcggcggcggtgcgtgcgcgtcgcgtcgctggcgacggcaaccggcggcggaggcgacgcgaaagcggcggcagcggatggcggcaacgacccaaagcgacggcgagcgcgggcggcggcgacgcacggggaaacggggaaggagaggagaggagatgcctcaccgagggtggccggcgcggaggaagacgatggcgaatggcgacggcaagccacggggggcgacggcgaccggcggacgagctccggcgtgccctaaggaaggagaagggagggattagagagagggagatagaccccggcgaccggcattcgaggccgaaagcggcggtagggtttagaccctaccggagcgcgaggagacgggggttccggcggcgaacctcgacggggaaggggcggccgaggtagatctcgaccccgcgaacccgacggcgacgacggaacggtgcggcggcgaccctagcggtggctagcggcggccgaagtagcaaaaacggcggcggcgggtggttgcacggcgcgggagcgttggggggctcgggagaggtcggcgcaatggggaaaaagagagagggggtgccggcgatgcttaaataaggggagagggggccggacgtggccgggagcggcgggaatcaccggccgacgtgggggagtggggaggagagagaggcgggattcgattttcgaatcccggccatctcgggcgcgggcgcgagcgggagagagaggggaatgggcgcgggggatgcggcgcacgcgcgggcgtggtcgacgtggcccggggaaggcggagacgtgggcgcggcgacggttgcgggcgcggcggcgcgccgggatcggcgggaggagggagacgggcccgacaggtgggtcccacctgtcggcgaccccgggagggagggaggcgggcgcccggctgccgggctgggcctcggcctgcggccggcccagcagagaggagggggaaagagaggggaaatgggccgacggcccatttaacaaaaaaggaggaaaaagaggggaaaaagaaaaagaaaaaggaaaaaggattttccctggaattaaaaattgcactttggtgatttttaattggttacaattgtttctagagctctgaaaattccattaaaaatcctgttaatgaatttcgacatgtagaactcaagaaaaattccacatgtcaaatccgattattatttgcattattttcttagggttttctcctgatttcacctgcattttcttagggtcttttataaattacaatttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtgaccttgtttctggttctcctttcgctggtatccagtatacgaaccggcttctcaacataagttaggtcttcctggatatcaatgtgttccgaatcagcctgttcttcaggtacccttaagcacttctttagttgggacacgtggaacacgtcatggatgccgatcatgttggatggaagttctagctgataagccacttctccccttcgttccaagattttgtatggtcccacgaagcgtggtgccaacttgcctttcgtctgaaaacggtgtactccccggagcggagtgacgcgaaggtacacgtgatctcctgcctcaaaagtgagctcccttcgacggttatccgcgtagctcttctgtcgagactgagcaatcctcaacctttccctgatgattctgactttctcttctgcttccgctaatacttctgttccgaatagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgacccgctcggtctggccatcagtttgcgggtgataggccgtgctgaaatttaaacgggtccccaattcttcctgcagcttctgccagaattttgaggtgaactgactccctcggtcagatacaatctttttgagtactccatgtaggcacatgattctcgaaaggtaaagctccgccaaccttttgcccgtatatgtggtatgtactggtatgaagtgagcaaccttagtgagtcgatccacgactactcagatcgaatcgtgacccgacgatgtccggggcagtcccgttataaagtccattccaatttcttcccatttccattccgggatttgaagaggttggagtaaacctgtgggtctttggtgctctgccttcactcgttggcaaacatcgcagagtgcgacgaattcagctatttctctcctcatgctgacccaccaaaacttttctttgaggtcttgatacattttggtgctgcctgggtgaatggagtactgggtctgatgagcctcggtgagtatcagatccttcaattccttgtcgtcaggtacacacaatctttctcccatccagattgtgccatgctcatccttaaggaaatcccgagcctttccgactctcatgttctttttcagttctgctatttccggatcatttacttgagcggctctgactgatccacgagcgtaggccgtgcttccagagcggctacgaacccgtgttcaacaattcctatgttgagatgttcaaactcctgccgcaattcctcacacatgctctcgatgcatagagcagtgcagtaacttttccggcttaaagcgtctgccaccacattggccttacccgggtggtagtgaatactcatgtcatagtctttgattagctccaaccatcttcgttgtcgaaagtttaggtccggttgggtgaagatgtatttcagacttttatggtccgtatatacttcgcagcggttgccgatcagatagtgcctccagatcttcaaagcatgaaccaccgctgccaactccaagtcatgagttggataatttccttcgtgtggacgcaactgccgcgaggcatatgcaaccactctgccctcttgcattaggacacatccaagtccgtgacgggatgcatcgcaataaacttggaagtctttcatctggtcgggcagaatcaaaactggtgcggatactaatttcttcttgagctcctcaaagctcttatcgcactccgctgtccatttaaatttctcatctttcttaagcaactgagtcatgggtcgggcgattctggagaagtttccgatgaatcgacggtaataacctgccagtcctagaaaacttcgaatctgcgacacagtcttcggtggggtccacttggtaactgactccacgttcgatgggtcgactgccacaccctgagctgtaatgacatgacccagaaatttgacttccgtcaaccagaaatcacacttgctgaacttggcgtatagctggtgctccttcaacttctcgagtaccagacggagatgttgttcatgttcttcttcgattttgagtagataagtatgtcgtcgatgaataccacaacaaacttgtccagaaattctatgaacactttgttcatcagattcatgaagaatgcaggcgcgttagtaagtccgaaggacataaccgtgcactcatataacccgtaccgagtggtgaaggccgtcttcgggatatcctcttcccggattctcaactggtggtagcctgagcgcaggtctatcttagaaaacactttagcccctttcagttgatcaaataaatcgtcgattcgcggcaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctccgttaattcgttggccgccattctgtacggtctcttatagattggagcggttcccggtgccaaatcaatccggaattcaatctctctcttgggtggcatggtagtgaggtcttcggggaacacctctggatactcgcagactatgggtatatcatccaattttctcaagttcttctctacggtgtccactgggatttccgtctcaatctgattcaacgagactcctttctttggcgagactagagatttgtacaccacggtttctcccttctcgttggtcagggtgactgtgcgattcgcacaatcgatgactcccttaaacttggtcagccaatccatcccaagaatgacatctaggtctttggattcgagaaggatgaggttggctagaaccggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgcttccgtctccttcttggcttgcgcgggctggcctgactgtgccgatgccactggtgggcgtggagctgcaccgcggttgggctgacctccatggtggttctgactgtcactggtgccctggtagaagttgctagggttgaacgggcggtgctgacggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagccttcaaagtcagcgtagtacccggatatcagctggttggtcagctcatcatccaggcccgccatgaacttctcctgcttatcggggtcggtacgaacatcctatggtgcatatcgcagtgaggcgattgaactcgtggaggtactctgtcacggtcctgttaccctgatggagtgcacgaaattccctcttcttttgtgccacgaccccatctggcacttgtgcctcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctattgcatggagccagtcatttgcctccatagggttggtggtgctggagaaggtgggtggcctgactcctaggaactcaggcaatttggattgagggggagggggaccaaagtgctggtgctgctgttcgacgtgctgcatcatcctctggtgcatttgctggtgttgttgctgcatctgctgcatcatggctgccatcatctgagtctgatgcgccataacttgggcaagggtcggattctcgggaagtggtggcggaccattgccggaatcactgttggggtgcacgccatcaacgcgttcttcgccgttgctgccctcgcctgtcgtgcggttgccagtcctggtgtagaccatctggagggaagagcagccggggtaaagaagaaaaacagatgctcaagaactaagctttattacaaaggaatttaaactgcaattgttctgatctgaattaaaacacttaaaagagcaagcaaccaatccttattaagacagccataccataggcacatgatatcgaccgtcgtctgacccaaacaaacaacctaaacacacaaactaacgaacaaaagctagacagtcggtaaactagtgggaaaacgagcataatgctcggaacggctcctgcggtcggtggagtcgaaagcgtcctcctgctcgtcaccaggtccctctgagcgactcctggagcctggcagatacgtctcgccgctgcctgactgcgagccactggagctgctgctgctgagatcgcggctgccactgggagtagcagacaaccaacccccggtgccactggctggacctctggcggctgacgctggagcgaaggagagagcggacgcgggagctggagctggagctggagctggagctgcaggaactgcgggcggaactggaggtgctgcgggagctgctgctggaggtgggtttctgggtgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtctgtcacatcctgattttcgtttcaggatttataaattatttaataaattattaatagaatttatattaaatgttctttaatttacaagtgaagttaaatgtgggaaataaaatttcctaaataaaaaaaagcatagatggatttaatttttattaagtcctccatgattaattatactctctggaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgttgggccgaatccggcccaactcctctctctttctctctcttcccgcgcgcggcccacgccggcccagccgagccgcccgctcctcctctctccagccgctgacatgtggggcccacatgtcagggccgtcttcaacctccggccgccgcgccgccgaagcccgaaccctagccgtttttgcgccgccgtttccggccgaatccgaccccatctcttccaattgattgaggggttttgttcctctcggtctcctctttcttttcccccaagaatcaaagcaaatggttgaggattcgatccgaatcgaactcgttttgttttatctctaaaaaacgagtccgagttcttcccgattcgattcctctcgtttgcgacttgatctgttcgattcgagctcatataaaccttccccatgatctcctctttcgtttgccccctttcccgagtcctcccgtgcctcctagcgccgtcgcgacgagctccaagtccgccgccgccgccggccatcttcggcatcgtcgcgccgccgtctccgtcgtcgccgtcggtcgccgtcaccaccgttaggtgcgccgtgaggagaagaagctcggccgcccctccgttttcgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgagccggccgccgtcgctgacgtcatgctgacgtcaaccttagggctgacgtcattgtttccagggctgacgtcatcatccctttttccttttcctttttccttttttctaatagatcaaatctttggaaaatcataactaaataaccgtagatccgttccaggtggttcaagttgctaaattcttctaaaataaagatctacatattaaaattgtccataaattgagttaaatttatttaattctttttaaatgggctttaattagatttaatcttgtaaaattcataataaattcatttgaagtcagaatgaggccgttcaagtctcataattcatctaaaattatgatctacatgtttgtttactttttatgtactgttcatttggtttttattagtctttttcttcgttttgcgtgttagcttgtcgtttccgtcgttgcgaaggttcgtgagtgcgccggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgtcatatatatatatataattgcttagcaatgcttagaaacattagctcattaatgggatgaattatatacactacattattattatggttatatttaatggcagctcacgatggtcaatcgtgattggttaattaattatttgccaattaaaacttgataatggtgggttgtgagcacatggttttgatggttgtgctcatgacaattaaggaccggttcgcgagctactgttgtgaaacattaaccgtaccaaccacaagccagcgtgggcaacggctttatcttttgtatagcgtgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacagcctctattcgggtactttccagtatcgcgacgcatggttgacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgtaataactggtaataatttgcttagctcctgctttggagattagatctgtatagccgggtatggttgttcaggatggttgggcctgagcagcatgggtgtgctgttcagtgttgattaaaattgatgattaattactctactgttttatttctctcaaatgttttgctaaatgctgcttttgcaaatgagcctatattatgccatcctttggaatctttgtgcacttgcatatttgctgtgtggcttgttgagtatgtcatatgctcattcttgcaataatcaatcaacctcagttgaagataaaggatccggaaggagaagacgtttggcttataccccagttgagctgcctgtgggagtggagccggagcttcgctagattttatttttccgctgcagtttccttcttggtgaggactaagtgcctcttaagtaagtatttatcggtttagttattatgatggatttgtatattaaattgtcagtttgtgtacctcggctgattcctggacgaggattttatgcacaaatcagttcggaaattattagtgaatttccgggcgtgacaagttggtatcagagccatctcgactgtaggataagccaaatggtcaaaccttaaggactaattttccgaaaacataatttgtgaaagtttctcttttcttccttatctagaattcttcgcaaatcgttttgtcgttctctcctcttttccctctttcaacgtgagtagttgttaaacttgatggagaaactcgaaggcgtcgatgttgtcaacttctgcaagtaaagtggatcgaggaagaaccgaagtgcccagatatcaagatagagtgaagttggatcctagtttagaacctatgccgccaaagtgtctttgaagaatagttagtaggatagaacgtttgttgcttgcttgtgtgtaggtatggttgcattcccgtcattggagtagtccaatgatgagtgtgtaactatactaggttgtttgcttaatcaacttgaacaatataatggtttacacacatcagatcagtgttaaactggttaaggtcttgtctttagtgtaacccctctccttctatcttctctaatctgcaacagatggtgaacactcgcactagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaagccacctactttttctagcactaccaacccagtggaagcaggtgattggctgcacgctgttgagaagaagttggaactgctccagtgtacggatcaggagaaagttgttttcgcttcacatcagttgcaaggacgtgcttcagaatggtgggatcatttccggatgaacagagcagaaggacaaccaatcacttgggcggagttcactgaagcattcaagaagacgcacatacctacaggagttgtttctttgaagaagcgtgagttccgggcacttaagcaaaaggatcgtacagtgacggaatatcttcatgagttcaatcgtctagctcgctatgctccagaagatgtgcgtactgacgaggaaaggcaggagaagtttttggaaggcttaaaggatgagctgtcagttatgttgatctctcatgactatgaggattttcaggagttggttgataaagcaattcgactggaagacaagaagaacaggatggacaatcgtaagagaggaaggattgttttccaggaggcacaggatagtagccagaggtagtgtatcaagccactccaaattggtgaatctttttctgctggtcaaggacagtcacaacagttgggcatcagtggtgagattaactcagagactaatgcaagcaatgaaggcaatgatgagcaagctactcaatcagtgtcatttcagcaggatcagtctcaagaagataacagtaatggaagggagcagcgggtgtgtttcaattgttatgagccaggtcacttcgtaaaagagtgtccgaagccgaagcgtcaacagccacaaggccaagtcaacaacattgtcctcacaggagcaaatgcagtgccggttgtgtcttcaagtgttacaactcagccactagtatcaaagcagcagtagttttctttaaagccttagaataattatcgaagttatggaataagatagactgcagtttatctatgccctttttctttctagccgttccgaatctcgggacgagattctttgtaaggggggtagatttgtcacatcctgattttcgtttcaggatttataaattatttaataaattattaatagaatttatattaaatgttctttaatttacaagtgaagttaaatgtgggaaataaaatttcctaaataaaaaaaaagcatggatggatttaatttttattaagtcctccatgattaattatactctctcgaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagttaaaagagaag

SEQ ID NO: 20879 - DNA, 2255 bp, Oryza sativa
ctcctagcgccgtcgcgacgagctccaagtccgccgccgccgccggccatctcggcatcgtcgcgccgccgtctccgtcgtcgctgtcggtcgccgtcaccaccgttaggtgcgccgtgaggagaagaagctcggccgcccctccgtttttgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgaaagctcggaacagctcctgcggtcggtggagtcgaaagcgtcctcctgctcgtcaccaggtccctctgagcgactcctggagcctggcagatacgtctcgccgctgcctgactgcgagccactggagctgctgctgctgagatcgctgctgccactgggagtagcagacaaccaacccccggtgccactggctggacctctggcggctgacgctggagcgaaggagagagcggacgcgggagctggagctggagctggagctggagctgcaggaactgcgggcagaactggaggtgctgcgggagctgctgctggaggtgggtttctgggcgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtccccacgtaaccatggacctccaagcggacacggtgaggaagctcgccactgagcggtggaatggtcgtgtactccggcgcgtcggggtagcccaccaccagtgtcatgcgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagggaatcaaataagagcagaattttatgcatagatcattttacatgagagcgaataaataagacagactcacataacgataaaataatgagaaattagatacataataataataacgaacaaagcataaataccttgcaacccatgttacagagctaggacctaatgcattgcacccatcaaaccccaactaactgacgaataaatcccaataattttactaaaaccctagactgactcgttttgaaaaatctcacttaaacgagcgaccaagatttttcccttgaaccacaagaacagatccccattttcccggaacaaaaccaattgcaaagaacatatgcaatgacaaggattcagagggctcttaggtttttccatttggcttgtcctacggtcaaggtcggctctgataccaacttgtcacgcccagaaattcccgaatagaattccaagcagaatgtgcaataaaatccccgtccaggaccagccggggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcctcggagaacccttcatctggtccgaactcaaactctggggttgggaaaagtagagcaagactgagtactacccactgtactcagcaagtcataccggaatagaggtatgatgcagggaatcatcaaagaaaagctaaagtggttcctttgcataaagcgagcatttataaacagagatttcaagatttaaccagttgtaataagtaattaagcagtattaatcatccactgt

SEQ ID NO: 20880 - DNA, 628 bp, Oryza sativa
ccgaaactccttcatcagtttttggcacttctcattataaactacaacgtatcattcttacactcatattctcatgccaactgactgattactaacaaagaatcccccatgatttcaacagcatcggcttcaacctccttgagcaattgcaaccctttaagtactgcctcatactcagccttattattagtcgcataaggtttgatagtataagcaaactcaaaacatgccccccgaggcgaaattatcctttgtgtagacgttcgaatcctccacgacgccctcaaaataatagcttgggttctccatcttcaattggctgtatatcagaatcggatacttttaaaaaatctccatcccaaacttttccagataaacaatcaaggccatccatctcccaaagagctaaatcggcacaagcaacattgactgacctgtcggctggtacgatctctatcttgttgccttgccattgaatcaagcattggtgcatggtcgaaggaatacaacaattagcatgaatccaatcccttccaagcaacaagctataagaacccttcccatcgatgacaaagaatgttgtagggatggttttactgccgactgtcaactccacgttcagaacccc

SEQ ID NO: 20881 - DNA, 660 bp, Oryza sativa
gcaggaaaggctattgcaatgctacggaaggacgacagttgccattggaattatgcaaggaatttgaaagattaaatttgggaattgtcagtagaggtttcgttgcagccttagaagcgaagcccactctaattgatcaagttagagaagcccaaattaatgatcatgatattcaagaaatcaagaagaatatgagaagaggaaaagctattggtttcttggaagatgagcaaggaactgtatggttgggtgagagaatctgcgtccccaacaacaaagatttaaaagatgcaattctgaaagaagctcatgatactttatactccattcaccctggtagtaccaagatgtaccaggatctcaaggaaagattttggtgggcatgtatgaagcgtgaaatcgcagaatatgtagcagtatgtgatgtttgtcagcgagtcaaggcagaacatcagaaacccgccggtttgttgcagcctttgaagattcctgaatggaaatgggaagaaatcggtatggattttatcactggtttacccagaacatcatcgggccatgactctatttgggtgatagtcgacagacttaccaaagtggctcatttcatcctagtaaagacaacatattccgggagtcggttggcggaattgtatatggcaa

SEQ ID NO: 20882 - DNA, 357 bp, Oryza sativa
caactggcgcagccgcggcggcaggtgatcgggatcatcggcgacggctcggccaactacggcatcaccgcgctctggagcgccgcgcaataccgcgtgccggcggtgttcatcatcctcaagaacggtacctacggcgccctgcgctggttcgccggggtgctcgaggtgcccgatgcgccggggctcgacgtgcccggcctggacttctgcgcgatcgcccgcggctatggcgtcgaggcgctccacgcggccacccgcgaagagctggaaggtgccttgaagcatgccctggccgctgatcgcccggttttgatcgaggtgccgacgcaaaccatcgaaccctgatgttccacg

SEQ ID NO: 20883 - DNA, 1120 bp, Oryza sativa
tgggaggctcaggtcgaggttcacacacgagttccttcagagtcagactacagcttcctgacatgccaccgtcgtgacttaccgaagaccgcgatgcaggatgcagcccgggaggccttcctccgacttagctctatccaccgagctgagttggcgagtactgagtttgctcaccacccgtttcgagaggagagcaactccgtctgcacggctcaggacacaccttgctgctacaacccgatagtgactcgactgtcacgatgggctgaggcagtagacgacttttacgaggaggctctgttagagatcaacgaccagcagaggcgtgtgggagagttagagaccgaggtgactgacctcacagtgcagcagcttcagctagaggaggagcaccaggcttggggtagtaagatagactcaatgaaggcatagctccaggtccacggcgaccggttccagcagttatctaaccagtacaatgatcgccgcgggatgatggatacacttgaggagcaggtgagagagagtcaggagcacgtcagccagctggaggagcagcttcgagcagccacggtcagcaccacaggagcttctacttccacagcagtagggtatgaccgctactccttcctcaccacaccgtacccaccagcgttccacactcttttgggagaggttggtatgctggctactgagtcagcaccttacttggtggacccgacagtgacacagccacctgccccggagattgtgcacactccactgatccctacaccttctccgcagctaggttcgagtttggagactccgatccaggtcgactccgagacagaggggaccgacaccgagcagagatcgagccagacatcactgatccttcagaggatgagacccctgttccccgcatcaccttcctcggacgccctcacaccctcagcactgcccgcaagagcacacgacccccgggcaagaagcccaagccagatccagaggccactacttctgagccgtggggactcaggtttgcctgtgccagcgaccaccctctacctgccccaggatcctgcggatggttggatgactagactggaggattattgcagcttcgatctcgctttag

SEQ ID NO: 20884 - DNA, 3190 bp, Oryza sativa
aaagtgatcttcgtagtaaaccaactggagggacccgctggtgattggtgggatacttacaaggaagctcgggaagaggatgctggagaacccactgggaagagttcactgcagcatttcatgagaacttcgtgcctgctgcggtaatgcgtatgaagaagaacgagtttagaaggctgcaacaagggaacacaacggtgcaggaatatctaaaccgattcactcagttggcccgctatgcaattggagacctcgcaaatgaagaagaaaagatcgacaagttcatagaagggctgaatgatgagttgcgtggacctatgattgggcaagatcatgagagtttccggagcctaatcaacaaggtcgttaggctggagaacgatcaaaggactgtagggcacaaccgcaagaggaggcttgctatgaattgcccacctcagggagtgcctcagcgacacaagggagccacttcgtctgggtggaagccccctattgtggcaaccaaccgccccgccgcacctagaaatttcaacaggccggttgcgattcagaatcgcacccctacaccaactctggctgcccctggagccaagaagaatgtggactgcttcaattgcggggagtatgggcactacgccaacaactgccctcatccacgcaaaactcctgtccatactggcgctaatgcaatgactgttagtggaactactgcccctgctgccggacgaggactattcaagactccgcaaactaacaggaccgctaccagatttggacgcggacaagtgaaccatgttcgagctgaagaggcctaggaagatcagggcgtactaatgggtatgttctctatcaattctaccccggttaaagtcctctttgattctggtgcatcgcattcattcatatctttgaaggctagtcaaaaacacaacttaaccctagtgggacttagaaagcctatgatagtacactcacctgggggcgagataactgtgagtcatgcttgcatagacgtacctattcatcttagggatgtggtgtttccctccaaccttatggttttgataccccagaccgtgggtgtcatattgggtatggattggttaacaaagaacagaggggtaatcgactgtagacgtagggaagttaccttgaccacaccctggggatcggatatgagagcaaccatggatcaagatcctagactaaccgaacatgccggaggcatatttaccatgctacccctgaaaggaatgcctgtagtgcaacgatttcccgatctgtttctagaagatttacctgggatgccaccagatcgtgacatagagttcattattgatctgatacccggaactgctcccatatccaagagaccttatcggatgccagtcaatgagttggaggaacttaaaaagcaaatcagagaattgcaagaaaagggatttgtacgccccagttcgtcaccttggggagccccagtgctattcgtcaagaagaaagatggtagcatgaggatgtgtgtagactaccgttcactaaacgaagtaactatcaagaacaagtatccactaccatggattgatgatctttttgatcaactcaaaggagctaaggtgttctctaagattgaccttcgatcaggataccaccaattgaaaattaggaccggggatatacccaagaccgcgttttcaacacgctatggattgtatgagttcacagtaatgtcgtttgggttaaccaacgccccggcatactttatgaatcttatgaacaaagtgttcatggattacttggacaaatttgtggtagtattcattgatgatattctaatctactccaaagatgaggacgaacatgcggaacacttgcgattggtactcgagaaacttcggaagcataaattatatgcaaagtttagtaaatgtgagttctggttaaaagaagtcgcttttctaggccacgtaatctcagccggtggagtagcaatggatcctgctaaagttgaggccgttacggaatggaaagcacccaaatttgtgactgaaattcggagttttataggcttagccggatactaccgaaggtttattgaaggattctctaagatagcccgaccaatgacacaactactcaagaaggaaaagaagtttgtgtggttagaacagtgtcaggaaagctttgagcagctcaaagaaaagctgacctcgtcgcctattttagttcttccggacatctggaaagactttgttatatattgtgatgcatcaaggcagggactaggaggagtactgatgcaggacggaaaggttgtggcctatgcatcacgacaattgcgaccacatgaggaaaactaccctacccatgacctagaactcgcagctgtggttcatgcgctaaatatttggagacactatttgattggaaaccattgcgatatctacactgaccacaagagtctgaagtatattttcacccagtcagatctcaacttgaggcaaaggcgatggctggaattaatcaaggactatgatctagaggttcactatcaccccggcaaggccaacgttgtggccgacgctttgagtcggaagagccattgcaatcatctgaggacggaagggatggctcctgagcttaaggaggaaatagcccaactaaacctacatatggtacctcatggacagataaacaacctggacattcaacctcttttgagaacccaaatagaagaggcccagaaggacaacgaggaaatccgagaggtgaaggaacgtctagttgcaggatttgcaaaggaattttcaaccgacgagaaggatgtcctatggtataaaaagaggatttatgtacctgaacagggtggactgagaggattaattctaaaggaagctcacaaatcagcatattcattacaccccggaagtacgaagatgtaccaggatctgaaggaaggatactggtggcccaacatgaagagagatgtggcagaatacgtagcactctgtgacgtgtgccaaaaggtgaaggctgagcatcagcgaccggcaggtttgctgcaaccccttatgattcccgagtggaaatgggatgagataggtatggattttattgttggattgcccaagaccgcaacagggtacgattccatctgggtgattgtggatcgactcaccgagacggcaagatt

SEQ ID NO: 20885 - DNA, 7204 bp, Oryza sativa
tttctccgatgaggggaacgaaaaggtttaaggtcaaaggaaaactagcgccaagatatgtgagaccttttcaaatcacggctagacgaggagaagttgcataccagttacagctaccagaaaatatcgccgatgtgcacccagtctttcatgtgtctcagttaaagaagtgcttgcgagtgccggaagaacaagctacgttggaagaaattcatatcagcaatgatctcacgtatccagaacacctagtccggatattggatgaagctaaaaagaagactagaaccaaagtgtggcgtatgtacaaagtacaatggagtaatcacactgaggatgaagccacttgggaaagcgaagaattcttgaagacagaatacccccacctattcgaaaacctgtaagaaatctcgggacgagatttatttaagggggtaggtttgtaacaccctgaaaatttgaccaataaaaacaaaactctaaaaatacgggccttcgaaaacttttaaattaattgcatcatgccgatcttattcgcctattttatttggatttgatttcgaagttcattaatcgtgagtaaagaatagttaattaggaataaaccctagaagtaaattggtaaaataaatataacttaaaataaagattaggtgtggatagaaataaataaaatattatcacgatcatatttgtatcaattaaatttaaatgcgatggaataagaattaaccctaattaaaaattcaaataaattatataaataaaatatgagtaatattaatctagggtgaattcattagttgagataacacaaatattgagaaaaattcatatatgcaaaaattagaaattgtggaaccaaatttatataagaaatagactaaaatgagaaaaataggaaaaagacactgttcattgcactctaggtgctcgatgtggttctgtagccctgcccctcctccatcgcctgtccctagccgccccgagccgtgccgacgtcaccatcgccgcctgccgtcgcgtcaccgtcatgtgcattgttgctgtggtggcttgttgagtacgattggtactcacccttgcaatatacaaacttaatcagtggtcggagatgaagcttcggaggatccctatgcttactaccaggatggtgatgaagacgatggcgctcagtaggtcttagttacggtcgttgcctgtggcaatggcgtgccgctgccttaactccgctgccttacctacttctgtttttggaatgtattccggaccacttggtccgatgatttaagactatgcctgcgggcttatgatgtaataattcgttctagacactcgtgtatgtgcacttggtatttcagctatgaattcgtgtgtaccagactacttgatccagggaaatggtactgtttacacgattgatttctgttataaaaacgggggtccacacttacccaatcggtgcccaaccgtatcattacagataacgacacccagttcaccagtgaacttttcggcgactattgcgacgacatgggcatcaagctgtgctttgcctcgcctacccaccccaagagcaacggccaagtcgagcgagccaacgccgaaatcttcaaaggactcaagaccaagacgtacaacgtcctgaagaagcacggggattcatggctcgaggaactgcccgccgtgctgtgggcgaatcggaccactcgaagtcgcgccccgggggaaacaccctttttcctggtgcatggcaccgaggcggtcctaccttcggagctttccctgggtttgccacgcgtcacgctgtacgatgaggccaaccaggatgatctttgccacgacgacctcgactatttagaagagcggagaaggtgcgcggccctgcgagcggtgcgctaccagcaaagcctgtggcgctaccatcagcgccacgtccgggcccgatcactgcaagtcggcgatctcgtcttgcgccgcgtacagtcgcgcttggggctgagcaagctctcatcaatgtgggaagggccatacaaagtgatcggcgttccccagctgggctccgttcggctaaccacggaggacggcacggcgttgcctaacccctagaatatcaaacacctccgccgtttctatccatagagtcgcgcgtcttttgctttcttggaactcaggccaagccccacgctaccactgttaaatatgttgtatcttttgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcagaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagcaaacagcattaaaagacacttagttgctcaaagctattttgtaaacacgattccagagctatacaatattattaatcaaggccgtgaacccacatgaaccagccttaacccaaggcctacgatgattcagaccgaactggcgacccgaccatgggtcccagctcgtcccaagccaacccaggccaaccattccatattttaattgttaagcaagttttaagaattaaaacactaacttgggtacattgctcggcttgcccataactgagggcgcggctattcgaatagattatactctgatcagaggtgtacatctgtcacgcccggaatttctatccaaaattccaaacgcttacatgtgtgtgaaccctcgtcgaggaatcagccgaggcacacaataacaaattgataatagagtacaattattactctaattaataagcgaataaaatgtcattacagaggtagatagtttctctcaaacaataaagatctaagcagcggaaaaaaaagataaacggcgcagacggctccactccacaggcagcttgaccaaggctacacctaatcctccacaccatcagcctcattgaagaactcctcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtattaaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgacaagtgtgaaactaatcacgaaagacattgttagacccgctcataaccgcgggcacggctattcgaatagttttactctgatcagaggtgtaccactgtacccacaagacacaaccccacatcatgtcaccatgtgcctcaatacaaccacggtatctcggaaaggagttgtgacaataccccttatacaacacaatccactgcagcgcaccttcctggatcataatcacccccttataaacaaggcatggctaaaagggcatataaacttttcccaaatatccatttaaagagcatataaacttcaaatggccataacttgtccatttgaactcggaattggaccgttcaagtctctaatttttccttaagaagtcaagaacccatttttgtgctttgtttctgcttgttatatggagtttattagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattaccgctttatttaaattcccgcgttatcactgttttatctagccatgcctatttacctttgttatgaccttattattgttattgttattattaccttgttcaccctagaataaacaaaacctcaactagtggacactttactcatggtaccactagtatgaatttaggtagatgcttcgctggttagttaggcaacattaggtggttttacaactctagactatgggaatattctcatcacctggacactacggaatggttggattattgtggaattggattcatacctccccctctattcaatatcctcaaaatggttttaggctgggcttggggtccctggttttgatagtagcacctcggccatataaggatcagtcttcgggcctctgttgcaaagcactaccgtacttccacatgtctagtgggtaatgcttagtttgtggctcagtctggttacaaacaaaagtacatggatggagatggacgaagtcgggggtcgatggacatctctaggacaaatgacggctacacgagctgcggcccggtagtcgagatgtcatggcacagggctggtgtcctgctgctaggggctcagtcctgcctgcctgtccggggggttccggccgtaggtgggattgggtcggtactcttgtctatggctaggatgggttggaaactatgtcacgtcttccgtctgtataccgtggtggtatgtggcacgtggtcgcacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccatgataaataatatggtatagttctagaatcgtgtttacaaaatagctttgagcaactaagtacctttaaatgctgtttactgcaaaccctaaccctttatagtataactcctttgtactcccttgcatttattctgcacttgtgggtgtgtcttgttgagtacggtggttgtactcagtcttgctcaatttttcccaaccccagaagaggagcccctagaagatgaaggctttggtgtctagctcgtgcctgccgtcaagcgcctgtggtcgtcgtcctagtcttccgctgtttctcgtttgtctctgtgtgtgctgggccttcgctgcccatgtaataaattaactatttacgcttccgcttgttaaactctgaattgtattaacttttggtgtaccttgcctcctgggacaaggaataatacacgcacgtaaggaacacccgttgggttatttccggtcgtgacatgagcccacaccacaacaatctcaagcaacacctcagcagcgaccatgggctgatgtgataggtgatgtaatgagggagcaatttgggcttaaaccaaaggagactggaaatttgtaccgacaaccatatcctgaatggtttgaaagagttcctttacctaactggttcaaagtacctgatttctcaaagttttcaggacaagacactacatcgacttatgagcacattagccgatttttagctcagtgtggtgaggcatcggctgtagatgctttgagggttaggttattccggttgtcattggctgggttggcttttacttggttttcttcgctgccacatgggtcgattaacagttgggccgatttagaaaagcagtttcatagttatttctatagtaggattcacgagatgaaactgtctgatctcatgtcaatcaagcaaaagcatgatgagccggtacatgagtatattcaaaggttcagggaaatgaggaataagtgttacagcttgagcttgactgatgcccagttagccgatttggctttttaagggatgattgctccgatcaaggaaaaattctcatctgaagattccgaaagcttgtcgtaccttacacagaaggtaggtttgcatgaacaaaggttcgcggaagctaggaagaactctaggaagattaatcatgtttatccttatatgtatggatcggatggtgaggatgatgattctgaaatagctgcagctgagtgggttaggagcaaaaaggttataccttaccaatgggtgaaaaactcaggaaaagaggagaggtatgactttgacataactaaggctgataagatatttgatttgctagttcgagaaaaacagattcaacttcctgctggacatacaattccatcggctgaagagttgggcaaaaagaggtattgtaagtggcataattctgggtctcatacgactaatgactgcaaggtcttcaggcagcagatccaaacggatattgagggaggaaaaatcaagtttgatgattcgaagaggccaatgaaggtcgatggtaatccttttcctgttaatatggtacatacagctggccaatcagccgatagcgtccgtgcaaagggttttcaagtgaattcggctaagataatcaacaaatatcagaggaagtatgagaagcagcaggagaagcattatgaagaacacgatgatggttttgatcctcattggggttgtgagttctttagattctgctggaatgaagggatgaggttgccgtctatcgaaaactaccttgggtgcaatgatatcattgagagctcaagtcagtcatataataggagtaatcggctgaggcaggaaagagtgtctgttcgtcaaagattgggcccagtgaatcaaggtcgtggccaggaggatgacgtagtcaggacaaatcaatggtgtccttctagtattttcatgaagaatcagaagagaagggttcaaagattgaggaacagggagcgccttcaggaggttgaacaagaaattaaccatcggctgaagaaagcaaaaccaagacaggaattgcgtgttaagaatcagattcctatagccgatgatgtgtagccga

SEQ ID NO: 20886 - DNA, 1780 bp, Oryza sativa
ttcccaagaaaattgtatctgatcagggaagccagttcacctgtcatttctggaagaaactccaagaagagttgggtcccgattaaatttcagcaccgcgtatcacccgcagacagatggacagaccgagcgtctgaaccagatcctcgaagatatgcttcacgcatgtgtcctagattttgggaagacctggggtaagagtctcccttatgccgagttctcctacaataacagctaccaagccagcatacaaatggcaccctatgaagcgcgttgtatggccgcaaatgccggacaccgctattgtgggaccaagttggggaaagccaagtgttcgggaccgatatactgagagaagctgaagctaaagtcagaaccattcgggataatctaaaggtggcacagtctcggcagaagagttatgcagacaaccgacgtcgtaacctggaattcgcagtggatgattttgtgtaccttcgggtcacgccattgcgaggcgtacacaggtttcagataaaagggaagctcgcaactcggttcgtgggtcctttccgtatcattgctcgacgcggagaagtcgcttaccagttggagctgcccgcatccttgggcaacgtgcaagatgtgttccatgtgtcgcaactcaagaaatgccttcgagtgccatccgagcaggccgattcagagtaaattgaagttcgcgaagacttgacctacgtggagaggctagtgaaaatcctggacaccatggagcgcaggaccaggaaccgggtaatccgtttttgcaaggtccaatggagcaaccacgctgaggaagaagctacttgggagcgtgaagacgagctgaaggcagtccatcccgatctcttcgccggttcttctgaatctcggggttgagattccgtttaaggggggtaggtttgtcatgtcccaaaacgaccctaaaatatatcctttaaattatgcctagaataattaaaatccatgtgaaagcctccaaaaattaaaatgtgcaaagtaaaagtcaaacaaggcttagaggatttttgtatatttcctaaaagcctaaaatgcgtaaataaattttagtggaattttcagagcacaaataataattattaagaaataaacaaagttgaaaaagttttataaaaagaaaaaccccaaaagtaccccttccctcacttgggccggcccggcccatctctttcccccctctctctctcctctcccccgcgggccattcggcctcccaccccgcgcgccgccgccgccgccaaatccgccgaatcccgccatccccgcgtgcaataaagtggggggaaatactccccgtgatcccctctccctttccccccatttttccctctctctctcgtgttcaaacgggtggatttgcccccgcaaatctcgctggcgccattgacggcggccgacctcccacgccggtttccttcctccctggccgctctctcccccttccaaccctatttaaaccctccccgcacctcctccgtccggttccacctctcgccgcccttcctcctcgccggattcgagctcgcgacgtcgctctctctccgccgtcgccgccgagctccggtccaccaccgtcgtcgccccggaccgcctcccacctcggcgccgcctccttcggcttcaccgcatcctcgccgacctcgttcacctctctgtttcggtcgccgatagccggagcgccgccgtccccgtcgaccccaggcgcgccaccgcctacctccgctccggccgcctcctccgt

SEQ ID NO: 20887 - DNA, 4808 bp, Oryza sativa
  unsure (1)..(4808): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccagatctagaagaggaagctgtagggttaacgcacgcaaagcaaattcgagacgaaagcgggtgggggagagagagagaggatttggatgctcaccaggatgcaggaacccctcccctgctccggtcgcgagattgaggatcggcgccctgctctgccctcctcgcgagatggagatcagcgctggcgcatggagcggagacgagacgggagtttttcttctttttttttttcttggcacgcgacgggagtttttcttttctttccttttttttatttacgcataagggacagcgacgaaagatttcctttttatattttaaaaaaaagtctgtgtattgcaacgggtgaatgctattttaatcttattattgttgtacggtttagctaagatgaaattcactttgggaatttgcttagattttttttagaaaatcatgaacatcaattagtagtccaactttcatatcaagtaagcatgcggattttttaaagggatttcttatatgactccttttatattttcaaaagcaaacgaatttaaaatccgactcaaacacgaatgatgtaccaaaatattaacaaaaacatcttcaaattttataatagtagagatactaatgtaatactatctcatccgaattaatatctaaagtgtttgttttttggatgtaggaagtaaataaattataggtttgtctaaactattgcttattgcttatgtttggtaggcttggctacggtgcaactgtagccagccgctacagtccctgtgtgtttgttacaaacttatagtgcccgctaaaaatgttacgtacagcgtgacggtggtcaagcctactaaacagcacattattatgtactccctttatctaaaaatatagcaacctataattgattcatagtaataaaatatgtctcatcgggtactaggttactacattttataacggaggtagtaggtgttattttgaacaaccttatttcaaacttttcatttaaaaccaactgttctttataatttggactaggggcccacctttcggtggaattcggttggggatgggtgcagacaacaaactcctccgccacggatgccagcgacacccactggctaccactcttcacatccacgcaccaccaccgccgctccttctccatgagccatcgtcattcctcctctgcacccaatcgcacacattagccaccgacatgtcttctcttgcctcccatcgtaatgcacgcggctattatagtcattgttgagatcggtagcaccgggctagtgaggatttagagaggcaggaactgacctagtggagagtggggacgctgattcatgatcctctttattggattcaatggttcccccagttgctggagagaagaaagaaagatgagagatagctagtgtgtggagcgatgacagtcattggacttaggtggatggattagatgagggtggtctaagttgaaataaaatgtaaagttagctggtgttaagtaaaaagaatggttgaagaatggtctaatttgaaaacttgtaagaatacctagcccaaatagcaatttacacttttttttcagcacaactaaagggcatgttcaatttgatgcatttttaaccataccattttttagtaaagttgtcaaaaaaaatgtctacatttagtttgttgtcaaatttggttaatacataagaaatcatgtcaaaattttagcaatattggcatcttgccaaagttttggtaatattggcatcttgctaaaattttggcattgcaaaacttggtaaggtttattttggctacaatctgaacaggcccaaaattgggttgtccatgagccgacgggcccatgctttgctataccaactatagttttatcgtgtctagatggcatggttgggctagcctatttaaacagaatccaccaaatcccacctccgaaaatcaacgtcggcataccgcttcttgcatagaatgccatcatcctcaaccctaaggaacccaatcgcgcgaccacaaatccaacatccctacaacaatccaatacccaaatcgcaccacgcgctgcaagaaatcggtggaaacgaaatatggtggggagggggggagaagagaggaaatgaaggggaggataatttttacccaaggtacaactttagtgcgactccggagcatagtaaaaaaagagatcggcccgacggttgaaccgggaaaaaccagaaccagtccctagcatggttcaatttgtagaaaagatcgtctatgcatatgaaccagcgaaaaccggttagaccggatggttttatggtgaaccgtcttaaaaaccaaagcgagtcatatcgtaaactgtactagctacatagaaaaaaaattaaattcttggttgggcaattaagagtcaaccccaaaccttttgagaaaggatctgcatgcctatagagtatctccaacatgttatctaaatttgactctttacatgttcatttggccaacttgccaaaaatttggagagccaaatttatctttcaattcaacatgctctccatcatagcaatgggacccacttgtcagtgtctatctccttctcccttcttttctctgcacaatgctcccctcctcattcctcccacctaccaccgccgatagaggcggcgaacattgaaaccgctattccctcatcgattcctacgtgtcgatagcaggcgagcggatctgacggcggcagaggtgtcggtgaaaaacagtggtgacgaaaatgggcagtgacgacgaaaattggcgatggcgatggcaacattggaagggctagagatggggacgggggcacagggaggagctgcgtcaaggaggaggggcggcagaacaaccgtcgagccgccatcgttgtgccctgttcgtcgattcaaatcccatcgtgggggaaggattaggatgagaggcggcgacgcttgtcagctctgtccggtggggttgctattgaggaaaaggaggtggggtcgctgccgctaccattgcacccctctccaccgatcgacggacgcggtggacagagaggagaggcggctccgatgactgcataattgtggcggtggtggcggcggtggggggaggaggatctgaatatgtgacccacctttggcaagccaagaaggcttgctagatttagccagtcggggggttgatttggcaagcaggacgacaaaatctgttggagggtgttttttctcttcacttactaaattttagcttggagagtcaaatggccactctcttggagatgctgctcccacctaaccaactatgcaagaggatcttgtaggtgaggatagaaaaaactactttgagagtggattacaacttaaaaaataattaacaataaatcggcggttcgactggtggaccgatgaaccgacatgctcaccaggtgagtccctggtccatgtttttccaccaagttctggaggcctcatccacaatcttgctcatgggcgtcactaggcccggcgacatccggatgatagtagggtacactagccagtggaggtcacctggcggtgtacctgtctctagcagatatttaaaaattaaataaataaaacgccattttggagtgttacagttcaaacgcaatttaggcccggacagttcaatgtggcattactcctatggtagaacaacatcatggttttcactaagcaagtaaaatgcccgttctttcttttctttctaactcacaaaggaacttggcttttatttaagcctccttgaagcaaaggtcttctgaaggattttcataagaattgaactaaccccatgaaaatcctgtaaaattcatgagttccaaaggagccttctcatgacgaaatacaggatagacaaataaaaaatgaagagtgaccaataaaacatagtcatcttcattttacaagggcaatgcttggttggatagaatagagcaaaactatatgacaggctctagaccgtttcacacaaccaaacgcatcatcaaggaaaagaatgcacgaaatttgaaagctagtcagcatcatcagtaaataagattgggtcaataggttcacattttctcatgttgagattcaattcatggagaatcctacaagccccatgaaattcagggcaagaatcatccccgaagatgaaccgatgcacccgtcctcccacctcaacacaactctctcccgcaaccttcttcatccctccttccctcatcaccctccttgccttcgctgcctcgtcccatgatccaatttcgcagtagatgtttgaaaccatgacgtagttcccgcttctccggggctctagctccagcagtttgccctgcaccttgtcaatgatctcaatacagtccttggagctatgcagctggcaggctgccaataatgtcctccacacaactgggtcagcctcgactggcattcctacaacaaagtcataagcttcctggagaagaccgttgcggcctaggacatcaaccatggcgctgtagtgcgtcatcatcggcacaataccataaacatgctgcatttcgtggaagaaccggcgcccctcatcaaccaggccagcatggctacatgcacaaagcag

SEQ ID NO: 20888 - DNA, 2058 bp, Oryza sativa
cgcggaggcgaggccgtccttgacggcctccgagtgcacggatccgacaacggggagggatcccggggcgaggcgcgcgagcgccttgaggacgtgcgggagcgtgtgcgcgtcggggcggagacccccgcggcggaggcgaaggaagagggcggcggcggtggaggggtccggcgaggaggcgagcgggggaaggaggaggttgaagaggtcgagggatggggaggggagggagaggaggagacggtgggcgaggtggaggtggggattgggcagcgaaatgaggcggcggaggaggacggggccgagggaggggaagcggccggaggtgaggagatgggcgtggatctgccggagatgggggacggtggtggcgccgccgccgccggcgatgagggcgtggaggtggagagcggccattccatggaggttgcgcggcggcgcgcgacggccgacggcgatttggtcgtgggggaaagcacacgctgcggttgctgttgggcctaacgggcccggcccgctcgatacttgcatctgcatcttttggaaaaagtacagcgaaggtccctcaacttgtcatcaagttacaaaatcgtccttgaactgcaaaaccggatatgacgtatcccccaacttataaaaccagtgtaaaataggtcccttggcagtttaacttcggttttatccgatgtggtagctgaatcagcgtgggacccacgtgtcagcctcttcttcccctcccctctccacctctcttcctctctccttccctctccacgggcagcgcccggcgaagaggagctaggcgcgggcgcgcggcaggccagtgcggcgggcgcgagcaacggccgacgggagaggagttgggccacggggtagcgggtgctcatcaggcggaggacgtcgatcgatggggatggccgcgccatggcctccttggctatggcggtccccatgaggccacaaacgacgatgactagaagggtagaacctgggaggaggtcgagcgcgggtctcctcaagcgatggcggcaggggctcctctctctctctcttcctctcgttcccttcaagcccatgacttcctcggcaagctcctccagccaccagccctcgacgggcacggcagcggtctcaatgggtggactcggcggagggtgtggtgtggacactgctcactctcctccacggacggggattgtggcggcgagcggggtggaattgaaggcccttcaaagcttgtttggtaactcgagggaaggggattgagagtttacacgagagaattgataatgagattaagatgggaatttgatttttaatcccaatatcttgtttggtagaggttatggaaattgatagggagtttagttggagattagatcattaataaaaatggatgactgagatttgcttagattaagtaaaggaggaattccctcccaattacctgctcctacccacgtattgaaaaggagggagttccttcctcaattccccatccccatccccatcccaccaaaattcccatgtctcccaaccaaacaaaacacttaatagcctcatccctctaaactcccaatccctcctaaaaactccctccaaccaaactataggcgatgtgtttggtgggtcaactaggcggaggagacgatggggaagagaggaagggatggccaccaccttcccgcgcgctgatccgccgcccgccggtcgcgcccagctgctccccccgccgcctgcgcctgcccacgcgctgctctgccgcgcccagctgctcccccaccggccaccacccatgcagctgctcacccgccgccgctcgtggagaagagaggtgagaggaagagaggtagagatgggaggggaagaacaggctgacgtgtggggcccacgtgggttccacgctgagtcagctaccacatctgacaaaaccggggtcaaaaccaccgagggatataatttgcactggttttgtaaattgggggatacgtcatatccgattttaccactggtagagaaaccatctttggtcggtcgacccatatccataatagt

SEQ ID NO: 20889 - DNA, 12921 bp, Oryza sativa
attcctgcagcccaacaccaaccgggactaaagattgatttttagtcccggttatttgaaccgggactaaagatagcgatctttagtcccggattcttagtcccggttgaaaaaccgggactacaggggggttacgaaccgggactaaaaagcatttctccaccaatgtacggttcaaagatgattttgtaactcgatgataagttgagtgaccttcagcgtactttttctgcattttttttgtcacgttaggtgatgaacatgggccctatttttctattctcaataattaataatcctgaaactgaataagtggtaattacttgtactttctccgtttaatctggattcattaacatcaatatgaatatgagaaatgctagaatgacttacattgtgaaatggagggagtagttgctaagatttcgtaaaatataaggtggacgctgtagccaaaagcgtccagctgcggatgctgttgcggagtggtgcgagctagctgctgccagcgtgctcgccggccggtgagcccatacgaaccagatctgaggatgttgttgcatgaatgcctttatactgctgttgaattgttgatgattactcgactcaaaagaatccaatctagttcaaatccgttgtattaattgtgttccatccaagtgctaggttagattttttgaaacagagggagtatgatgctagctattgctgtccgtgttttgtttgctgttgatgcatgcatgctagtgctgttgttgatgaatccgaggaaaaaaaatcatttctaaaccattctatttatgtcggtggaacggcttttatgcggttaattttctttttcttttgaaaaaaaaatattttttagccgggtgacataaggacaccgcttatgaaaaacctatttccacatgcggccgtcttcatctatccgtttgcaaaaatagctttttctaggtgagcggccatcctcctgtgaagatataatattttcgcatgcctttgcttacaagcggcgtgtgtgaccacctgcaaagagcaattttggccgcctgcgaaaattgcttttctagtagtaacaatagcaaaagggagactccaaattgtatttggatctaccaaaattaaccctttcattcattattgagtactctctccgtcccattttaagtgcaaccataagtttccgcgtctaactttgaccgtccgtattatttaaaatttttttagaattagtattattattattattatgagatgataaaacacgaatattactttatacgtaacttatgtttttaaattttttcaaaaaaatttcaaataaaacagactgtcaaagttgtgcacggaaaatcatgtctgcacttaaaatgggaaaagggagtagtaatttaaggttatatttatgaatttatgataaaaaagtatgctattaaaaatatgtactcagtataggtaaaatgcgctactaataatacaaataaaatatcatttccagtatgatgtctaattaagatgaatgaacaatgtttttttttcaaaaaaaacttatgtactttctttaaagtaaaggtacacaacgtacatgagagaggaagtcgacacatataacttccagattgtagaaaagaccctaagaaatgggcaaattaaccttataacacaaaatatgtaaaagaggacttaaaaaacttaaaaagcaatcggatcctactttttccacaggaacggcgagccatcttgtgccgacgtcgatggggaggatgattccatggcgagctgcaaaggagagagccgaggagcaaacccagtcggggcctccgcagtggaggttgaagctaccttggccaaacaagaaaaccacagctgcccccagaagacgaaaaaccgaataccaaggaaagaacaccgttcttctgtgttggtcaccagagaaaagttggacggccgacataacctctttgcatgcaaatctggtgaacttgaagccgcagacaccgaagagtagggcgtctagtacttacccaatgagtaccgttggaatagagagtacaggaataagtttcaacaactccatccatggctaagcacctccaggacgaagaaggacgacacaacttcctccattgaactacacaaactacggaaaaaacccgacactgggacaagcccaaccgctccctggaccctcccccctcccccatcccctccctagcgacccacggtcatcggagacagagaaagaattggagagctctcttgcactgttcaaacgaggagagagaaagaaaggataagaatgagcctctgatcccccaacactactcagatgaaagaacagttgatcctatattcagtctctttggaagaagtatatatatgactagttaagctagagttcacatacccaaactaactcaaataaatacgaggccttggcaatataattcaccttttgttacacgtgatcgttgccacctgtgctgactcacagccacatctcatacataagctatgtcacaagactcagactaccaatcaagaggttttgcaaaatcgtcatgaagggaagggcacatgcacatgagactgcatgagtaagatataagcacacactttgatataggtgatatatatgaatcctagctagctagctagctgctcagctccaacccggtggcttgtggtggttgtttgggcctgagggtgcatagtcctgtgtctccaaagccatcctcgcattgatcatggcgtcctcctctagggcaacaactggtctctccatttccatctgaaagagatatcattgatgaaaacgaacaattctatgctgtgtatagtaaagtaagtgtttttctgacttccatgtgatatgaatccaccatctctcttgatatataactcaatacggagtggttctctcaagttggctatgggttgggccataacaacgatatctaggaaagtgataaggttgtagattgagtacttgtgtacctaggtccttcgacgcaaattgatgcatctctaattcaacagtacatatcttggggatatcaatcatgctaactatccacctttttaacatgggaatctttgaaaaactattcctatacacaattcttgcactagcaacaggttatgaaccactaatccttttcttcactggagaacaaattttgatgtacgaaaaacgtgtaacaaacatctaagaaaattttgaattatgcaagatgctctgcgtcggtttataggattcctctcatgagctcttatatatgcatgcatataaaaaacccagggaaattaagataaaaggatggaaacaatgtgtccttaagaatgagaagataatattatattatttaaaatacctttggctttgctgtgctgcctctgactaatggcatctcactggactcttgcaagtgcagcctttgcactcctgcaatcaaaagggatgtgaatgaacaggttgatcttacatgctagaacaacaaaaccaaatggatcaaggaatcaaggaaggcaatgagtgtgattctgaactcacttgagagaggtatagcattggaaggaacaatcaagaagtagaatgccaacaaggtgataagaagatagtagagtggtagtgctggtgatttccccattgtatgcatgcactatagaaggctgttgagcagcactatctcaagttctcaatggaatggaatctctgctggcttcatgtgcccttgcactacttcttggtcatgccctcaacccctttttattgcacatgtcatgcaacctagatcattcatttaggagccaaagtcaaaaaggcaaggtggagattcacaaagtctaatcagtggaatttggcactagcccaacctttctctgcctttcttccccgtccactagttgatgaagtgcttctattagtccatatctcatattgctgtatttggtcatggcatgccatttgttgaatgaggagagagtgagagatggtgtagtttctattaaaagaagactaattagtaagtcatatgtaagtagctacttcatgggtatcttgtgttttcagaggtgtttgcttaatttgaaggaaaaattgtcaccatcttaatttcattttacacattaatataactagatatatttatcaaaatccaccgacttggtctaaacaaagaaaaaattaaaatccttaattactccatcacgttgttaatatttttgcggtgaaattcaatgtagcaacaagtcctgaacaagaaaagctatttccagcctctatgtcaaaacaaagtgccatacacgaaaatttcaaagtccagagctgtattgcatttcagacaatatgcatgtcattgtcacaacaaaactaatgggacggctttctgatgaactattctcaattatgcataatgcacggcattacgcatgaactgagagagatatttccattgggagatgcatggatcatccatagtggtggatgcacaagctaagcatccacaacaaccagtggctgcaactccttgtttggcatggcagtggtggtggcgtctgtcttggaacgaacaaaaacccatgggaatttcacaagtccacaaaagaacttttgattgtgcgttggtaagtacggttggtatccaagagtggcgagagatatggtgctggaaaggtggtcacttttgtatatttgcaacggggacaggacatgcatgcagtggatttgagaatttcggctgagcaatggggtggtttcttataggagtggatctgtgcttttaaaatgctgagagtgttgaatgattggatctttattagagttttagttagcgctactagatggttggtgcaattagtccacgagttctgtaattagatagtgcactctataagctcgtgctcaagtgctaaccaagtttatttaataagtagtaaattgtgtctatggtacgtatataaacttgaggtggatgtaatttaatgcaagaacttaaaaaaaaagcatagaggtgcgataacttggataatgtgtacatttttgttaaaaaatcaatattccacaccatatatactttttaagctagcgatgtaaaaaagcagtcactcagactatctcgataaggatctacatgtattatgttgtgactatctcgataaggatctacatgtattatgtattgttttttttcttggttgtataataaaattgcatatcgatttgaaactgaaaaatataatgattagcaaaagtaagtgtgtatgcaaactaacatagtttccaaactattagactaatcatacatatcattgtctccggtgacaaatacactgcaaaacacaaaattaatccaggagccaacaatcttgttaagcttataatacaaataacgaaacatgattaatcaaaggtgcataacaatgtttttaaccaaaatgttgccgagtttacataccaatctactcattttttaagttagtacactagatcgtacccacctaccaagttcttgtatcacatgtgcaatttatactctttaatgaaaacaaaacaatatacttgtgtggttttaatttcatccgcacctcaatattgtttatttttcttactccatccgtttcacaatgtatgtcattctagcatttcacacattcatatagatgctagcgaaaaatgctagaatgacttacattgtgaaacggaggaagtatctattataacatgacatatgaaatgtgaatttagtctaccattatgtgtttcaatccccgtttactttctaaaagtcatgtgttagttcaatatgattgtgacaagtcatacaaaacggatcggatcggatcaaaagtaatgatcggactatattaatccttatgttaggtcactgtaaaaatatagtcttgtgatggtattacggttcacaaaaacgggaccatggtggttttgggattttcacaaaaaaaaaaccgttgtttactagtgaaatccgatcaaattttgtcaaaaattaaattcagtttgattttttaaaaaacttcagtaagaaactgacccgtatgtgttcccgagccagcccaggaagttcagttttcgttggttttgtaaatccttgatggcatagacttcacaagtagtttggttaagtcaacaaaattgtgtaatccacttgtcgccttcttagtacactcttcgtttcccttcctagtcaccacactcagacccatgcagcgcactcactgaagctgctacaaagttgacatttgaaggccatccgagcaacccaaagagaaaagagggggtctaagaaatgtatcactctatcgtgtatattgtacagcagggtgagaggtaaaggatgcagagaaccttacatatccttctcatctctgcttccctgcttcaagtctccaagtaccagtaaagctgcagcctagctaattgagatagcccaagttgttagacacttgtgatgcacccatggaggtgataacttatttaataaattgatttgtcttaattagcgtagtgcatgatcaaatgcaagtaagcaagccaaactaaaaaaatcatttttgcaagcggccaaatgtgatttttgcatgcggcgagcacaaccgcatgcaaaaatcctatttatgcagcccgccgccgtcctccgagccagatccgcaacagcgccggtgttgcctgctccaggccctaccgcccgccatcgtcgtcggatccgtcgcccctaccaccctcggtcgtgcgtcttgagctctctggactacgggacgtggcgggagcttagtggcggcagctgatgatgacaccatggtcatggtcatggaggccttcctccacggaccaaacggtgcctcgtccacgcgactggtgagcacttcaggttccactcccacatgttcccttcacttcagtttgctgatctaatacctgatgagaccaatgtatttgttcccccttcaaattttgtctgctgctgcttatgtgatgttcgatgttgcatcgtaaattccactcaacatcgcaccgaagcagaattagtataatgcataatgctttacctgcctctatctactcttcgcttggagctttaaagttaattaatttaatttgtgctaaattaggattggttactctggatttcgttgcttcatttgtccactgcaactgcaactccacgctcagctgatcctccccttcgccaatcggggctgccttggggaactctcgcccatcgcgcgcctgatgcgatcgatcctgccaccaaaccgaagccgaaccatcccggccgctgcctttgatcgattgccaccaaccacgacgcctccaacgtttcagaatcgatcagaggttcatctctttttacaatcacagtttcatgctctatggttgcactatttatttcgaacaacatattatcagtgaccctatattcttgcttagtggaatacatacatctatgattagtgaggttgacatgtggggtccactttctcttttttttattgtcacataagcaccacatcagtgaaaccagatatctataccactagaggatttaatttaacccggttttgtaagttgggagattatgatttctggtattacggttagggtattaaattaactcgacgtaaagatgagggatgataggtggacttattctaatctgtcatgcatgcatggacagcccatacgccatagtggcatagagagcccactagccaaattttgatatctgaaagtgtggcccgtagtagccaaggtcaaatgtaatgttcaagcccaaatatgatcctgcacgtacgcatgtctactgggtggaaagaagccttatgtctacggtctactgaacacgatttgtgggctacattctgggcaccgttcacccggctaatttttgcggaaaaagtccacattgaatcccttaaatatcggccgaatctaattcataccccttaacaagaaaactggataagatggctccccgaactattaaaacggtgtaatttgactccctagatggttttgcaagcggttttggctgacgtggcacctacgtggcggtgctgacctggttttcatcccacgtgtcgcttacatggaataagaggaaaaaagaagtgggacccaccgacatgtggccccacaggtcatcctccctctacttcccatcttcctcctcccccccccctctctctctctctctcttatctctctttctcggcggcggcgcggagccccagcaacaagcagcggcggcgggcggggcgcgctccagcgcacggtgcaggccctccgtgtcatcgtccgtggcgtgctcgaggagccctgcgaaggcgtcgtcggggagcctaggcgctgacgggaagcaggcccagcactagccccgcgatggtggagaggaagatggagaggagctgccacgcctgggggctcacctcggcagggtgcgaggcgaggaagcgcacggcgaggccgaccgcgagggacacgaggagaggaacgagcttcgcaccggtgggggccaggctgtccgcctcaagtttgggtgttttcgaggcgaggagagaggtgggatgcgacggcggagaggcgttagcattgttctcggccgtcccttccttcccggaaaaaggaaatgatacgatgatgcgaggagagggagagagagagtgtgaggtgtggggtagggagaggggaacgacagcgatgtggcggcgccggagctggtgcagggataggagatcgagcgagctgtggaggctagagccgctggctttggcgaggaaggcgatgtggatgcggggagatggactggctgctctccatcgcaaactctatcgtcgagctgacgagatcaccctgtcgatccaagagctccccgacggcggggggcggttcgaggtcatagtgctgcgccgtagcgacatgtacatgaatctcgtggaggccgtgccgccgccgttgctccagcacccgtcggccgtcgacccgcctgcctccgccacagccgaagggaaaaagaaaagagaaggagagagagggaggaggaagaagggttggagtgagaggatgacatgtgggtcccataatattctttttgtgtgaatgataaatgggtcccacatatatattttaaattctaatgccacataagcgtcatgtggtacgaagaccaagttaacactgccacatcagcgccacatcagcaaaaccaccctctaaaaccaccgaggaagtcaaattacaccggttttaatagttcggggagccatcttatccggttttcttgttaaggggtacaaattagattcggccgatatttaagggagtcaaagtggactttttccaatttttgcttgggagagacaacaaagggttttgggttgggctgattctcagctgaaattctgtaatgttaaaatttggacaaatttgactggagttaagttcggtgattagttgtgcatgccaccaataatgagtagtccaatatatcatcaataagatttatttctaggagttatcatctattttacaaagctagtccccttccctgctcaaccctaccatcgttgtcttcttctatttgtatgttggaagtcattatgttctgttgaagtatcaaagtttgtttgaccctacgtaccacaatcatcctctctctccaataataaagtcggccagtgagactatgaaggataagcccatcaccagatcttcatcgtcgagtgagaaacagtccagatcactggctaaggcccaaggttcaaaagaactctgaatagcctagcaactggggaatgctatgctgacaaagcgacgttataccggatagaaatacgcctagttattagtgccatttattctatcaatggaaaaaaaaactttgcatgagaaaaagtacatgcttagagcgggtataatagcagactattagccagctattaaacatattttaataagataaaagataagagataaaagcagtgggctacagatctgtagccagttgcagcacggactctaaaataacatacgtatatgacatgtgggaccatatattaatagtatagtaagctattattgtatgaattggctattagatcggctattagatcggctatagatgaattggagctagtagtggacgattctattaaacttgctcttagtagatgatagcatggtgtaccacatcagcgatagatatagcatcatataagtgtggcatacctagctcgggcgaatagcttttgcgtctacggtcaacacattttttttcttagcaaaataaacactcctatatcttggtaaagttgagaagggatgccaaccaaaacccagcatgaatctcttctaatctagcttccgattacagaagtttctactcccaagaagcaagaagaggtcatatttttttttccaaagcaaagactcgcatttcttttatttccttgtgcaacgtgacatacctttaggcggtgtacgcaaatcctgttggtagatggatcataagtcacaactttttaaaaatgtcatcggtgataataaagactgtgtacaaacacactaccctatgataaataggtcgcgacgactagaaggcatgagtacattattatgaaaacaatcatgaatactcactccgtttcataacgtaagttatttcataacgtaaattattttagtattttctacatttatattaatattaataaatctagacattaatatgcatgtggaaaatgctagaatgacttacattgtgaaatggatggagtatctcacaaacacatatctataatgtgtgcagtcctaacaaattttagacaaaaaaaaatacgatcaccgagaggaaaatatcgttaaagttttaggactaccaaattttagatgcggtatttcagtactactttgattgataaattttgctataggacactactattgtgtggttttagccgcgggacactgtccaaactcacttttaggggaaaacactccataaacatggtaatttgccaatgaacaccgtgccaataaaaataatgatttccggttgaggagagagaaatcacgtgaaatgttaaaaatgctcttgggcccacatgtcagctctccatctctcttcctctctttctttttctttctcccttggcgctgcgggaggtgctcgacgcggcgcagtgtgctgtcgtgtcggcggcagggaggtgctcaagacgtgcggcaccacgccgctgctgcgcgcggtgcccgtactgctgcgtgccgccgctgcgggcgggctcagccgggcactccggctccagtcgtgcaggtactcctgcggcgagtgcctgttcccggaggcgcaaccgttcccgcacgctgactttgccgacgaggtggcgtacctcgacggcgccctcccctgtgaggtcctactcttccgccactccgccgtgatgccgccgtcgtcgtcgcccggtgcctcgcacaggtggcacgtctacttggcatcttcgtcgtcgtcgtcgttcgtggcgcgacgcggctcacggtggaggtgtgcatgacggagctggaccgcggcctagccgcgcggttctaccagcgccccggcaacggccggaccaaccacgccatcggcgacgagttgacggcgcgtcggggatcggcggcgtggtggaccgctaggccaccgtctcggtctccatctcctacaccgccggtgctgcgtcatcactctgcacgccggtggccgaagccctggagaaagaaaaagaaagagaggaagagagatggccagctgacatgcccaagagcatttttgacatttcatgtgatttctctctcctcctcaaccggaaatcattattttaatcggcgcggtgtccattggcaaattaccatgtttatggagtgtttcccccaaagtgagtttgagcagtgtctcacgactaaaaccacacaataacagtgtcctattgcaaaatttgccactttgatactacctccgtcccaaaatagccttttttgagtttttgtttgtaatatttgactattcgtcttatttaaaagattatagaatagttatttattttgtttgtgacttgctttattatcaaaaatactttaattatgacttatcttttttatatttacactaagtttttaaataaaataaacggtcaaacgacatctaatttgggacgtacggagcagcggacaacaaatttgtagccagctgcagcatggactttaagatacatgtgtgtatgacaggtgggaccagacattaattatgtattacatgtttattgataactattacatgaattggctattaaattgactatagttgatttggagcctatagttagctataatactactacctccatattttaatgtacgacgccattgactttttatccaacgtttgaccattcgtcttattaaaaaatttatgtaattatcatttattttattgtgacttgattcatcatcaaatgttctttaagcatgacataaatattttcatgtttgcataaaaattttgaataagacgaatggtcaaacattagataaaaatcaatagcgtcatacattaaaatacggagggagtattaaacttgctcttatgatactctggatttcacttagtttgcaagagccaggtgtgtttgcaagagcaagttcccaacactcccctctcgtttttcgcgtacacgcttttcaaactgctaaacggtgtgttttttgaaaaaaatttctatacaaaagttgtttaaaaaaatcatattgatccattttcgaaaaaaaaattaactagtacttaattaatcacgtgttaatggaccgctccgtttttcgtggataggagatgggttcccaacggggatggattctaatagctcgagtgg

SEQ ID NO: 20890 - DNA, 43203 bp, Oryza sativa
  unsure (1)..(43203): unsure at all n locations
aaattaggcaggccaacctggcccctccgcacgcaacgccgcatcccggcgccatcgaaccctccaaaagcctcgtttaaagcccccacgaaacaccaccacctccttctccctccctccctcctcgatcccattccccccccccctcttatctctctccccaatctcctccacacagcaatggcgaagccgaggctgctcgccctcctcctcctcgccgccctcctcctcgccctctccttctcgcacggtacgcaggcgctcacctcaccgatctctcgctgtgttaactagattccttcttcgattggttaatttcatgatttggtgtggtgtggtgtgtgcggtcgatcgatgcaggggaagcgaaggacgtgcagctggtgaagccggcgcgccgctacgggcggtggcgctcggccctccaggccggcgatgggatggtgtcgacggtggcggactactccgatcccaagcccaacaccaacccccgcggcggcgtgctccccccgaccgaccccaactcgccgccggcgcactgaccgccgccgaccaccgtcgatctacggtctccttccaccccggtcagccggcgacgtatctgcgtataaatacactatatatactgtactaccgtataaatacctagtagtagtaaatacggcgtataaattcggaatacatgtgcgtaattaagtagtagaggaagaggaaggatcggaataagctgacggcgttcttctccttgggcatatacggtgcagtgaccgtatacatgtacgcgtacatacgtatacatgtacgcgtatacgtatgcgcggcgtacacactagccaattattgaagtagacctagctagacttgtgcttgactgtctgtcatgtgtgtgtgtgattattgcgtgtctgatgttgatcgtcgttgattgattattatgagattctgaacaatgttttgtttgattaatttggacgattaattgttactagaacgtatacacgtgcgtgtgtgtaatgttgatgtgtcttgcatttcgtccccgttgtatcacaaccgatccatgtaatttgcaataaaatcatcaataataatgtgtcattgttggatgtaacagagtgtttttttgtcttcagttattcgtctctattccattttccgtgaatttaatttattcctgtataacttgatatatatatctatccatggatgtgacaaactaacaacattatatctatctctgtcgaccactgaacggtctgggtttgtgcatgtgaaatcaattagaacaccatttttcagtgagcgcgcacaaatatagtttatagtttagttaagctaattaaacaagagccaagaaatcattcatcttcagttattggactgctcttgcaaatgtggtcaactcatcttcattctcaacggtcaatgaaacacgatactgttcagaacttcagacatgttttggcatgcattgtcggcgagacttaattatagcttgcatttctgatgttaattaagcttcctcacggtgtgcatcgtcgttggttgcaagcaaggtttctttctttttcttttaagtatttgaaatttggttgcaagcaaggtgatgatgaaaattggtacactagtttaatttaggctcgtctacattgcaaggatcatgaacttttcagacagacctcttacatggtgaaattgacgatggaaacggtttgattcagcagaaatatattcggacaatcttctttgttctcgatcaaagatcctgccttagtttgatgtcatcgtccgatcctaggtgtttttttcattggctgaattagctgtgtgccctttcttcgagcaccaatcatgcttttgcaactagggataccaaaaaatcattgcttgcttgaccaacacaacaccatatatatgactatatgagcatcgatcacatacatgaatatttggccatcgatctgggtcaactcatcgggctggctgctgcagaatgtgatctccaagttcaattctagtttgatctgcaccaaccctaagttttagtctgatcggatctcattttctttctcggatataagtccatcaagccatgatgcccgtctccaaactgcaggaaagtgtacgtgggctgactagctgagtgacgtgccaccagttagcaaattgagctgctagctactccatcaatgtactctctctatcctaataaaatgaatctagaaaagattcatcctagattcattatattaggatggaccacatgacataaattatttattttgggatgaagaaagtaagcacctttgaaaaaaaaatatcgattaagttgagaggtgaaattaaatggccagattcatttagataagggtatagattaaatgagagatggtctccccgtaggaaaaaaaaaggaaacaatttcatccaaaaaataagatttttgcaaaaaaaaatgaattaaacaaaatttattcaaattttgaaatatttcagaccaaaatatttcaaaatatctgcaattttcaaatgtttggttctatcaaataggccaccttgtgaagtagttatactttagtagattcttttgatcggttggaacatgtcaagctcgtgatgggtcggtcactcaccgatcaatgcatccatccgacgatgacgcattcacgcagaaagaaaactaaattgtccacggcgatgccaaaacggaaaaaaaaaagggagaagaatttcttataaacatcttcatttaatttggtcagccttgagacttgagagattaatttgcatggagatggagccatggatggccaaaccaagaagaggagagctttatctctcattcttttcgtcgtcacattgcctaactagctccgatcgaaagaggtaggagtagaatagtagtaggatggatgaacaggacggctgtggctgtgttcggaagcagccgttcggcccgttcccaacaagcacagtgctaaaaaaaagggagcacagaaaacggagcagtacattatcgtgtgattaattaagtattagctattttttaaaaaaatggatcaatatgattttttaagcaactttcatataaaaactttaaaaaaaatataccgtttagcagtttaaaaaacgtacgttcggaacacgaggaagatgagttaggaacctgagcgaagaacacagccgaattgatgattgcctcccctttgcatatgtgaattatggatgtgtttggtatccagaaagaaatagtagtggggtctgaacttatagtccccctcccatctacatacgataaaaaaatttaatggggttttcgtggggctcttatagtcttcacgccagtagtgggggctcgagaccccgccgcccccatgctggatccgctcctgcatgtgcacaaaccatcagattgatctgattgtctgaaacttaataaattattcagaaatggaagagatgctatttaagtgcttcctaggtgtgggtcccggatgttttcgtgccaatcggtcaagcattttgactcatcagtttgtagtttacctcttgttaaatgtgagttgcacagtttagaaatcttggatcactggacttgtctcgtactttcccttgttttcttttacagttttgacatgagtcgcgtatgtatagtgtgtatactgcggcgtacatgccggcatatcggcacaaatgccgttggtgatattcggatatgtttgacgccttgacgtcgtgatcgatggaacagcagacaaaagctagagcaagttgggggtggcctgatctgatcatagttcagaagctagctgccgaccttttccagctccaggagagtactccatccgtctaaaaaaacataaatatagattttcgtgtccaacatttaaccgttcgttttatttaaaaaaattataaaaaaaattaaaaagacaaatcatgcttaaagtattaatcatgttttatcatctaacaacaataaaaatactaattataaaaaaaatttatatgagacgaacagttaaacgttaggcatgaaaacctaggtttatctaaaattaggacggagagagtactcctgagcagcagctggctaggccggccgacgacgactctgttggattggatcgatctgtgctggattttcatttatttttaaaacttattttataaatagatctttgaagaaatttattttatgagaatggactttttctcggcgtcagtaaccctagtatatgttgtatcggaggacccatttgtaagactttttttatattatagttatttttaaaatattttttgtaaatagattatcaacgttaatgtcattaacgccgttccccttcgtaacagtgatttagattccgcaaaaggaccagagcgtcagcgccagcgtcattggcgtcgagacgttagacctcgacaacaataaccttagcaccgaaaaaaggggttgatatgtgaaataagtttttacatatgtatatttgtaaaatatttttttgaaaataaataaaatgtaaaaagtccagtcgattgatctgtgtgcatgcccttcttcgtcgcgacgttgcaggtcatggtcatcgagaattcgagaaggacatatgcatgagtgtgtctttgtcatatgtatagtactagggccgtaagggaataagatgtctcatcggatatgcatgcatgtgattgtgtgtcaactccagctgaagtctgaacatttttttttaattatacacggaagagtgatgatatggtgggagaggcataggtggtgtttgaatctcctagagataaaagacgaagataaatattaagtgtttcacataaaacgagataataataatgtgtaattaattgagttttaatcattataaacttgaaaaatgattaatctgatattttagaacaactttcatatagaaagttttcgtatgaaatgcaccatttaacagtttgaaaagtgtgtcacttttatccaaaagtttatttggagaaaataacagagtatggcctgttttagttcccactttttcttacttccaacttttccatcacatctcaaaactttcctacacacacaaacttccaacttttccatcacatcatttcaattccaatcaaactttcaattttgacgtaaactaaacgcgccctatgtttggtacatctccacagccattcagcctgagcgattttttaaattacagaactgcgacctcttttgtcaaacactttgtcagcgagagcacataactttttctagataatggaataaaatattttggcatttgcttcaacaagctccagccaaatattctggcctttgctcaattattccggcctttgcgcatatctttttttgcctccagtcttgtgctactgatcaactagtagtgggtactatgtagggtggaaacgagccgagccgagccagttacaatggctcataacaagttaggcttggtttggctcggctcggttagggaaacgagctaaaacatgagcttggctcggctcgtttcctggctcgagccagctcgagctggctggtgagccttccgttgaagctgtataatttgtaatcattaagaaaaacaataacaaatcatcaacatgtaaaattaaaataactttatatattcaattcatcaaatatagatgataaattacatattgacaaataataactccactaataaaataaaatcatccatataaatgcatgatggtctaggctcacgagccaaataaaacggcttgcgagccagctcgggctcggcttgtttcagaaacgagctgaaaaagagacttgggattgactcatttggcattcaaagccgagtcaagctaaacgagctcgagagtgtgcagcggtcagggccggccctgagccagtgcagacggtgcgaccgcactagacctctaaaaattaggggcctccaaaatatatatattatggtatcagacctgataggcttagaggaaagacagaagaccgatcgacgatcgagcatattatgactgcttggttgtattttagacttattagtgtgaaattcgttaatgacaataagcttttaaatattatcttgtatttttatggtgaatgggggtttttattttttgttccgcaccaggccaccaaaaagttagggccggccctggcagcggtgtactcacagctgcacgagtgcgcgtggcgtcgcgacggaacaaggctagcggcaacggtggtagccgggccggctagccgtgcgcacacatcactgatcacatattcacttgtggtgtggttgtgccgtgctgtgcgtgcatcggtgcatccgaggcatcagccaacaaacaacgcgaagaagatagaaaatcacgtcgctgatgggcttctcgtaatctaggattaatttgtggttaaatctgaagttcgtccatgaaccgtaataccaaatacgacgcgttcctaaactcttagggcctgtttagctgatattttctgcagctgcacggcaactagctgcagcagcaagcaacacaacacaattacagctgcacgaacacaagcactgcagctgcagcgctgccacatgaatgacagccgaacaggctcttaaaattagtgcaaataaggtctcatggtaggttggacggcagttttagttaatgtgacacttatttggtgttgacgtaacacttaaagtaaaaaattaacatgagacccacgtgttaatgaatctacttctactatactacttataagaaataaaaataagaggtgtttccatcatccgtctaaataaaaaaatagaaaaaaaacctaaaataaaaaagtccgattccccataagaaagtggcgaaaataaaaaaaactaccgtatccgattcccatctaattttgttcgttttctctttttttctgtttttttccgttttattttcttttcccgtttcttttttttattcactttttttccggttttctttgtccgttttcttttcccctttttgcgtattttcttttcgccgttttttctttcaccaatttttctgtttatttcttttatcgctatatttttttgcggttttttcatcgggccaaacccagcgccgccgccacgttgattttcctcctcatatgcttcctcctcctatttactgcaataaccgattcctcactactctctcattattttccccatgaatctactctctcattattttccccatgaattcccctttcgattcagctttaattcaccagattgaatctccatttaatcatcgttattttttatcccaagtatcccaagttttgcagattgcttcgattttgatgaaccatttaattgtcgtcattttttatcccgagttttgcttattgctttaattttaataaaaaaaggggaaaagggagatcaagtggataaaaatccctcaataattttggatatggagaaagattcgaccggatttgatagagatgatcggcttcgttagtcatcgtacgggtacggaactaagcgagctcgagtggattaccgtatttgatgggaggatcggctccgtcatggtataagactatgggagctcgagcggattaccggatttgatgggaggatcggctttgtaatggtatggacacgatactgttcgacttgggcctacaactccatttgtggactgagccaaagagaggtagactaagcagagggagatagcggactgtactaagactagagctgaaaaggacagaaggaatgtgcgtttgtttggtccaaaacgtacgggcattaaagggagtatagtgcgtaggataaaaaatatttttacccgttacaacgcacgagcatttttttttagtatgagttaaaaataaaaattgcagtgtcacccacattgccgtgacaccctccaacctcccactcctctccggcatccacgcgtcccgtgatctaatagtcccgttcgccggcccaactttgtaggactaatacacagccctgttccggtgatcgggctgaaatataatgggccttacgtccaatggaagctaggctgtgtgagcaagctggatgggccggtaggcccattatacgcctgagctgattcggcttgtcatttttcctttgagggctgctatataaggaagggactacctatacatttgtcgacaaattttttcctaaaaatttgacagatgtaattatagtacaatcgtagtgtaattacactgtaaattgcatgtaactacagtgtaacttatatgtaagtttcacataattttgaatcgttagatctattacaagatttgttttggtgaggaagaaaacaaatcatagcacacacatatgtgaaagaatttgttcccacgacctccattttaccgaaataacatgttacgtagagatttttgaaagttacatacaagttacactatagttacagtgtaattgcatgtaagatacagtgtaattacactacgattgtactgtaattacatccgtcaaatttttagggaaaaatttgtcgacaaatatatagcaaaatcgataatggaatcccgttttcgaacgggatgatactggttagttatcagaaccggcatcgggtgacacatatcaggtatcaggcgattctaccatattttcaggtgaaactcacgacgtatcaggtgatacctatcagatatcatgcgatttttgccacatataaggtgatacttacgaggtatcaggtgatacctatcaggtattacgcgatgcctattagatgatacttgtgatgtatcaggtgatacctatcaggaatcacgcgataccagccaggtatcacgcgatacatacccgacatcgacgctgacgaccactgccgccctagtgccccttcctccctagctccggccatcgccgccactccaccgccaccccctcccatcccctagatctggctaccaccaccgttgcccctccctcccctggctccggccaccgtcgttgctctctcctccagctccggccaccgtcgccgccccctaccctggctccagccaacgccgccatcccctcccatcccctggatccggctaccaccaccgttgccccttcctcccccggcttcggccaccgttgtcgttccctcccccggcttcggccaccgccgttgctccctcccccggctccggccactgtcgccgcccccttccccagctccggccaccgctgccacccctccctcggctctttggctccggccaccgccgccgccctatcccttcgctctctggctccagctgccggtgcccaggctccggccaccgccgttgctctctccctcggctccggccaccaccaccgctctccccccgtcgctggctcgggccttgtgccttgtgctcttgcggctgatggaggtggaggggaagctatcccgttagagcaacggtatcccgtcccctagcattcctgttttcctttctaaaaggtagatgtttttctaatggatttagtagaagttcattattattattttttcaacaaaaataaacaactatcatattgatcgatcgatggcatggagtatgtggatctatgatagatcgatggcatggagtatgtggatctcaagaaacaacgtgatattcagaggcataaatccttattttcatatatgtaaggatatattcaaaaaataatttgccttggttatccttagggcatagggcaaaagatagtctcaaactcctaatgtcggaatggctagacaacctttgatttttttttaatgtacatatgtaatttgtaatctttttatactatatatatttactcaatgtaggagcctctccgatatttccatttttttttgaaaaaaaacctgttaaactgactcaggtatgcagaagtagttgataatacatggtgcgttcgattgtaccttttcccatcttgtattactctctcttttttacacgcacgtttctcaaactgataaacagtgtgtttcttataaaaaatttatatagcaaagtatatttaaaaatcatattaatttatttttaagttttttaagttcatacttaattaaccatgcgcttataagatacttcattttgcttgccgggaggagaaactaccaactcatttcagtatcagctgatctttcagacaatccaaatccgtagttaataatctgctagtgttttgttaggaccataccagtcagagctgactggtcatggtgttcgattaattgttgatggagtcatatcgtggagaaagtaattatgagttattcttttatttttttcattgccttggttttttaagttccatctattgttcgtctccatttagtttttaggttttttttatacaatcctcatagattagatttgtagataatttagggtttgtcttccatgatatttttggagttaggcttcttcaaagacttttgtcttttctatttcttccttggtggtggctatttcgtccaaaaggtcatccattaagacgtactggggttaatttgtttgaaaggttgttcgatgatcagatcgacacaatgattttgggatcatcaactttttatgatattaatttgctgttctgttagaaattaattttggggtttttcttccattttacttatctcagaattggttattgttgtgactgcaatcgtccgttcgtattgcttatggtatcttgtggtatttcaagatgtgaagcatctttgttttattctagtttttctagtttttcaagagatttaatttgtttctagtttttctaacagaagggttatactttctcctcttatttaataaatctaccctcctttgcggaaaaagtgaaaaaaaaaagtaagcacgacaagtaaaattagaacaccaattgtgagaagaagcagacaaaacagatatgtgcattttttccacacttgtatttattttgtcctcgtgaagaagagacaaaagcaataccgtaccaccaggtcctttagcacgaacacaggcaaaaaaacaatagtgtatttattgaatatatgtgcaaccaaaacttttgaagattcaaatttcgtccaaattttctcagaacagttatatggttctccagactataataactccatatctttttttagggaattttttttgagggaagaataactccatatcttattctttttctgtgatttttgtgtacatgcatgatcagatgctgcacatgtatctatcgttgaaagcgtctatgatcatttgatcgagctacggttggtaagccgtaaggaaataacgaagtaaaaaaaaatctatgtgcgaaatttttatatcgatattatttgtagtttaaaaatcaatacagattacgatgaaaaaagaagtacgaaactggcttccttgttgtgtatatgcatgacgcgtcagcttatttggcttatgattttcctttaccatgtgcttttctaaaggatttagtagcattttttttattttttcaacaaaataaagaagtattaaactgacccaggcaccatatgcatatcggctgagaatatgtggctgcgtcaaattcccaggaggcgaccaatctatatcaactgatctttcgggcgatccaaatcatgtttaataatgctagttagtgttttgttaggactcatcaggaccatacatgatacatagcagtcagagctgactggtcatagtgttaggtggttaattactgatggaatcaccatggagaaatgcggcaggcataagccaattctatttttcccttgcactgcaaattaatcttgtacgacaagtaaaaactccacttttttagaagaaacagaccgcaattagatggttctatttttttttctatctgatcttgtgtgccattttctcttgtctaggagaagaagagatattagcaataccatcatgtccttccgcgtgaagaaaggcaaaaaatttctattttttttcctgttgaacatataaaaagtaggagtagtaaaacttttgattattccagccaaaatttcctcactgtttcatttattctctagactagaaaaatgcatccttatcgtgttcttttctttacctccagcatcatatgctgccaacagataagtgtttttttaattaacaacatcagacgatgcaatgatttatactgatagagtatgaaaaaaataaaaatattatcaccgagagcaataatcaggaaaattataggtgttttgttgaatgtagcgtaccaagggtttaccacagcaatgaccagccaatcaaccctccccctggggcataagccagtctagcttatttctttgtataacaaaaactcttttcctgctaatatattgacgtgtaatttttttacgttcatgaaaaaaagaccagccaatcaacgctatatattgatagtagatctgtagaacaaaatctacccccactaatagcatccatacgaaattgtcatcacgtacacatattcagacattcagtcaaccgctcgaccaccctaaccaccccctggctcaccgtgccaccttgccaccctaaccacagtcacgtacacagtgttagggcatcaccaatatttactacctactttgagaataagggtgggccctatgttaatgggtattagttcttgttatagctacaatggtgaaataacaaaagtgggtagtaagctgggccgcacaaccaatagccatgagagagggatgagaaaaatcatttgtttattacttatggctaggtagtaagcatattacctagtatttattacttactactttcacaatgtatacaacctgatagaagtagtattttattttttattacccactttatatgcaggatgcaattactgatggaagaaatgcagcaggcataagccaattctatttttcccttgcactgcaaattaatcttgtatgacaagtaaaaacaccactttttgagaaggaacagaccgcaaaatagatggttcttttttttttcttctatgatcttgtgtgcctttttctcttgtcttggtgaagaggagataatagcaataccgtcatgtccttccgcgtgaagaaaggcaaaaaaattctaatttttttcctgatgaacatataaaggtagtaaaacttttgattattccagccaaaatttcctcaccgttttatttattctcttagactagaaaaatgcattcttatcgtgtcatttccttttacctccagcatcagatgctgccaacgtataagtgtttttttttaacgaatagcatcaggcgatgcaatgttttatattcatggagcatgaaaagaattacaaaaattaccaccctagaggataataataaggaaaattataagtgttttgttgaatgtaacttaccaagggtttaccacagcaatgaccagccgatcaaccctatatatcgatcgtagatctctgtagaaaaaaaaatctgcccccactagtagatagcgtccatacgaaattgtcatcacacatcttaagacattcagtcaaccgctcgaccaccctaaccaccccctggccccccgtccaccggatcccactcgcccctctccccaccgtgagacacatcaaattcaaccgagaaatgcaaaaaaaaaaaagaacggaggagcagtagagaacaaggcgcaaatgacaacaaagacaaaagacaaaagggagaaaggaaaaaaaaaacaaacgttgcctccttccaaaccccgaacgcgaccgcacgccaagtccccacgctgacccacctcgctgcgtgcccgcccgcgacgtcgccgtccgctctcccccccgccacgcccaacccccgaacctcccgcgaaccatctctctcccccacaaacccaaaccaacccgttccacgtctttccccacgaccacgaccgttcatttctttcccacttccccgcgagaccgcctcaatttcctattttttcctttccttccttttccacgcgactctctccttccggcttccgcgaaccctccttccttcccgccttcgcctcgcctcgccttacgcccagagctatatatgccgtccccgccgttgatcccggcaaggcacacgcaagacacaaccggcaacccaacccaactcggagacgcggacgaagcaaaggtagaggagacaatctctcgagagaagagaagcggacggaagcaactgatttatttggccatggaggcagcgtattcggcgccgagcacgtcgtcgacctactcgttccacttctccatggcgcaggccgtgctcaccatctccctcaacgtcatcgccatcggcctctccgccctcgtcaaatcctcctcctcctcctcatcgagttcgtcttcccggcgccgcgccgctgcagcgcccgcggtggcgccgccggcggcggttgacctggacacggttcttggcctgatgggcggcgcgggcggcgccgcgccgtcggtggggttcgaggaggcgtccgcgctgttcgagtaggaggaggccaccctgggggaggccgcggcggcgttccgcgtcttcgaccgcaacggcgacggcttcatcgacgccggcgagctcgggagcgtgctcgcctcgctcgggttcgccgccggcgccggccacgccgagtgccagcgcatgatcgacgcctacgacgcggacaaggacggcagggtcgatttccgcgagttcctcaagttcatggagacggctgcggcctagggaatccacaggattcccatggcgtcacttctctgcaaattctttgttctttcgttctatttttctctttaatcgacttcgatcgctcagccgaatgaagaacggcagcatgtgtatgcttatgatcagtttaggtgctgtttggatcatggcattacaaagagccaagaaacgggttgtgttttacttgaactgaaatcgatggaaatcgaattgaaatgacaatttccgtgcttgggttctatccctgaatcaaattccttacccttggcttaaaaaacagaccgaacagtttttctatcctctacctaaagcatgtgcctcatctgcttatgcttatcagacaaattttaaattttcaaccttaaattttaaagttgattttgagatttttttcattgaaatttatttttagcttttgcttttaaatcgctaagaacacgtatataaaagtctatttaccaattactttttatttgcaaatatgccaacgatggctccgtacatgtggaaaggacttagtaagagaatatgaacgaggtttaaatttcactgattcaatttgatttaattaagcctttatataaatggtaaacatgtctccgatcattgaactctcattgattttagtttacaattgatattcaggcccatcaaaaccttccagggctcctttagattgaaggaaacttatagtagaatttttagaggattaaaaatttggaatctgtagagaagaaaaacaggattgctaaaaaaaaggtcgctacatttttcacttaattttagtccattgttctcctatttgtaggtataagcttttaattctcatatctcatctttcatgtaaataataaatactccttttttttaataatgggaataattgtattagaactgaaattacacccggtctctgcatcgactggagatgcacacgacctaaaataataaacacgtttaatcctaattttcttatacattgtgtgttagaaaatttgcattgtaaatgtttcttacaatgtaattataaacttgcagtgtacttacattataggtgtagaggtaatttacaaaagacgacttcttttttggaaattgtgatgccataacaaaaggcacactttctaaaaaaaatgcatctttataaaggaataggattgtaaaattctcaaggatatttttctttactaagtccgatgctatactgctcttttgcatgtgttttcctcccaaattctttctgtttcaattcctctgagccatctaaacacattatctcgagtgttattctgttctgaaatcttatgatattacatagcacttcctccgtttcacaatgtaagtcattctagcatttctcatatctagattcattaacatcaatatgaatatgggaaatgctagaatgatttacattgtgaaacggatgaagtacgtggtaatatattcctatgttttcatgtttcaaagctttggaatcatgggtttataattgctcagttaacatccctggcaagtccacgcctcttaggtcttataatggacgcatatcatatcctctacaataaatacagagaatatgatatgtttaaaaaatgtatatttttactgtaggttaaatgtatctgatatgctgcaaatgtatattcaggtatatttgtatatgatatactcatatatatttgtatatgtttaaaaaatgtatatttttactgaaggttaaatttatatgatatgctgtaaatgtatattcaggttaaatgtatatttgtagtatgatttaacctactgtcagggttatggataccacatatctaatagtagttgactaaatctcggcaagacccaccacataccatgtcctatacgaaagcaaccttcggatataggaggagttccgaataaggaaagacaaccagggttctacatggaaacgacaagtactactcggattgtatccatattggtttccttagttctacttggacaagggaacacctatgggtataaatacaagactccctaggaggggaagagagcggacacccaccagagagaaccaacacaatcaacatacacccaccagaagccacaacatacaagccaacatacgccaagacaagccgccggatatcgacatcagagatacgcctggatcgaccctatccggtaccttcagaggccggccgtagggatctagcactgtctctgattccgtcgggcgcgagctcgaggaggaaggctaccctgttgtcgactacgagtcagaccttcagaccgccatgtcgacaacagttagataggctaccccatatattgtactggtgtgattatggtgaataaaaagcaacatcggctccggccaacaggatgtagggctattacctgacaattcaggggtccgaacctgtataaaaatccctgtctccatctcttttaccttaatctcgcgtataccctagcatcgacgatcctcataccatgcaaataccagaattgcgacatcaaacgtcgacacctacaaatatacatttagcatatcatattcaggtaactgtagatgtttttagcagggtggctagtgaacagcacagcagtacagtacagaagtcccgcggatccttcctcctctttttcggatcatagttgggccaggcgaagaattttggcccatccagatcactccataaggcccatttcctattcggctcggctaagttgtcgcttggtgggcttcgggctcgtcgtcgtcgtcgtctcccctccccccacctgacttgagacggggagatgcggaggccgtcgccttcgccgccggcggcgaggggcccggcgctcgccgctgcggcggccgtcgtcgtgctacttccgtccatcttccccgcgatcttcaccccgcttggccgcgccttcccttccctcttctcggtgagcccccctcctcccctctctcctcctcgcgcggcccgaaattggagccgatgtgctgtgaagtaagattcaaagctactcttcgtagatttatgattggtagctccagggacccaatcacttgggatgagcaaaggtcgtcttccattttggcagatagctagttccttgtagtgtatgagggaagaattggtgtgtctaattgatgagaattttgcttgtgctcttctagtttaggttttatgatcttatatttgctttgagggttaactaggcagggttttgtcaattgtttgcaggagtggaatgcccctaagccaatgcatgagtctcttctgaatgaggctttgcggcgaacaattgtgagtacataatacttagctgaaaactggagtatttatgttggagcccatctgtaacttgtattttgtacagtcaaacgaacaaaagagagagctgtggtcaccattgccgtaccaaggttggaaaccatgcttgaagtcatcaagtgttcacggtaacctactgaaatggcatgattccgacagccgcagcgatagaaaatcgattattgatcagttgttctgataaattataggggtacctttggaacccactggatatatccaagtatttcttgatggtggactgaatcagcaaagaatgggggtaacacacttcttatgcattgatgctatgatatataacttaacataactggcatccttgggactttagattatccaactctttcctttctgttctttagatatgtgatgcggttgctgttgctaaaattctgaatgcgtctcttgtgatcccacatcttgaagtaaatcctgtttggaaagacacaaggtgcttttggagtctcggagcactatatttttaatttccattttccactgttgaattttaagtatagtttacctttttgtattgtagctcctttgaagaaatttttgatgtggatcattttatcaacaccttaaaagctgaagtttcaatagtcaaagttctcccaaaaaaattttcctggagcacaagagagtactatggtacaggcatccgtgctacaagaataaaaaccgcacctgttcatgcctctgcaagttggtatctggagaatgtcagtcctatccttcaaaggtttgtgaaaaaaattgacttggattgtttctctattagtcaaacatgcgctttgtttattgagtcagcttcatagacttctctgaaataattggctcaagtcacgccttgcaatggtcttcatatatgtagctggtggtcaattaaggttacggagaaatggtcataacatttagcctaggtcaatttccactggtctagctccatatgtgttaacatgacatcctgtcattgtttaataactttgttagttggtcaatttacaaggcaaatcgtttagcagtcatcttaccttccatttgtttccttgcagctatggcattgctgccattgcccccttttctcaccgtcttgcatttgatgacttgcctgtggacattcagcatctgcgttgcaaagttaacttccaagctcttgttttcctgcctcacattatctcactgggggagactcttgtgaaacgcttgagatctcccgtccagggccaatctggtgaacttatccaagaagttggagaagacacaaaccaagccggaaaatatgcagttttgcatctccgttttgataaggtaaatggaaacttctccaatacattttttctgtggatccacagtgtatgtgcattgttgtgccctttaaaacatttctgcttctgatcaatttttcaggatatggctgcacattctgcttgtgacttcggtggtggcagagctgagagattagctctggctaagtacagacaagtcatctggcaagggagggtattaaattcacagctaactgatgaggagcttcggaacttgggacgctgcccattgactccagaagaaattgggctgttactggcagctcttggatttgacagcagaactcgaatctatctagcctctcacaaggtttgactcttctgtgtgtttaccatttttttttctggtggtattaggaaggtctaatatacataacgtattaaggtatacggcggggaagccagaatttctagcctgcgcaaacttttccccctaatggaggacaagaggagccttgcgtcggaagaggagctgactaatgttgaaggcaaggcttctgttctagcagctcttgactactatatcagcatgcacagcgacattttcatctctgcatctcctgggaatatgcacaacgcactggtatgttctgttcgatcttgaatttgcttgattgcttcctttgttactggtcctgactagaataatttgttgaaatttagatggctcaccgtacctttgagaatatgaagaccataaggccaaacatggcattgcttgggcgcatctttgttaacaagagcatggagtggttggaatttcaggaggctgtacaagcagggcacaagggtagatacgggcaaatcagactgaggaaaccaaagcaatctatttatacttaccctgctccagactgtatgtgtcaagggtagactgctaaattttgcaacaaaagactagattctttagtgtgtgaagctgaaggatttttgctcggcgaccagtgaatgttacaatgaggttctaattgttgtcagtttcttaggacgacaaggttctttggatatagggttgggaagaagttttggttgacccaagcattcagctgacttaatttttaccctagaaaaaaaattcagtctcgttccacattcagtgtaaaggttgtagtttcgtgagtgatgtagacttggcatattgtatctttttgtcctttccgtactacattctgtgcatatgtaagtaaacatggatctttcggccgtgaacttgtaagcacacatgttgagtttccaccagggttgaacttttcgatttcaagttcgaggtaaaaatcacacctcacccgtttaccgaaaactggtaaaaccgatggttatttggtcaatgccatacgaaaaccggctagctaatagcgatcggttttcacaaactgagatctctatcagtttccactgctctacttgagcatctgtttaatcccattttgggtatatacaattctaccttttgtatttgtcatcgtagcataaaaaacgtttccaatactgtgtgaaactgtgaaagtgccatttgccatgctgaggataattaagcgatgatgctaatgtgtggtggaacctcgtgtttctggggttcatctctagcttccaattgaagcagaatctgtgacatcaggttgtttggattggattgcatccattctcagccagtattttggaaataggtggggttgttttacatcaggttctcgaaccaggaacccagtaaccctagtaaaatgtacggaaacggaaagagattagggcatgtacaatggtgtttaatagcgggctcttttcgttatcatgcaagtaaatttggttacgtggaggaaagagagggaagaaatgagaaacatcgttgctatgcatttattaacggaaagtttgttgcatgagggtatagtaaaggaaagaagtataataaaaaaaatatttagtgcattaatgatttataaatcttattgtctctactattgtaggaggacggtctctagtgatattaattaatacagagagctcatattagactctacctttgtacatgcccttatacggaacccaagcctaaaccctaaccctagtaataaacggaaagagaacttatcaatcttcccagaaataacaaaaattctaaaattaattcgaatcggatttgatttaatttggactccgcaataaatacagacttccaaacagatcgtcgagcaccacagacgcttcaacgagttcgtccgtgatcaacaacagttcacacgcgtgttctacgagaaaactaaaccaaaatctccaatggcggaagcagcagcaaaggaggtcgccggcgccgccgccgccgccggcgacatgatcctgctgatcagctccgacggccagagattcgaggtggcgcaggcggtggcgagcatgtcgaggctggtgcgcaacatggtcgaggacgagtgcaccgacaacggcgtccccctccccaacgtcccctccgccgtcctcgccaaggtgctcgagtactgcagcgagcacgccgccgccgccgccgccgccggcgaggaggtggaggagctgaagagcttcgacgcggcgttcatcgaagtggacaacgcgacgctgttcgacctgatcctggccgcgaactacctcaacgtgccgtgcctgctggccctcgcgtgccagcgcgcggccgacctgatcagggggaagacggtggaggagatcagggccgagttcaacatcgccaacgacttcacgcccgaggaggaggcggagatccgcaaggagaacgcgtgggccttccaggactagattatcatcgaagcatagaatttttagatgtttctgatatgattctactatagaagccatttaggtggaagccatttaggtggtttatgtgtttagtcaccctcgctgcattagtttcttgctttgcagtaacagtttcgaggcatagtttatttattatcaatcgaaatcgaagctgtagctcctcgcagtgcttttggcccagggttagacaggtttcaatttcgatttcggctaaaatttcggtcatttcggcagaaccaaaattttctaaaattttgacacaatttaactgaatttgactaaattcaagaaaaaaaaccgaaaatttcgaccaagatattgacttgcgggaggaggggggtccgaaatttcgaaacaaaatttcaatcccgggctcagacatttcagctaaaaaagaaaacaacacaacaaaactacggattgatccgagcgagtcataatgcatatataaaacaattataagttgtaaaatagaatgtcagtcattgaaatcttggagctctcctcacgtcatggtggatcatttggtttgaacaaaatagaagaatcttcctggacacaagcacaacggaaagaggcagaagcaaatttcattgtagaagatagatatagatattgaccaacgagctttagcctttaaatccccctaaatgcttttattttactagctaaaagcaggtgttacaacggatattgtaaaaaaaatgaaaggaaagaaaaaaattataactttatagcatagttagttgattaagtatataggggctgtttatattgatgtcatttttaaccataccattttttgacaaagttaccaaaaaaaatgtctacgtttagttcgttgccaaatttgataaaaacataagaaatcctgccaaaattttgtcaaagacaaattttggtaatattgtcatcttactaaaattttggcatggcttattttagctacaatctgaacatgcccataatatcatatccaaagcaaacgcattcatgtgcgtagttcttataatccctatatatcagcttgtatttgttgcggactcgataccaccactatagattatagcctgttctgcaggacctcagctactgagttgcaatctcttctaaacgggaaactattctaatccctcgaggggatgtttccttgtttgctcaaaaaccatctaaatggttatgaaaaattctggaaaaatttgacaacattcatacaacacatatatataacttcacaaaatcttaagtccaaactcaactcacacgtcgagaaataaaaaagacaaattcagcgtatgaatagtagcgtactgtttatatctaaatttgtcttttttgtttctcgatgtgtagatcgaatttgaagatgaattttggtcgactagtaggtatcattatactctacattgtcaattttttcagattttttcacaactatttacatcgaatttgaaagaaaaaggtatacgaggggatatcccctcgagggattagaatccactccccttctaaaccccatctttgtttgtaacttacttcctccatcccaaaatatttaacgccgttgacttttttaaaaatgtttgaccgttcgtcttatttaaaaaaaattaagtaattattaattattttcctataatttgatttattgttaaatatacttttatgtatacatatagttttacacattttaaataagacgaacgattaaatatgttttaaaaagtcgacgacgttaaatatttagagaagtagggagtattatttttattccttctcttgccgtcgtttctttttgccgaggaagggggttcggccgcgaagcgcgacggccggagagagcagccaccgcactggatcgtcggcccttctcgccgctcgtagtgactgccaccacgtcggatactccggatgccttcatgctgccaactgccaaattccaggttcccacaggctttcggcccaatacaaaaatcggagcagcaaagcccgcctccagaaaaccctagcacatggccccccaccccacgaccacgagcgctatatatacatctcctcccaatggcttcatcccatcgccgccgccgccgcccgccgggaagctgatcccctcctccgattcgtctctagggttctctgattctcgccgtcgccggcgtcctctcttcccgctcagctgcttgttcgcgcctctcgtttctctttcgagcaacttcctgtttctttctctcttgggatttgggatcttggttttgggggattttcgatgggttgaagcaggtgatgaaagcaagacagggacatcagcaccctcttctcttttgagagagatgggaatgatcgactaagtctataatgggaatctctctgatgcttttttaccttccccccaactcagatctgctttgttttttttttcgttatttctcttctccttttggttttgattggtgttctgtggtacttagcttaattaatacgtgaatttgcggttcgtgttgctgccagtgatgcataaacaaatgcacgtattatcggattcttccgtgacgatctcacacaaatattgtcactaccactgaggcagctcagctcagcctttcttttttttttcagaagcatctactgttgtgcttttgatttgccaggtttttttatttcgtttgtttgttttttgtttgtagtttttttgtatctgcagttcgtttggtgcaaattgcctatgatggtgttaaatatactttgagcagctcgctgtgaaaaatacttacaatctgaggccattttcatctcgaatgcattgttaaatatgagttttttggtacaatttattctgaacagtacactccaaatattttcaggctatcttcctcaggggattgctcagaaagctcatgaagctaatacatttttttttgaattcttcacggaaggaaaacactagaaatttgtaagctgcaacctgattaattagggatggcaataggactggttgggcacggttagagcaaaaccatatctgacccgattcccaatattgcccacttaaaccctatccactagagttagtgggtaaaactccgttccgtatccatgcctggtgggcacggatatgtccggcgggtatactatggatcacatataaataataacttgaaagatatataatttaacaaagaaaaataagatcaatatttatcaaattattggttatcaacaataatttaaattatgtcataacttagtatcagttagcatcacaaatgaaccaatagaaagggtataagaaataaaaaataagtcaaaattagctaatataaatacatatgtatcgatcgggtatgggctacctacgggtaaaaaatgaaacctgtttgttgcccatgtcgtctttgggtctcgggtgggcgtgcccaagaaggtgaaccatcagaaagggtataagaaataaaaaatgagtcaaaattagctaatacatatgtatctgggttacctacggataaaaaatgaagcttgtttgttgcccatatcgtcttcgggtcttgggtgggcgtgctcatgggtaaaaagtcacaccatacctatcggattgggtctcgggtgggcgtgcccatgggtaaaaagtcacacccatacccatcggatcgggtaccacggatatccggacccatggataaaattgtcatccctattaccaaactctgtatgtattgaaagattccatctgcagcagaaacgcttcaagatttatataaactagcagaaccaaatgaaattcaacctaggcatttcacccagccacgaaacaaccaaatatttttctttttcgcccggaaataaaatcagctcagcgagatgtggagacggagaccgctgcgcttttctgatgtgttgattggaccgaaagcccagatcttttatgggcttcgaattgatgaggtgtgggcttttcttcaaaggaacacgtctattttgcatcctttcttcttcctcctgattgtattgcgtctctcaacaacaaaatcaggtgtataacgtatccttcagctttgagaatcggtacaaattgactcctatatatggtttaggaagcggtttctgcatatggtccacttgccagtgatatatgataaccaacatatatggtggtcccacgtgtcaattccttttctccttccccacctctccatccgccccgtctcgctcaacccgtccaactacgttgaggtccgcgagaaccggacggcctctgaatccgccacaagcatacacttagggcccatttgaattaaatgatttatctaggaatttcgtaggatttgcccatttgaatcaaaggatttatctaggaatttcgtaggattcaaatcctatagtaaattttcctacttggccctttgattcaaaggattgaagttttccaaatcctatgaaattcctatggaatggcacattgtatgttattttgacggaaatatagcaagagctctaacctcttggaaaattccctttgagtctatctctctcatccgattcctgcgttttttctgcgctccaatcaaacgaccattcctgtgtttttcttgtgttttgcaatcctctgttttacacttccattcctattagaatcctgtgttttcctatttctccattttttcaactctgggattcaaagaggcccttaatttcatagttgtttctacatgtcgccgtgtcggcagcaatgctgtgcttgttgatgtagtgggtggaggtgtagaaaagtacagatgccgatgtagatcagcatggcggtgggtaccagcgtgatcgacgaccggcacgacggcgacccaccaccggcgccccgcgagcagccgaggcggacaagcttgagctgcacgatgttgacgacgagcaccatggtcaggaacctgcacccaagcacacggagcctaccgccattgccaggctcccgacgcggagcgccactcggttgatcatcgccgccgcgagttctcttgatgagaatgctcgtccccgccgccgccgccacctcctgcacaggcgatcgaatcgagctgcgaagcgaagcgaggggttgctcttcggaaagcttttaccaaacgtcgagcgaggagcaaggcagcgacgcctcatcgggtagcggcggtaatctgtggagtagctcccggccgccgctcccagcgccgactgcgagctaagggaggcaaaatagacctttttcctccttcaaaaatcaaaactgaagaatctccttacaagctgatggatataggggcaaattcatactttttgcattgtttctctctatttgcacataataaaataatacattcaatgtctagccagcagctaattatcatgttttttagtgtaatgtagcaaatacgtgtttttccgtgttctatagcaaagactgtgaacctttgaatctcggtagcaaattttgtctaatttgttcagctctttaaatcaaacatcaactctctattttgcgaaaaattaataagataaaagatacatactccctcagtacaaaaaaaaaagacaaaccctgggtttctgtgtccaatgtttgactgtccgttttatatgaaatttttttataattagtattttcattgttgttagatgataaaacatgattaatactttaaacgtgacttgtctttttaattttttcataatttttttaaataagacagacggtcaaatattggacatgaacattctcagggtttatctttttttttttgggggggggagggatggagtaataacacgattgggtactaattttaaacaggagtaggatgaaaacactgctccagacaaatttattgtgaataaagaaccctgcgcctggtttttgactagacaatgggcaacatgccctgcttccccggcttttttttgctcgagcatctgcagtacagtactaggacgcatgactggcttactagggaacagcaggaacttgcattactgatgagcactggccatatttctctgcattcacgcatgacatgagttagatatgaagtgatgaggcagcccccatgcaacagcttcccccactgttgtgagttgacttgagtttatactgatcatgtatacgtaatgcttgcagaattcactacccccgtcagcttgggaaagacaagaactgaattttaacaaactccattactaacttcctattctctcttactgtcttataatccctccgtactcgtaaaggaattcgttttggacggtgatacggtctctaaaatataactttgacttcttgtttctataaaaatatttattgaaaagtgatatatgtatatttttatgaaagtattttcaagacaaatctattcatataatttttatatttttaaactcaacaacttgagagttatttgtgatttatattaccaaggtttgacttaaacattgtcttaaatgacttcctttatttacgagtacagagggagtatgcatgtagtaactctgaatttttctgattcatcgtgcatgtccccattgtctacataccattcagcttatatgctgttaccaaaattttattttttttaattttagtgtttttaatggttttttagcattaacttttaaatagcgaacaaacatagatataacaattttacgcataaattattttaaagttgtttatatgccgttttacggcttatatcagctgtgtaggccaaacgatcagctgtaggctagctttattttgagcaaaacttgctaaattgttgtatgatttgtattgtggttcgttctaaattctaaatttccgacgggaatgtgagcgaggacaaatgttactatttggttgcatggccgatcgaaaagagcagcgagtagggtagggtgatggagttgcacgctcctatctatctctacacactcggctatggccgctgggggtacctggcctccatagtagagccatttaattgctactgctctcccacgtcgtcgtatgtccaatccaacaacgtcacatgtatcaccagatttcgttctaccggtcactccaaaatccaggaaattagggcatgtttagattcctgcaaaaaaaaaaaattttacaccctgtaacatcgaacatttgcatacctgcatgaaatattaaatatatgctaaaaaaactaattacaaagattgcgactaatttgtgagacgaatcttttaaccctaattgctccatntatgataatatggtgctacagtaaatatttgctaatgacggattaattaggcttaataaattcgtctcacagtttaccgatggattttataattagttttttattagtgtccgaacaccctatgtgacacgttaaaattttacacccggatctaaacaccccttagactctgtgctagctgcattattgcaatcattccctgtgtgtataaaaggcacagcgaatgcttctcgtcagctagctgctatttttctcctctctgattcatctgctgctatagcttcttctagctagctccatgatggatgagtaccaatgcctgaagaacatggttttttcttttgagcccagcgacgtctttgagttcttgcatgtggggaggaggccaatgatgatcatcaggatgatcgaatttatcgtgtagccaaggatgaattgccggcgtttcacgctgttgatggtgcgtgcatatataagttggcgccggcaagtcatttcaggctacatgtttgcctcctcctctcatgctagatcaaagatgtcaggttttccaagctctcgatcttctcctatgtacgtatatatgcatctggagcgaaaaggtgcgcgtggattgattttcattacacgctatccatataatcagaagatcgaatttgttctgtgatcgatgcatgcatgatactactaatgcattaccacgaatcactacatatacattggtttcttctcatgcagcttaccgtgttcagggtgtgatcataattaacatgcaaagctgcagcctgcagccttgcgaggagatctcattgcaagtgtacacgaatctataaaagtttcttgatgtactcagacgtcaaggcctattagctcagctggttagagcgtcgtgctaataacgcgaaggtcgcaggttcgtgacctgcatgggccattttttttgttttattagtttttttattatttttttattttttgttttattagtttttttttgtgattttctgttttattagttttttttattattttttgttttattagttttttttttgtgattttctcttccccttgaacctgtgtctggaactagccacacattcccctgaatctgtgtctggaactatttattattttttttttgtgattttctcttccccctgaactgtgtctggaactagccacccattccccctgaacctgtgtctggaactagccacccagtgggtagtgcagtaattatcgaagtgatttttttaatataattatagtataattataatataagtactttaaaaatgtataacttgcatgcaactactttaaaaatgtatataaatttttttatctaaattgtatagatattatgatgtagttacagtaccaatgagttataatcattgcaacttattgtaactataatataattataacttatgcgctacgttagtgtagcgcgaaatttgacatatcatcgtacgattgaaaatttaaaaactagggaagaaaaaactgtcacatgttttctagcagttcggactaataaatccactaaccatgcacacaagaccatatattcaagtttaaaaagatatatattgttttgtttgatttatagacaatggcgaagcagccaattaagcagggtgtagactgcagagtatttttttttcttgaccagccgggacaggcggttgttgactagccgaatcagggctcacagccgccgccgacgcatgcaaagcgcacaaaagcagacaaagctttcgcggtaatccatccattaatcccttataaatagtgtactagtgcacacgttaattgccctggtagagtggtaattgctcgcgcgcattctgcatgcatgagcgcgcgcggcggtgtcacgatggcaggaggcggaggcggcgaccgcgcgccgtcgtcgtcgtcgacggcgatgatctcgcgactcctgccgccgggcttccggttccggccgaccgacggggagctcgtcgcccactacctcgcccggaaggcggccgacgccggcttcacctccgccgccatccgcgacgccgacctgtaccgcgccgagccctgggacctcctgccgccgccgcgttgttagtcgatcgattgcgacgagacattgctgcgtgcgtgcgttggctttgatcgatgtgtcgtcgtcgtcgtcgtcgatgtgtgcaggtgatgcggcggcggaggaggaggaggaggaggaggagcggtgcggctacttcttctgcacgaggagcttcaggtggccgtcgggaacgaggacgaacagggccacggcgaccgggtactggaagtcgacggggaaggacaaggcggtgctgcacggcggcggcggcggcggcggccgccccgtgggggtgaagaagacgctcgtgttctacagggggagggcgccgaggggcgagaagacgagctgggtcatgcacgagtaccgcctcctgcacggcggcgccgccgccaccgcctcttcttccccgacgccgacgacagttgtcgcccgcgtgagtgaaatgcaacagttcgaatgtcttgtgcgactgaatttgtaaacgttttcactaaattggatcgaattttctgctgaattctgttgtttttgttagagtgagtgggtgatttgcagggtgttcgtcaggaagacaccagatggtaacaacgataggggaactacagaacatcatcttccctccgacgacgctcatctccgttcgtcgccggcgccggcgaactctgtggacggcgcaggccatgcgagctgcagcttcttctccggtgctaatgagtccatggcgccaagcgaccatttcaacataggagacgacatgatcctccatggccacgacgaggaggagttgctgatgatgaactgttcttcggcttttgatctgccagagcttctcgactacgagagcttctcgctggacctttgatccaacgagcaatggcatgttctaaaatctaaagtatgatctggttacttctcttaatacaaaagatacataagtcttttgcgtattctccaaaaaaaatctgaaggatgatgcagctagctagctagctagctagatcgatcaatcgagatatatatgaaggccataatttgatcattagatgcatatgcatcatccatgtctacttcttcagatcactagctacttaatatgtcccctctctgtaattaaacttgcacgtatctgtatatatatttgtactgtagtcattcatgtaatatacgttttgtgtttgcgtattttatacacccttctatttcaggcgctcttagcatttcttttactttcttagattataaaaactagtgtgtggttgtgtgtttttgctatgtacatcttacttatatagagagttaaataaaaactctactatctttaaaaaaaaaagtatacatgctacatgcacgagtatacactagaaaaaaaactattttttgcatacaaccaaaactgattttcgtaggcggcacatgcggtcacctatgccaactgcaggcgaaaataatttcgttgaaaaaaacaaaatttcaaaaaaaaaatcaaattcgaaaccctaactcctttgttcatccccaaaccctagcccaccgctagcacaaaccctaggtcacaagctgatgtcttcgtcgcagccaccaccaacgtcgtggtactcgccatagtccatcctaccgccgacgtcgctgcccgctgctagatctgtgcaggagagggcgggggagtgttgttgccgctggattggcgcggggagggccacagccatcaacgcactgctcctccgtgggcctcccactcgagcccaccatcggatctgcgagggggccacagccgttgccctcgccgccgctgccaccagagcccgcgtttgccatcctcgcccgccaccaccgtcgggatggaggagaggtatggttgtgaggagtagggagagtgaaggagtggagctgtgagatggacgggaaaggggagatagagaggaggggagaaaaaaaagaatgggaagaaaatggggtattttcttatgcaggccgcttaagaggactgcgtggaaaaataatgtttttttttcgtatgcgggcctgttaagaatctgtgcaggggagatcaattttttagacggaatcagttatagtttgcctacaacctaaagagtgttttgtccagaaaaatcgatattgtaatagtgatattccggtaaggacatgcggctgtgctacatatataaatagattattgttgttgtgaagaatgtataggtgtgaatttttatacatgttgagggtggactctctgaagtgtaagtcaccagcgcgcagcgcgtatctaggattatgtatatgtacgacatttttgtacgtctgtatatacatacgtacgtacataagtatccagggatcgatgttggtgtgactttcttgggttctgatggctcagctgtctttttcttgaagtgagttaggccttattagtattgtccttcgatgtcaatgttttgtatgaattaacttaactcgtttcaggttaattagttgcttccgtgtgtgtgttcaccttgttttgagccctgctagtctgcttgcatcactgcaggatcaggacagagggatttgtaggtcaacttgcatcacacactctaacacacattccctcccccgaggaaaaaaaataaatgtgagattagattttgcatgacatcatatattttttggaccaagtcaaattaatattagaaaattggattatcaatatccccccctctctctctctctctatatatatatatatatatatatatatatatatatatatatatatatatatatatatatatatatatatatatttttgtttggtgctccatggtgcccgggcaccattgttgaaattgagtatatacctaattcaaatgagtatgaaactttttcaattacttaggtattaacattaactactttactctctctctctctatatatatatatatggattggccatctcaaggtatatgctccaaagtgtttagcatttcactccaaaaattgccatggaaaaaaagacacgagatttaaagagagagacgtcgtccctacaaatatttttaaagaagaaattataaacttgttaggattgaacacgggacctcgacgttgaaatcacacacctcttgccactgcactatcaagtactttctccgtttcaggtcataagattttctagcattgcccacatttatatatatgttaatgaatttaaacatataaatgtgtgtcaagattcattaatataacatctatatgaatgtaggcaatgctataaagtcttataacctgaaacggatgcagtacatcacaacaatggtggcaagaggtgttcaccaaactgatcagtgcataaggttcaccaaactgttcttgagccaaaaaccgaggttcaacgtacggttttcattccctacaaaatctgatcaaagtgtaggaaaaaataaactttcataattgttttttgttcttcctcccattttccgataaagatatctggacaaaatctccagttctcagttgcatgcagtttaagggtctcttttaattgtaggaattgaaaaaaaaagaagtaatataaaatacataggattttgaaatataaatgtaaaacaagggattgaaaatcacaaaaataactggttaattggtttgcagaaaaacacaagaatcaaataaaagatatagaatcaaatgaaatttttcaagagagaggagtttttgctaagttttcttaaaatctacgtacatgtgatgaaacagaatgtttcatagaatttgtaaaactctatttttttttatcaaaggggcaaatagaacattttttcatatataggatttgatttgaatcttaggaaattactacataaatcctttcattcaaagactgacccttaacctgaagttggcttgcacgaaacagcaattacgctcatatgacctaacacactgtttacctaccatgatatcttggcatcttgcttctgcaaccacggtatatgttcatatactcatatgcatttatatgtcattattccaaactactaaataactctgccagcgatggccaagagcgtaactgatcgagcctaatgatgggggctaatataatctcccagttaagatctgagtcaaagccttaatggcgcggtggcggctcgcgactgggccagggcggcgatcacctgaccgccgcaacagtagttaaacggctgcaggctttctcgaagctcacaagctctgaatcaaactgaagaaattaaactgcaggccaggttcagtgtccctcccgtttctgaagaacttcagattaattacagacgggagcgtgatctccttctagatcgcggcttgcgtcagtcacagtctcatcacagatattgtagtatacattcttctagcttctctcacacagcacttgaatggagagagaagaattaatagaattctctcattatctggctgattatttagagtccgagccggcattcttcagacgtagacaggtctgctattaatataggaattctctcatgcaggctgatctgctgatgaagcacacaaggcatcgtgccggcatgtcaaagataggaaataaacaacgatcgatgaaaacaaatctaaatatcagctcaaaaattaagtttaaaacttaaattttagctgggacttgcaagctgaaagacaaacgataggatcggagtcctagtttccaactgtttctttccaccaaatgaaggattcaagggagaggtttcaaggtattccactacttcctctatccacaattataaacattcgaaggatttgaaatttatctatagatataagcatttgaggagtactatttatcataccaatcataactcactcaaaacaccccttttaaataagaggcgtcaaagttttttctcattgatcttaatctctgctaaagaatctataggtgcttatatttatgaacggaggaaggtaccttgcaaataaaagggggagaggtttgaagtaaagattattcttagctacattggatgagttttagattaagactttttttttcacacttcttagacttgaagaaaagatagttagttttgaatgaatcagagttcgtttgcttgtcatgatagaatttgaccctccacagaagtttttccttgaacttggactgggcaatagttcaatgcgagcctaatttaatattccttgcaatctacgctgagttggattgcatttcaaaatttgttataaattttgcagttatttcatgcatttacttttaaaatgcaattaatatcaaagtgataattttattcagttttgtagatgattttgctctattctatttctaaatgctccttccaaagtctcaatagcatcaaaacataggagtaccttaaattttgaacttgtgaaaattcagttcctcccaaaattcggcccaagttgcacttatcatgaaaatctggcccattatgccaggcccacaaacacaaggccttcttctaaaagaaaaagaaaactgggcatctcaaaaaaaaaaaaaaaatcttggtcgtctcgtcgtcatcgcctcgtcgcctcatctcgatctcgtcgattctatccgagcagtagactagggtttttgctgctcgagcggagagcagatggggaaggactccaagccgaaggacaaggggaagggcaagcaggctgccggctcgtccggcggcgatgacgccggcggcggcggcaagggaggcaagggcaagggcggcaagtccgccgacggcctcggcacctgcacctacgtcaaaggtatctccagttctctcggtcggattacgagcaatttgttctcggactcgatcgtgattggtaagatcggtttggattggcgcgatattggattgggatcttggtgcgcgggaggggggaccgggtgtccctaatcgtaagtggatggatttagtctttggtactgaaatagatgtgggcctgaacctaccttgttttcggtgctgatttattgttagctttaaagctcttttggttaggattattctgttcgtggtaaatttcatgttgtttttttttttttgggtacttgactgctgtgttgttactggtttttcagctaggcacgtactgtgcgagaagcaagggaagatcaatgaagcttacaagaagttgcaggatggctggttggacaacggggacaaggtccctcctgccgagtttgcaaaggtaagcggcagatgtacatgcagctcagcttgaaaactaatgtggttggcccaaagagagagtaaggaattacagttttcaggagtttggtacattcgtatggtacaactttattatgtatgttagtattgatgattcgatggttcaattgctaatctattccaccaatcatgcatatctgttggatttgcacagctgaatgctgcagttccagttatctcctatgaatcacagatggtatttatgagaagtgtatctaacattcaatgattttttggctttgatgtgatagtattgcatattgatacttgaagtggaacttggtatgtttggttgtatgattgtatcgggctggaaaaaaagtactattgcttaggacaattggttgaataataactagccaaaggactgtggtaggaaatcttaggatattttgcttggccaggatcaatctgttttttgaaaaatgagatcccagatctcattattcattattacaaataatactattagaatattgtggttaaacagtacacacttaaaagatggattacctatgtggaataagcgtacaatagtcagttgttgaacaacatataaatttgattgtaggcctgccttctatgggaattacctatgtggaataagcgtacaatagtcagttgttgaacaacatatagttttgattgtaggcctgccttctatgggaattgactcactctctgtatgattgtgtaatcactacttgagagttgagacttctattttaccttacttttgaggctttgtgtgtgacatcagaaggaaaataaggacaatatttctacttgatttcaatttcaaacaaatcatttatttgacttacagggctatccacttacatgttgcttgctgtctgtaggctcaggctgctttcataacccactagacactatgtatatatccgactgatattactattttgatactgcagatagcccaagaatactctgaatgtccatctggaaagaaaggtggagatcttggatggttcccgcgtggaaaaatggctggcccttttcaggatgttgcatttagcacacctgtgggagctactagcgcaccatttaagtcaacgtatgtgtataattgtattactaccctttttcctccaatcttcggtctattaacaatgcaagtagcgcctatgacatgagtgctgatctgtgcgataccgtagtgttccttttggcctagcaagtaggttctatgaatttcttcaacaagtggtctatgacaaaaataaaaggacttctaaattatttagcctgcactgttatcacctttagattattaatcgcctgcctcatcattaaccagttaacatgatcattgtttgtttacattcaggcatgggtaccacttcatcctctgtgaaggaaggaagaactgatcagtctgcttcaggttggaacagaagcacctcagtctatacaagatgcagatgcctcgtgtctctgtcaacttaataagcactgaatgacgggcatccatattctatgtttagcctttctaatgctctctgaaagagtcttgaaaaactgtgctttctgtaagtaacctgtggtgtcaagcatgacatctatttgggatatgctgagatttagcatttgtctgtgtctcttatctaattggcatcttgttagctattgttatgtctctaattggatggttcctcctcttacgacaaggcgggtcttgcctgaaaattagaaaatgcgtaaaccttgtgcgccatataagcaatttatcccgagtaacatagcatttgtagatgtggtttcctgttgctggcttgctgtcctgggaatctcccgaatgtcaagagcttttagacgatgacacttatattcagtcaactcagtgtttagaaagcataagttctactctccgtttcatattataagactttctagcattgtctatattcatatatatgttaatgaatcaagactttctagcatttgtccatattcatatagatgttaatgaatctatacacatatatatcttgattcattaacatctatatgaatgtggataatgctagaaagtattatgatatgaatcggaggaagtacttgatctcagcctgaattgaaccataatactactgtgtaaacttctccacaacggaaatggcgtgggtggtgaaaatcaaggaggaaggtgaaactcagttggagtgaaacgtctgtcggagctcatcctcagttttacttttttggatattttctttcacgactatacaaactttttacttctgttttattcaatgaaatctggtacgtagcttgctttgagctaacgacaccgataagcagaatttagaccctctttatttaggcttataagccaatttataaaccgaaaagtttaagactaaacaaacaagtaatgtctttttaaaatcataagccactctaacactgttaacccaaaaacttggttggagaagttttttttcttatgtgagatagatgtataacttcatcactaaccttaaaacattaaattcatcggtttataaatcatatacaaaccaataaactagtaacttaaaattctaaacaaataagctaagcctaaaactaataaaagggccttgacggtcttgacggagcagctgtgagcgactgttcatatccatagtcccccaagagcgcgcggaaccaacggtcgtcgtctcctctaatccgcaaccccgctctcgtccgccttctggctgcgcgccatggctgctgccatccaccaccaccacctcctccctcctcgcctcctctccgtccaccgcagcctccccgcctccgcctccggcgcccgctcccccgccgcgcggccgcgtccggcgcagcggccgggacgtcgtcgtcgaccgcggccgcgccgccgcccacggacgccgcgctgcaggagttcaggcgctgggtgtcgtcccacggcgcggacgcgggggccggcgcggcggcgcccgccgccgtccccgagggtggcctcggcctcgtcgcggcgcgggacctgccccgcggggaggtgctcgccgaggtgcccaagaagctctggctggacgccgacgccgtcgcggcctccgacctcggcggcgccgtcggccgcggggggctcaggccctgggtcgccgtcgcgctgcttctcctccgcgaggccgcccgcggcgccggctcgccgtgggcgccctacctcgccatcctcccgcgccagaccgactccaccatcttctggtgagttgaggtgatgctgatcgctcatcgctcttcatgtgttcgacgaaatgctcctttttgttttgggtggttcatcacgattaacctcacattcctctccgtgctgatgcttttgagtggtttgcttcgtgcctccagtgcaggtcagaagaagagctcttggagatacaaggtgggcgtccattgcaaaaagttcaaaatccatgaatttaaattacaaagcgagctcgttttgttcatactggttgctagtatctttgttgaaatctgtatgcttttgttccttgcaggaacacagttactgagcacaacaatgggtgtgaaggagtatgtgcagagtgaatttgagagtgttgaagctgagatcataagcgagaacagggagctctttcctggtactgtaacattcaatgatttcctatgggcattcggcatactcagatcacgggtgtttgcggagctccgtggagataagcttgctctcataccatttgctgatcttgtaagatcttgaaatgcaatcatgcctgcattttctatttgcttttccaacatgctgtgaaccgacttatctttgcaaaatagataccactggaaaccatgcctgtaatttgtcatgccaaaacgttcagaatatttttattatacactataatatgctctttcaatacttttccctcgatatataatacaaatccaaccaaaatattgggaaaccattatgttctaatcattttggtgctttgccaaaccaggtaaatcacagcgatgatataacctcaaaagagtccagttgggagatcaaaggaaagggtctttttggtagggatgttgtgttttctttgcgaacaccggtgaatgttaaatctggagaacaggtacaagttcccatttattcattttaaggaaatcatatagttgtgcagctgtgacttttgttcactgacaacatttatatactaaataatgttttgacagatatatattcagtatgatttggacaagagcaacgcagaattagcgcttgattatggtttcaccgaatcaaattcatcaagggatgcatatactctgaccttggagatatctgaatctgatccattttatgatgacaagcttgacattgcagagctaaatgggatgggggagactgcatactttgatattgtccttggtgaatctcttcctcctcaaatgctaccttacctgcgattactctgccttgggggaacagatgcatttctcttggaagcactcttcagaaatgctgtttggggccaccttgaactgccagtgagtcaagataatgaagaagcgatatgtcaggtcatccgaaatgcctgcaaatctgcccttggtgcttaccacactaccatagaagaggtatgtttataacccgaataagcattgttcattttcttttttatgttattatctccaaattagtattacgaaacatgtcaaaatatatgtaggacgaagaactgttgggaagtgaaaatcttcagccaaggcttcaaattgccgttgaagtcagggccggtgagaagaaagtgctacagcagattgatgacattttcaagcagagggaggaggaactggatggcctagagtactaccaagaacggagactcaaggatattggtttagttggcgacaatggtgaaattatcttctgggaatcctagagactttttattcattttctgagggtagagaaggttttgtaaaatgccactgtgcaatagcaaattaatgaaagaaaaagagaaaaaaaatgatattctagcacatgcaccttgtgccgtaaccagtgcaatagtagtagatgtttacggagtactccacaaagttggaattatcgccaacattcaaaattatgacttccactctaccagtagtcatatcacttcaattcctgaaatcaatattttccttcatacaaacaaaaattggacatcattgcacatttgcactagtacttgtagtgttattgcatttcaaacacgtcaaccgaacttttttttaattaaaaaagcctataaattgcgcttaaatcggttcaaattgacgaggcacatttcacattttggccactttgttacacatttgtggcagagtccaaactccaaactgtatcaaggtatttgtgggcgcttctctttgttcgatcgga

SEQ ID NO: 20891 - DNA, 19445 bp, Oryza sativa
cgacctcccccgcgcagagtccctcttcctcgccgcccccgcggccgagtgctcctcctccacctcgtcgtcgacgcccaccctggccaacctcgttctccgcgccgccgcgtcgtcccgcgcgccgccggaccggctggtggcactcttctcgcgcctcgtttcccgccacgggttccgccccaacgccttctccttctccacgctcctcgctgccctcgcggacgcgggcgccgcggcgctcccacacggccgcgctctccacgcccgcgcgctagcgtgcgggctagtgctgtccagtgggcacgtgctgaccagcctccttgatctttatgcggcggctgggcaactgggggaggcccggagggtgttcgacgaaatgcctggcaggaccgtggcagcatggaattgcatgcttgcggcgtatgttcggtgctgtgagatggacgccgcattgtggttcttcaatgagatgcctgggagagactctgtggcgtggacaacgatgattgctggttgcgtgaatgccgggaaggcagcagaggcggttgagctgttctggaggatgaggaaggcaaatgcgaaggttgacgctgtgaccatggttgctttgcttacggcctgtgccgagcagggagacctgcggctcgggcggtgggtgcatgcccatgtcgagcaggaaggacgacagtggcggactgttttgctggacaatgcactcatcaatatgtatgtgaagtgtggggctgtggaggatgcgcaccgcttattcctggtgatgccaaggaggagtaccgtctcatggacgactatgatctcagggcttgcgatccatggccgcgccgaggaggcactagacttgtttcacagaatgcaggagcgtcctgatggtgctactctgcttgcagtgttgttggcatgcagcaatgcagggagggttgatgatggacgacaatactttcagagtatggaaagattttacgggatcactccagggatacagcactacggctgcatggttgacatgctctgccacgggaagcaattgcgtgaagcaattgagtttgtggagacaatgcatttgcagcctaatgatgctgtgttgggcgcactacttagcggatgcaagagggaaggcaatcttgagctcgcagcacaagtgattgaaaggttgattaggctgcagccagagcgagcagctgggcaccttgtcctgctggctaacatgtatgctggtgttggacaatgggagcaggctgggaaggtaagagaaagagtagctgccctgaatgctggaaaacctgcagggacaagcagggtgaatccgaaccaatccagcatgttggtacatagcatgctggcatgagcccaattgattctgcagtttcgttaacaagacttcggaggaatctatgagtaagcatgggagcttgaagagaaatggcaagcacaaaattatttggtgttctcgtgaatgccttgggaaaaaaaaaaaaggttgagctggggcaaaagtatagcatgcattcctgatcttctggtgaagccatgaaattatgcagtagtgttgcttcttttcaggttagcatattatatgttcttacttacccttaattgtccgagaatcctctttttactgaacttatagctaaactgctaggaacatgtatatttcagtaaattatcgctcagaacttctgataatgagatgctttctttttgaatcccttgtttcatcttattaatcttgtgctcaaaactatttatgacaactcaggacattgtcataatggaataccaaaataaagtaatagcagaatacatacacaagctgatctaatgcatctcattcttgtctatatccttcctaggagatgcaaatcactattctgttccaagttaaaaaatgcttgaatcttctcttctgtctgaacctatgctgtaaattgttcttaatgtcgacaaattgatgtttgctaaattcctttgtctggcctcccgagtaactgaagtcaactacttttgatactagcagttcctcatatcactcaagaagcttgttacatgtaccgatgccaagcgcagcggcgagatgccatgcagcatggatatagggagtctctgggaagcaatcatcagcgatgaacagcgcgcctcctaacagagacgacatcttgtgcaggttatgtgccattctgagctctggttcaattgatgctctttttgcaaaggaaacctggcacatagaaaatgctagatctttagagaagtctagatttatgcagcaaatatgcctagtgatcgttgaaatgatgattggttttatttagccaatatgccatgccattaatattacttgcctccatcattccagtgtgaacaactgaaaccatcaaaggctgaaatggtaggagcaatgctgatgctgccattagtaatcgcgggttctcattccgaagtgctcttgataaacactgcacaaaacacaggcttgtcacaatggcatgatttgcatcagtcagataatgtaacaacaattatccatcaggtcacgaaaacttactacatccgtctcataatataagggattttgctcgtacaactacatgcatgggcaaaatgccttatatttgggatagaggtaatattgttttggcatgccttaagtcaaacatttgaaactttaaacatgcatatctctttatatatgtttagattggatcataaaaaatgtatgtagagattcattacggaaagcactttcataatattatgataattgtttgttgtaatagatatattgttatagaatatagtggttaacattgtatgttcaaaacaacatttttttgtgaacagagagtactagagtactccatccgtctcatattataagtcgtttgactttttttcaagtttgactaaattcatagaaaaatatagtactattttcaacacataacaaacatattgtcaaattatattcaatgctatatttaatgaaactaatttcatattttaaatgttgttaaaattttctattagctcggtgaaacttaataaagtttgatgcggaaaaaagtcaaatgacttataatatgaaacggtgggagtaataagtaataccgacgatatgacttaccaatgtagtggtggctatcatagtatagtctgcccaccgcaggagttttctgatttctcccttggaggaatggtacaagcttgaagctatccctactccgactagcgaattcgcatagagcgccgtgtttaagttcgtcctgcaaagctggtagcagccccgttagacgggaagcatagaatctaaaccaaaaagaaccagaaattagctagagtagctcgccttggcgtttgcattccgagaataatgaaggggagcgaggtgactacattagctatagtttcaccagcatgcttgtcacctgctcgcaggaaaattcagttagaaactgtatactgagaagagctatgttggtgcagctataacttggatgctttaccgcatgagattctacaatggacgggcttcaagaacgagggcctgtgctgccacaatcgcctgcagtttgcaacaacggtatatgaacgtcagactcagcaaaccaaagggtataaatttttagagagcttttctactgacggcatgttcacttcttatgccagttattttttgacgaaggccatgtttagtgcatctccaactacccctaactttcaaccttccatcacatcacatctaaaactttcctacacacataaacttctaacttttttttccgaactttcaactttcccaaaacttctaacttttttcatgaactaaacacagccgaaatggaattacctaatcggcaatctctgcagcgttgtgccgtccccgaacttggcttcagaatcagagattgccgagtactccacgacggtcgtcctgacagcctcctcctcctcctcgccgccgccgccgtcgcccggcgacggccgacggccaagctgcaccccgtagagcccatccagaactccgggagacggcttgacccccatcaatcaacgtacccgtgtggcgagcacagtttcacagcttgcagaacgagcaagatcagggttggccccctcctgctttgctttggctagcttcttcctcctctccggccgatgcggtgcagcagccgcggctagccggcgggaggaaataaatagtgcgcgtgtttgcgcgaagggggaaggaaaatgtggaatgggatggagagacccgtgtcgcggtgctgggttgaattctctcggcagtgcgcgagacgccaagagaacgggaggcgagacgatgctgattcccaccggatcttccgttggcgagtcccccgcgggctgcagcagccgggaatattctcgcccgcaaccgcggcatccatcgtcccgcgaccagggtgatgggctgatgatgaatgagcccggcccacccaaacttcgggcctgttcagattgatgtcattttaaaccataccattaatttggtaaaattaataattatgtagttacattgagagcttgtttggtttgatattaacttattgccctaccaaattcttggtaacttcaataatagcaaatgcatgtttggtcttgtcacaatagttcaaattcaacactacttaatttggtagtgtcaaagcttgccacggttttggcactatcaagattttggtagagtaaaaattagtttcaaactaaacaagcctttaactagttattaaatattggtgatgtaaataaaatttcgacgatagcctatcatttttagtattactactaaattttagaaatgttcattttttaccaatgaccttcaggaaacgaagccgggaacgagatttgtcgagagagagagaagggagaggcatctggtatgtcgctcgtcacgtcgtgccgggagacggggagacctggagctgacactgggctttggctttggctcggccatggccggcagagtagtagccgcatcggtaattgtttccgctgcttggggcagcgtagcgtcgcagagagtcgtagctgcacggagagacaagacggacacgcgcgcgatccgattcgattcgaagcatcaaccaacctggcaaaggtcgcgtctctctatcgcctcgatccgtgcctgcgttgcgtccagattggccgttgttcctcggtccgtgtttcagcttgcgtggccgactttgtcaggcgagcggcacggcagctagaccacaacgccgcgccatgggaatccttgtgaagggaagatgatttcctcgcttgtttcgtctttaaggttattgcccgcgcaagtttcatacgagcaagttttataatagggatagcgataacatctaattttatttaaattattattaatttagaactaacacatacaacaggttgccgacttcatcttttcgtttatacttatgtttatgtttatgagccaaagtttgaattttcaatcttaaatttggagttgattttagggttttctcatcgaagtttatttttcagcctttgcttttagatcactaagaacacatatataaacgttctattcacaaattatttttcgtttataaatataccgttttgcttattccctaaataagcgaaatgatagggccatgcatctatctacactactcccaatacactctggctgtgtttagttcacaccaaaattggaagtttggttaaaatttaaacgatgtgatggaaaagctaaaagtttgtgtgtgtaggaaagttttgatatgataaaaaaattaaaagtttgaagaattattttggaactaaacacgtcgtctgtaccaatccacttctctctctcattccttaaagattggatagagattgacctttgcacgagagaagttgctcattctttttccttttcttttctctcttgcacattatcttatggatctacatggtaccttggggctagtgataaggggcttagagcaggtacaaatgtggactataagccagctataaacatatatcgagaagataaaaaaagagagagatgagcaatgggctacagatttgtaccctggctttaagatacaatgtatgtatgacaggtgtgagcaaatactaatagtgtagtatatatttataggtaactattgtatcaattggctatagatgatttggagctattagttggactatactattaaacttgctcttagggtgtgtttagttcacgccaaaattataagtttggttgaaattggaacgatgtgatgaaaaagttgaaagtttgtgtgtgtagaaaagttttgatgtgatggaaaagttgaaagtttgaagaaaaaagtttagaactaaacaagggcttagagtagtgatttattattttttaaaaaatcagatcaaatttttcattgacccggctttgaaagaaagcccaaaacagcgaacagagtcttacacaggctgaaagtaaacagcaaaagcaaaacaaaagaacagacgccagtacaaagactggttctctctggaccactgctgcaaatcttacaaacacctcacagacttttcggcattgaccctcctaaacgcgaaacctttccccaagatattatcccacccgaaacaaaagcctacacaaactgaaaaacaacagcatcacactgaagcagggaggcagcacggcttcagccgttgaagtttagccatcagtagatcaccccatcctttcatagcagcttgatctccttcctttagcatgatacaccaccgctgaacaaaagacatagctttgtaagcaacttgtaagggagattttaccaaaatatttgagaacacccaatcattcctaactagccagatagcccagcacacactagcaaagaacatcacccacacaccctgaacattttcccctggttttagcctcaagcaatcccttatgtttgtaggactattagttagtcccaaagcgtctctcaccacacaccaagtaaacacagccagagggcacttaaaaagggcatgatcagtagactcaatcttgccacacaatttacagaattcatcccctccttgccatttccttttgatcagctgaagagcacaaggcaacctgcttagagtagtggcttataagtcaactataagagcagggtcaatagtaaagtagtcagttggctacaattatacctaacttatctatagctcactttgcaacctatacatacaatagttagttatattgttggtccttacacacttcacatcattattaaaaaaaaatgagagaattcacttagtacctttgaggttttccccacttctataatctactactgattttgttaagttgaacaatataccatcgtgttttcttgaacctctgcttcatgccatcaccgtcaaagagccgttagttggcatccttttgtgtatttaattttcttttagtgactaaaataacctttgacttgttgattgaaaacattagcacaccgtctaccccgacaaattgatctatccctgtctcccaaagttccagtgaggcggcgccgactccccatcgatgcaacgccgggactacccgacgcgccgccggccgctcggatgcccatcgacgcgcggccaggcgccaggctcgccatcgacgtgtggccgggcgtcgggctccccatcgacgcgggtgggcgtgggcggcggcggatgaagatgatgggtggtggtgggtgagctgcaggtcggtggcagcacggatgacaagggctagcgcggagaccatggcggaggcgttgtggtcggtgcgcgccgcgtagtagtactgcacgtacgtctccggcgccagagcgccaccgccgctgacgaccgcggcgagctcctcctcgtcctgctacttctgctttgctgctgctgctggtggtggtggcggcggtggcagaggcgcagctgtttgctgcgtcgacgaccacgggatcgagctgtggatcgatttgggctttggaggcagcgcgcggagacgatgaggattgaggacaacgtatgctgataagaacagccaagagagagaggagacgaggacaacgtatgctgtttttttttttgcattacgtacatttatttctactacatttatatagttcaatcagtttgacagtatatgcattcatatgtcgatagattacatacatatctccctggaaataaaatgtcagttaggggtaaataggtctttttatagcgctaacggatgcccaactaacggctcgtggacggcgatggcacgtagcagaggttcaagaaaacacgatgacatattattgaacttgataaagtcagtggtagattgtagaagtggaaaaaactcagtggtactgagtggattctctcttcaaaattgcagcattgatcccatgctgcaactgctgcaaagcagcatctctctcacgcccaacacttttgtctaaagaagcgtgctacaacccaacgataaaattatctcccgctcgcgcccactcacgttctctctcttcagctcttttctccatattagcattgcaatctacgtggacttggcgtcgtcgatattgtacctgctctaagcttatgtggaaaaaagatataaagaaaagtgaggagttggcacttagagcaagtttaggagtatagctgactactatctccaaatcatctatagctaatttaatagttcattcatataatagtttttttttcgaacggtcgatcgttgccaacgttttatataaagaaggtgccccattttaagggtaaaacggtgccaaaccttacattacgctcaattaattaggggaaactgagtgaaaaccacaactacaacaacccaccaactaacctaacctaagctaccacgacggagcccatcgtgagacatcggcaccaggcatgccatagaagcgacacggcaactcacatgtgttattgttaccgagcttgtcactagcgacacgacagttccaacttcaccttaaggaagcctcaacgccaaaaaaaaaaacaaaacaggttggactactcacaaaggacagcagcacaagctaccaaggagccgcttcctacacacggctagcactaacaacccaagatagagattgtagtgagtcatcgttgccaagcttcattgcaacccaacaacaaagcagctccgactttacccagcaaaaactaaaaagaaatgatggttactcgccgcaatgcaagaaaagaaaccaaagtggcgagggcctcatcaaacaccctaggcttgtagagtttcggagccgttgcaggaatccattaatgaccatcattgcacgcggttggtgttggaagagagtggtcagcatcataatgatgcctccaaggagaggaacgacgcctaatggcgtcgccgtcgtcaagccggcccaaggcccaagcaaggctttcgccaacgattcccaatcaaaaccccacacaaccatcttgtacaatgaccatcgccggaccaccgtgccatcccttcagtagggctgtcaaaaaaggtcgaggcttgcgagctgctcgagctcgacttgtcctaggctcgatttgagctcggctcaagctccagatgagccgagcccgagcctctcccaaatgtcacgagctttgtcgagctgagctcgaccttccaacgagcctactaatatataatttttgttgttacttaatttaaattagtagattaaatatgttatctgtatgccttgtattagcatcatatatttattttattcttttttcctcttctattaatatgatgaactagaaatagggatggcaatttcacccgcggggccgggtccctgcgggggtggggacaggtgaagatttcgccccgcgggtggtcggggtcggggccccggagttgggcgggtgcggggacgggggatgctttccacccgagggtgaccagcggggccccgatgagagtatatcacctcttaatgtacagctcattgcaagcacaagaagcccattgctgagatatataagcaaaaacctaaccctatcctctcactccccaatcctccacccggacaccacgcagccgccgcccgttgaggccgaaccacgcgcgacggcacgagtgcctcagtctccctctatcgccgcgtcgcttccgcctccgttcatcgaggggctgccaccacctccacctccgcttgtcgccgcaccgccaatgtctctgctctgcctctattcgtcgccgcatcgcctcctttcgtcgccacgctgccgctgtctccggaccacctccgctcgtctcggtccgtctccactcgtcgtcgcgccaccgccgtctccggtctgtctccactcgtcgccgtgccgccgctgtctcgctccgcctctgcctgtcgccacaccgatgcctcctgctgccgcacagcggcgcctcctcccgtcgcctcgccgactccggtcacctgcgggtgtagcgggtccccggtcgagtggcggggccccggaggggccggggacggggatcgatttcaacccgccctccacttcggggccggggccgggtggacccgcagaggagcgggggcagggctgttcctgcccaacccggccctgacccgccccgttgccatccctaactagaaattaattattttttaaaagattatccttgaaatatgcattgttttaattaaaaatcaagcttgatagtcgagctcgagcttgatcgagcacgaatcgaccctgtctgaaagctcgaacattttataggcttggctcgagctcagctcgttggcagccctaccctttagcgaccaagcccaacaccaccccgcagctcaagctggctcgatgggctgctcattagccagtgtcgccgccatcccctgcgcataagccaacgcctccccttttcctggagctccccacgatcaaacctgaaatggtcgggccatagaaggggaggagccctatgaagaagaggatggttggccagcaacaaagaaggcgacctccactgtctaactgcttccctaattattgccataagccatcgaggttatcactggcgaccggccaccaccgcaggcgacccgagctgccggccacggcctcacgccatgccggacatgccccgctggccatggacaagcgttgctcatctcgccgcctcgcacgccgacagctgcggtcgtggtcgccgttgccatcggttctccaaccagatctggtaggagacgccagatccggtgcaccctctctgcttgcatggaggccggctcctcgcgcgcgccgacagtcactgatgccctctctgaggctgccccgcaggcttttcctgtgccgcagcggctgccactgttgtggagggtcctgagcaggagagggaaggccccgccgctgttgtccttgtagccacacgtttttctggcggcgaggcgggggagggaggagtggtgggtggtgatggtggatgaaggtgtcgcccgtgcagcccaagcctagagcgacgcgggtgattggtccaagaccgtcattgtggtgggccgctattcatacaatagttacttataaatccattaatatatggttccacatatcatacacacgtaatgttttgcagttcatactgtagctgattataaatttgtagcccgcgattattctctcctctcttatctcttccatatatttttgtagctgccttgatgcttccgagacgctcaagcgaaacagtttgacagtcatctaccaaggatgaagacaagtacttacctgatcttgtcttgatgagttggacggaggagatggagcgttggatccccatcggacggctcatgtagcccaactccttcgttgccattagtgccataaagttgggactcacgcgactcccagcacaagctaaaacccaaaccaaacaaacccgtcgcatatccaaacagataaggtcgcgcgcgcgtgggccacctctgccgcgcaaaccaagcctctccatggacaccaccgcgtcatggagtctcctccccctggccgcctcctcgccgtcgcctagaaggaagtcggctcttctccggcgccacccagcggccaccaccacctcctccaccagcaagcggacgacaaggctcctctgcctcctccatgacacggtaacatccatctctcgaatctcccactactgcatgatagattttcctagacgccgcccctttttgtttccatgcggttcgtaagtggaaccgcatggaaaaatagggggacaggcaccgggttatcgtccgcacgggaaaacgcattatctcgtgcgggcggctttagccaactgcacacgaattttcgcccgcacgggacccaccgcttttaaccgcgcccactcgtcttcccctccacccgctcctctcctcccacctccctctctaccactcctctcctcccactctcctctcctctcctcttttccctctctcccggccagccggcggcgtgacagcatgcggcggcgcacggccccttcctccctctcgctcgacagcgggcgggaagaagggcggcgagagcaggcggcagcggccgaccatggcagcccctcccctccctcccattgcagatccggcggaggggaggcatgggggggcggatccggcggcgcgcccccccctcccctcattcccgttgcagatctagcggagggggctggcggatccggtggcgcgcggcccctcccctccctccccttaaagatccagtggaggggaggaatgggggcggcaaatccggcagcgcgtgccccctcccctccttccgcttcagatctggcggaggggggcggtgaatccggggacgcgcccccctcccctccttccccttgcaaatccggcagaggggaggcatgggggcccggcggagcggcggcatgcgtcagcggacggcgtggaggtggggtgacagcctcggcgaccggcggatctatctctccccctccttctctctttgttgtttgtgattctttatgatttgtgagatgcgttcttagagttgatttgttgctgtgagatgtgttcttatgatgtgagagttcatttgttgatgtgagatgtattcttgtgatgtgagatcattgtgtgtcgatgtgcgactacagatccagcgccggcgacgggagcgggcggcagatccgtagccggtgaccgcgagggcgacggcggcgggcctcggctaggtggtagaggcggattagggttagggttttttttctttttttttgattttttgtttttccgtgcgggcgacttaagctcccgcacgcgaaaatcacgattttctcagatgactgggtgcatgcgggctgctctcctgcacgcaaaaatagtttagcccatacgggataatcggtattgtagtagtgtccccgatcgatcgatcaggctgaggtggtttagggatggtaattttacccgcggggacccgcccctacgggggaggggacgggtgaagatttcgccccgcgggtggtcggggtcggggccccggagttgggcgggtgcggggacgggggatgctttccacccgcgggggacccgcggggccccgatgagggtatatcacctcttaatgtacagcccattgcaagcccaagaagcccattgctgagatatataagcaaaaacctaaccctatcctctctctccccaatcctccacccggacaccacgcagccgccgcccattgaggccgaaccacgcgcgacggcacgagcgcctcagtctccctctatcgctgcgttgcttccgcctccgctcgtcgacgggctgccaccacctccacctccgcttgtcgccgtatcatctccgcctccgttcgtcggcgcgcagctgccatcttcgctctgcctccacccatcgccgcaccgccgatgtctccgctctgcctctattcatcgccgcatcgcctcctgtcgtcgccgcgctgccgctgtctccggaccgcctccgctcgtctccggtccgtctccactcgtcgtcgcgccgctgccgtctccggtctgtctccactcgtcgccgcatcgacgcctcctgctgccgcacagcggcgcctcctcccgtcgcctcgctgactccgatcacctgcgggtgtagcgggtccccggtcgggtggcggggccccggaggggccggggacggggatcgatttcaacccgccctccactccggggctggggcctggtggacccgcagaggagcgggggcggggccgttccagcccaacccggccccaacccgccccgttgccatccctaaggtggttcgagcgcaagttcgtcgagacgtacctgcagttcatgttcacctactggctacctcttcttccccgggtgagttccctcttgctaccacgtatacttacaaagaaattattaaagaacaaaatgcggcaacttcgaatcgatcggtgaattgtgcagagtgccgagaccaatatactggtactgtaattacctttcaatccgagtctttattgagcatcaatgcagcaataataatcatctactagtgatctggtccatccctctgggcaaaaaagaaaaagaattatcttaaggtcttaaggagatagtaagacacactcctaaaatatacggtgtagaattttattgtaaaatttgacatctatgagtacttttcggaaggattataaactttctaaaaagaatgtagttttgttttgctaaggtgatcggagttaatatgcatgccactgccagattttgtttgtctgaaccaaataaccgtgaaactcaaaattgccatatatctcttgctgtgaatggcctaatctatactttctattagaagcaaaaactcaacatgcaagcatggcacatcatcacccactagcaattactattctaacccatttaaaatcccatggaagcataccacatcttcactcactagcaattactattctagcctattttaaatcccatgcaagtatgacacatcattgccaatctcactggaccgtattcttatcgaaacaaaatagcatttctttgtatggatttgtaaaacatgcatggtgccacaatcttcttggatgtatcgagcaaagtgagatctcacataaaagaaagggaaatgataatgatgcaatattattgtatactagcccaggcaccgaagcatatgttgtgcttgagaaaagattgctagataagttgcaggtgttggcaaaatctagtaactagagtagcagcctgtctttctgtttcacagttaaggcaccgttttctcatgatcatcttcaaaaatactttcatactagctttacacctaaattataagtgattaatataacgaacgtcccaatctttcattgtatactaattcgaaaaagagtagattgcagcttggtctagatcgagctttgacctttcacgtacttcgcacaatgtgatttggaattccaattggataaaaaccttgacctctaggagtgtgtaagggactgcaagtaaaagttctagatttagattcccatatgagtattttgcaattgaacgaagtggtaccagattacaggctgtcctgcccttagcagagttcacaattcgtttgaatttcatcacccaaaattctcccaaaactgcgttctcagcttcataaaatttgttagtctcgctggggctctcatttcaaccttaaaaacaagattgtaaaccctgtctattgtttacatattaaactgagggtgagtgaaaaaatatgccaaattatgggccaaaggcatgggccttgttgatttcactctggggatccttagcaaagatattgctttttgagttgggacattacccctccgtaggacatggcatatttgaggttcgctcattgctcaacaacttggcttgtaggcgtatcattggtttacccttgcccttgtcacctttggcttgttgatcgatggatcaaattgtgcttcaattatgacattgaggtttgaccttgatttagcttaaccctccctaatatagggttgtatagtactccctctgtcttctaatataagggattttggctttttcttgcactgtttgaccattcgtcttattcaaaaaaattgggaattattattttttttgacttactttattatccaaaagtattttaagcacaacttttcgtttttttatattgtacaaattttttgaataacacgagtggtcaaacagtgcaagcaaaatgtcaaaatcccttatattatgggacgaagggagtatggggcgaagtcttgtctccagcttaagttcatagtattattttagcatgttttttttttcatttctgtactaacaagataatatgcatcaaaataaattaccaaaattttctacacaattgggtaaatatgtaaccccccacccgggcgccgcctctaacaagttgctttggactttttaaagtccacattacataaatttggttacctaggtctttagtagtataaatttatgaagtaacgtgagtgcaatattataaaagctcttattacagtaaacttgaatataccatttttcatatagccaaaacctatattataaatacattttatggtcaaagttaacttttgttgactgctctaaaacaacctgtcttttttttactcgagaaagtaaactagtcaccaatctgtgcgtggcacatgcacgcacatgctattattgttgatattataaatattcaaattcgttgagcatattggttaactttgaaagtgtaattgcttgtaccaagacaagggtctacattagttacagctaactgttagtttccgattttagaattaaattagtaaaatactaaactgataatccaagctctaccatatttattaattactggtttccgaattatcaaattagagtaaatattattatttctaattgcatttatttgagatatacactccatgatgattttttaagataatataagcttttatctaactcaaccaattatatcaatatgacataatcgtacttaaaaaatcagagtataacctactatcataaataaatcaacggccaaaattcttttttaacatgtgagattctacaaagtgtctagttaatactccctccatctacttttgataaggcatatttccaaatctgaaaaatttacttttgataaacatatttcaatccaatcacctattctcttaatgactttcttagatttaatacgtggctctccattcttctatgcaagattggctacatggacatcgagaaatgtaaatattaatgaatcgcttgtttacaaggaataacgtactccctccgtcccaatatgtaacaacctagaatgggattagatccatcctagaactacaaatctgtacatagagtatttctagattctctattttcagattcgtagtcctaggattggtctaatctcattctaggttgctacatatttggacagagggagtagcatgtttaaatagatgataagtagaattacttattcttggtcattgtgccaagatgaaatataactatcaaaagtagatggatggagtacgtctttacaatcatactaactactcactccttcccaaattgatcatcatatatttatgcatcaagaccaaggataatttaaatcgcatcaatcaagacaacatgcactagcatgcacacattctcccatactgcattaattgtattataataaaatccgtgtccatgcggttatatgatgatcaatttggaaaattttaaatttcattgtatgatgatcaatttggaaagaagtaatatatactactatcttatcaatttatagctttatagctagactcgccacaaataaccggcacttgctatatccttccaattaatgtgataattttaccaatgaatatagatacacttttcttactactactttcaatttttaagatggtggaaatggagtactactttactggtcccttttaaccgagtaaaaagaatacttttgacgaacacaaatcatcgactagcttgttggtgccgtaactcatggatgcattcgcgggtctacctagcgcggtatgatcattgcagcacatgagccccctgaaccggtgcacagctcaagcaaaaaaatttgtactactagtcgcactatgcccctacacgtctttatttcttttgctccctccttgttggccgaggaaaaaggtttaagggagaggagggtgctttgtactaggaaattttgttccggggaagaggagcaaggaaaaagtgcctggcactcacgtcataatggcgttgtgatgatatcaagcgcacgcgggacccatatgcatcacccatccagtggtgtggaaaatatactgaaagattagccttggtagtgctgggtgactgccaccatcattcccaattcaacatccccccagcaggatgctccatgatccatctgtccatccatccatccatctcaccacccacaaacactcagcaaaaaacacttcacattttgctccattagtggtggtcagctaaaggtgtgtaaactactcgagctatcagcattttgattgtaataaatcggttcggagtcgttcataccatgctcaaaagatttgagggagtgatgtgtcgtagtggaggatgatgatctattgatctagtagtgtggcttaaccagaagtcgacagcctcacgagccaacgcaatgatgcgggcacatacgaattgggacaaaaaaaaaggccgtgaaaaggactagtaacacgccgtcgtacgagccaaccatccaaacagattaaccaaccaaacctttctcccctgcccaaaaaacctttctaacgcccggccgcccacgagacgacgtgagatggcacatttcggccggcgcgcgcaggcgattctccgttaaaattttctcgcgcagcggcagcggcagcctgcggggggaggagggacgcaatcattcggtcgcgcgcctctcgggcggcgcgcgcgggggggaggagggacgagacgaaatcactgcgcggccagggcacgcacacctgccaaaaagccgcggccacggccagcgcccggacacaatcacgcggcgtcaacagaaccgtgcccccgcgtgcatgcacccgcaacgcctccctctctcgttggctcgaacggctcacacacacaacacacaaccgtagcagcagcagcatccgtagctgcgtgcgtgcgtagtagataggcggcgtggcgtgcattggcattggcggtggcgagatgtcaatggggggaagggaaggggaaaacgcaacgcatgccccggggggggcatcgtgctgttccctggcgctgcacacggggccttttttctattgactgtttggcagggctggtcggctttatactcgca

SEQ ID NO: 20892 - DNA, 30866 bp, Oryza sativa
gtcaaatcactaccctccagttcggctgcgctttgcctgcctgctcgagtaggggagtacattttgatacagcgaaagaatcagaataccctgtcattgcgttgcggtcaaaatgttgggcaaagtgacccaaattatattagttggggagggggagggggggggggggtctatggatttagcagcaatcaccgttcctgataaagtcattggacggggataacctagaaataatttcactttagtggagaactttacttccttccgagagataaatccctttctaattgctacccctagacactcatcaaagtatactactccagtactactgctactcgccattttcaaaacaatcgaaagcagtactaaccgtaccacattatttgtcgctttaaattttttataatgtttaattattcatcttattaaaaaatttaaaattattatttatttcgtttatgacttgttttattataagagtactttaagtatgacttattatttttatatttgtattaatttttcaaataaaatgaatggttaaactttacaagaaaaggcatctattatggaacggaggtggtagcagcaagaacacgtaggtatatgtaggcctgctgagccctcgaaacattgatgccagatgaccaccatcgatcacgagacacgtatgcatgcaatgtgtatacatgtgtttcgcagtcgtagagcacaaaaaggacagtagtaacaaaaagaaaacactttaagccagaggcaaaaaggcaagggccccttctctctagctcaagctacactagccagcgccgtacacgagcccccctggcctttgcctccctcgccgtctcgatcgaccactacccgcggcggcaaaagcacacgataaaaaggcccccctcctcctcgtctcctcctccgtaaagccatcacccgtttgaccgagagagagagaacgacgtggtggtgggttgggtgagctagcgatgtgggaaggcgggagccacgacgccgcggcgcagctgctgccgtggttcgtcggcgagccggcagcggcggcggtggggggatacggagggtgtgtcgacgtggtcgggcagggcggggtgttcgggttcggtttcgaggccgcggcggcgccggtggtaaccaggcagcagcgtggtggcgcggcggcggcggagggatcatcgagaggcggtggcggtaagccggcggtggtgtccgggctgctcggcagcctgcaggcggagctggggcgggtgacggcgagggagatcatggacgccaaggcgctggcggcgtcgcggagccacagcgaggccgagcggcggcgccggcagcgcatcaacggccacctcgccaggctccgcagcctcctacccaacaccaccaaggtgagccatgcacgccgttgcacccatcgatcgatcatccatacacacgcacacagttgcactcacgtacgccattttggatcatctctatacacttatcgcaatataatccgatctcgatttgattccggctcgtgtccatggctaaacaccaaatgaacaagaaatgcaagatccataatagagaagtaatttccagggttgcgatttttttttctttttcttggttatgaactttctaggattataatcttgtaatttttcttctgctctatcaataaaaaatatgaacggacttaactttgtctagttaacgatgggctgggattagtagctagctagtactagaatagttttgtgatgcttagtttatatagtactagttctttgattgcttatctagataaatctgacaagaaaagcaaatagcagaaactgagtattatcatcatagattgcctgaaaacaattagtatagtagtaagtttcagctttcttccatttagctaatggcatatatatcctgggagttgctactctaataggattgggccatcgagcaaatatagtacggagtactaagtggaatgaacacatggagtataactaatcaaaggataaacaccactaaccaggtggtggtggccattagttagtggcaaatgtggaaggacgacgcggccactgcacgcgcgcacgccatatgtgctcccgaaccccctgacaagacaacaaggggacaaaaaatatttcattcggcgaaaacgctgcctctcttggacactgtacacactgtacatatgtctgtgtgtgtgtcagtgtgagcgttagccatacactgttgtgtcagaagcttagaactccaacctagcgttcgtaaagctcaaaaagacatgagaaacgcagtgagaaaagctgcacatcgcgccacgccgcgcgcgtctgtatgtcttggtttgcgacgctagctcacacgcgccgatggatcgatcatttggtggccacggcgtgcgtgcgtgagtgctcgcttgttgatgagctcgtacttacgtcagtggctagatccagaaaatcaattcgttgttgttgtgatactcataacatgtttatcaatgttctagtatgctaattatatttaaattatggtgttataatatatgaataaacagttttcctgtaggttttaccgaaaatcgtcggtgtcctgatatgggcctttctactgtatatccgtccctgacttacgtttgtggttgtgatattgtatgtgtgtgtggcgtgcagacggacaaggcgtcgctgctggcggaggtgatcgagcacgtgaaggagctgaagcggcagacgacggcgatcgcggcggcagcggcggcgggggattaccacggcaacgacgaggacgacgacgatgcggtggtggggcggcggtcggcggcggcgcagcagctgctgccgacggaggcggacgagctggcggtggacgcggcggtggacgcggaagggaagctcgtggtgcgtgcgtcgctgtgctgcgaggaccgccccgacctcatcccggacatcgcccgggcgctcgctgcgctccgcctccgcgcgcgccgcgccgagatcaccacgctcggcggccgcgtccgcagcgtgctcctcatcaccgccgacgagcagcagcagcagcactgcgacgacgtcgacgacgacgaggacgggcatcgcctccttcttcgccacggcatcgacggcgccggcgccgccgccgacgacgacgacgagtgcgcggcgtctcaccggaggcacgagtgcatagccacggtccaggaggcgctgcgcggcgtgatggaccgccgggcggcggcgagcagcggcgacacgtcgtcgtccggcggcgctgtcgtcgccggcggcggcgggggcagcatcaagaggcagcgaatgaactacggagtgcacgagcaatgctcggtgtagcgtgacacacactagttgcagctaacgtgccggcattttagctagctaccactttccatgcatggcgtctatgacgagaaagtagcaaactttttagttatttttcaagctttcgggttggttttgggagtagtagtggtcctttggtataacgagagcagctgcttcatggtgcgaaagggaaaagttttatatgtcccttgtgtgtgttgttgtgcacacatgcgcgtgctacacaaattaatgcatgtgtgtgtgttgggaatgacttggatatgtaagggtgcaaagcagctgggggccagcgagtgggtgtgtaaatctactggtggtatctctcttggggtatatcaacgaaaggtggaattaattggcccgcatcgtttttagatttccttgtgaagtatatatacatggcttatggaacaatacatgaaagtgtacatggatctctcacactccaagcaaactagagtttgttcatggatttaattaagagtggatggtatagttgtatatgctcgaaacactactaaaaatatatcattccaaccggcaccacgggagcagcactgatgaggaggattcaaaggtgtcggtttaagaacgagcacaattcgagccaagccgacgcttcaaagccaaaaaaaatataaaccaaaagctgtaacagaaaaaaaaagacaagtaaatatcagagaatcaacaagttcatagatcacataatcaaatattcacatcaaagaattaacaagtttatagagaaagatcacataatcaaatattcacatgagagaataaagaggagccccgggcggttcgctatggcaacgtcacggaggagcagtacgtggcggtgaggggggcgaggatggcgatggcgctgtggcgcaagaggcgtaattgatggtgacaggcgccagcactcctgctccctcacccgatgaggacgacggcgccacgcttcctcttgcgagggcgtcgtggcggcggcgtgcggcaaggggggtgaggacggcaatggcactgtggcgcaagaggcgtggttgacggtgacgggtatcgacactcctcccactcccccacccgatgaggacgacgatgtcacggggtgcccctgaactggtttagccctatcagcgccgcactaccccttgcgactctatcggccttggaggtggaggggaggaggcggcatggtgaatcgtggctggtgatttggggaggagacgagacgagacgagaggagaggtgggggatgtggtggcttggggaagaggaaggaaagggagaggagcacgggttggacgagaaaggataagaaggaagcaaaaggggataagaaggaagtgaacagactgagaagataacgacaagagagcggaagacaggtgtcggttgtattaaaaaccgacatttttatctcatataaaggtgttgttttttaatagaaaccggcacctttctctgacaagaaatataagtgtcggttccatttaaaaaccgacaccaatttgtacagaaatgtgctagcttttgccgctggcgtccacgcggttgcgagtgggcggaaaaagcactataggtgctagttttagctatttcaacacctatagtgccgtctcctttgtggtattctgtagtagtgaaaatttgtagaagccattgttgaagcattgaagaatactgatacgaaatctattttaaactttttctttaaacttctaacttttttatcacattaaaactttcctacacacataaacttccaacttttccgtcacatcgttccaatttcaaccaaacttttaatttttgcgtgaactaaacccactcatatttttacgactcgctgctcaacaagtccttgtatgtacggtacgccgttaggacgttccaaaaatttttccatgaattaattttgttatcaccatgaacaggggaaacgtacataaacgaactttctgcctatcatgagcttatcagctcgtggttagcctcatcgtagacgataataaagcgtcagcagaaccccaagtgtccaagcagcccaaccaagcagtagtactccctccgtttcacaatgtaagtcattttaatatttctcatattaatattattgttaatgaatctatgcatatatatttatctagattcattagcatcaatatgtatgtgggaaatgctagaatgacttacattctgaaatggaggaagtagtaataaggtctagtttagttcctaaaattttttctaaaaacaccacatcaaatctttggacaaatgtatgggacattaaatatagattttaaaaaactaattgcacaattaggagaaaaaatcatgagacaaatcttttgagcctaattagtccatgattaaccataaatgctacagtaacctgtatgtgctgactgattaattaggcttaaaagattcgtctcgtggtttccagaagagttataaaattagttttttcattcatgaacgaaaactacttccgatatccgatcaaacatttgatgtgacactaaaaaaaatttccacgaagtaaacaggccctaagccaagctggccgttgaacattgcagctaaccttgctgctgacaacgtactgtatcgattcctgcgcacgcatcattgatttgcttggctttgctggtggtgtggcgatcttcgatcacttggcgcgaacagaattaaaatgtcaaaaagaatgacaaagacggtggcaaatcatggagcgtcgaacatagctgcgcacgccgccgacccactcgcctctgctcctcgtgcgtccttctgtctcacttctcatcagagagtcacaaaaaacattctcccatgacggacccaccgcgtctaccacaccagtccaccaacaccaccaccaaaggaaggaaaatccggaaaaaaggagcatctcgttgacttgccggtgagtacgtggggtgggcggtacattgtgcccgtcgttttctctcggcgctgtcctgccaagccatatgccattctcacctctccaccatatcgggtccatgcctccatggccactgagccaaacgacggcctgcctaccgcgcgagcatcatctcggcccatccaccagcgcggcaccggccgaaacagcggcaggcctcgccacccaagcggcccacgcatccgcacgcagaaaatcgcgcgcatggaacggagcacacgccacgggccgcgccccagccgcgcgttcagtccccctccctgcctctctatttatacatagggtatgttggtgtttgaaactcgtagataaagattaagattagttaaattttaattattataaacttgaaaaatatatagaaagttttcgcatgaaacacaccgtttagcagtttgaaaagcgtgtaatgaataaccaaattttcatccaactttagttggagaaaataacggggcctttgtatatatattttatatacatatacatatacatataaaccttctatatacatttgtagaaatatgtatacatatacatctacaaacttcgtatatataaaatacaaattttatatgtataagtataaacaatgtatgcatatatgtaagtttgcatgtgaaagtataaatattgtaatgtacatataaattttacacgtataaatttggaaacaaattcaaaataaaaaagttgaaaaaacaaaatgggtcatagtacctagcccatgaaaaaaaatcaagcccaaaaagggaaaaagaaacgtaggctaaaaaccaatcaagattcaaccccaaaaagaaaaatgcaaccggaaaacaagatatatgagatccctcaacttagaaaatcggatcactctgagtccctagatggtattcacctcaattttgtctgacgtgacggccgagtcagtgtgagacccacatgttatggtgaccgtgtcatcaccctctttctctcccctcttccccttcctcctctctctcactcttctcgtcgtctgggctagctgaccggggggcgaggcgggagaggagggtgttggcaaccagcgataggtgatgcagtggcggtggttgcagaggtcgcaggcgtggaggagggtgtcggaggccgacaatgggcgacgcggcggcggcagtgacgtggaagaaggggaagcggcggttgcaggggccgcgtgcgcggaggaaagccgccgtctcgatggcgtagaaattggcagagttccgttggagccccgctgatctcttccccaccctccgtccggcctgcccagtcgagaagagtgagacagaggaggaagggagagaagattggaaagagagagagttatgatgtggtcaccctgacatgtggggctcatgtggatcccatgctaactcgaccgtcacatcagataaaaccgaggtcaatatcatatagggactcagagtgacccgattttataagctgatgatcctatatatatatatatatatatctatttttttagagacgattttataattcaatgatcagttaagagatataagatgtactttttccatgaaaaaaataactaagcccatgtttaatactccaaagtaaagtagatggatcgacaaaacctcatcaaggcaaaaaaaacgaaaaaaagcagggtgatcacgcgcccgggccatcgtcaccggggtagcataatgggcgggtgatcaccttgggcgatcaacacccccgtccctcccctaacacgcacacgtctcctcctttctccccttcctgccacactatatatgaaattcaaaccaattaaaaaatataaaaagaaatctagtacacttaaaaacatattcatgtgaataaactttatacttataaatatatatacagaaatttcgtacatataaactttatgtatagaaatattctatataaaattatatttgaatctaaattcgaatttgaaccgggtatataaacttttaactataaactttggatgtataaactttagataactttgggtatacaagctttagatgtataaactttgatgtgtaaacgtgactttatgtatagaaatattttatacaaaaaaatatatttgaatccaaattcgaattcaaatttgaacctggtatataaacttttaacctataaactttgggtatagaaactttagatgtataaacttaatgtgtaccaactttaggtgtataaacttacaaaaacataaaagtaatgtggtgaaaaaaaaaagaaggaacgtggggagggggctgatcgccgcgcgttagctattccgatcgtcacctgggcaaaaacagaaagagcggccagggtgctcgcgcggcgggtagccgcgcgcgaatttagcgaattcggccggctgctccgcccgcgaagacgacgtgcagtgcagctgccgggggagaagaagcgtcactctcactcacatcggcggagcagtggctgtgggcgctatatatatgctgttacagcgtgttacatcgatcgatctgcgcagatgcatatggaaaagttattcgcagctggagtaactagctgtggcagtgacctatagtgaggggcgaagccaggataaatgatcgcaggggtcattactaaccagggtctatgttttcaaccaaaacggattgaaaacaacgcaatttcgatgttccaacttgggacaaaagtagattttgagtgaaatttggaatagtttttcaagaattcaaattttaaattgtaaaattaaaccaaattaataaaaaaaaacaaattttggtaaaaaaaatagagcgaggttaccacatgattaataaagcattattagcttataaaaaacttaaaagacaatagattaatatggtttttaaaataatttcctatagaaattattttgctagggaatttgaaaagttatgagccgctggccttatgcatagtctcaaatctcaaaaactcaaagtatatgcatattcggctgacgtataatcataaatgctaggtaattttctatttgccgctgctagtatcgtttctagttgtcaattggaatttaacacaacaatcaacaattaatgtcaccggggtctaatatttgttttcaccggggtcatagctggtaaaataaagaggatatgagaggttaaaataaaatcatcggggtctactgacgccggtaattgactgtaccttcgccactgcctatagtggtataaacatatgtgcgctagctatagataattaatagacctttttttttcagattgtgtaacagtggttttgacgtacatatatactcctttagttttaaaatatttgacaccgttgactttttagtacgtgtttgaccattcgtcttattcaaaaaatttaagtaattatttattcttttcatatcatttgattcattgttaaatatactttcacgtatacatatagttttacatatttcacaaattttttaataagacgaacggtcaaacatgtgctaaaaagtcaacggtgtcaaacattttgaaacggagggagtatatatataggcagtgtttagatccagggataaatttttttgccgtgtcacatcggatatacggacacacatttgaagtattaaacgtagtccagtaacaaaacaaattacatatataatcggccggtaaactgcgagacgaatttattaagcctaattaatccatcattagcaaatgtttactatagcaccacattatcaaatcatgaagcaattaggcttaaaagattcgtctcgcaaattagtcacaatctgtgcaattagttatttttttagtctatatttaatacttcatgcaggtgttcaaacatttgattttttttattttttttagagaagggtattttctacccggcctctacatctaaccggatatatacggccattgaaatagggaacttagcccctcaaataacccaaatagggaacttagccccgcaaataacccaatctgaaattcgctccataggagatttaaactcaggaccttgggtactacttaggtcactgtaaccactaggctacatgccctttcgttcaaacgtttgatatgatagggtgaaaaattttagagtggaatctaaaccaggccttagtaaaaaacgggccggggttctgccatgcattgtctctgattagaaatttgcacaaatgtgatcatatgaatcaaagctaggattcaatggtatgtacggtggttacgtacgtcgtcggatatttgctgatttagggcatgttttgtttattagttttcctaatccagctatactaagctacttcctccatcttttaagcacaaccacgtaagtttttcttatccaactttaatcgtcagttttatttgaaaaaaataaaatatataaatcacgcataaagtactattcatgtttatcatctaataacaataaaaaaataatcataaaaaaatttcaaataaaacagatgatcaaagttggaaacaaaaactcatagctacgtttaaaatgggacggagggagtactacatatcctttttaataataaataataccattgacttttggatacacgcttgaccattcattttattaaaaattttgtgtaaatgcataagatataaatcttgcttaaagtactttagtgataaaacaactcacaacaaaattaatgataattacatataacattttttaataaggttgtattatttcccttggtttgaatgaagattttcattacacacgaaacaataaaaactcattagtaaactcattggatgaggacctcactgattcgaatataacaatacttatgttacacatcgacaagctaaaggtgcatatgttcttatatcagatttacttattatatgcttgaagaaatgttattgcaccatgagttttgtaccttctcgtttgcagaaatacacttgtgtgggtgaagaaaagagaccgagcataaggaacacatcgatgatcaaataagttgattgaagactaaaccaaaatatttcttaagtatactcctacatcaccgcatcacttttggcctacacagaatgcaaaagattaagttctgcatattttggatttgattcgaacctcccgatagtattaacttcaaatggatttagttgctgatccagatggattcttgagacccatgaatacttgttgaaaaacttgtggagtctattttcatatggttttggtcccatgtcaaaatttctccttagctattgggaatctacaaaacaaaccacatacatcatctagtctgagtctaatttgagtcttggatcttgtaattatgtcctatgctaagcaaggggtggacgacctagggctaaccctaggatgtccctaatcatatttattcagtagacacctgttaacgactaaatttgtcaacaacaccatagtttagagttggatttgcttagattatttctgctattgcagtttcgtcgcaagtttggtttgtaaaacctcaactttgagatcttaattattcatctgcaaattgagttgcaatataccttgttcttgtttgtgttcttcgatccgtatatagggatttgtcttctcggcgaggtcaatcgggcagcgcacgattgataatcagaggagacatgggttgagtactataggggaaaacttattgctacttggccgggtgcagagtaacacggatgctagggaagcagtgcaacactagggtcaagctaactgctagataaaagaaattgtcttagtggattgcactttgttaatttttccattgatttacacataaggtgcattttgatataaaaagtcaaactttgtagattttaactaacaattagtcaaacaacaaaaacattaatatataaatatgtaccaagatttatatttcaaagtgtgctttcatacaatattggttttatagttatttaaaatatatcttatgagatatctatgatcaaattactactatattgaagattatttaaaaataaaatacgttacaaggaggtaatgatactttaaagcacgtttgggcctctaggtagtctcaagctatcttaagttcttaacaatatgttggaattgctataactatcctcacttttcataaattttttttatcgacgccttttcaaatggctggatataaataacgcattaatttgaaggacattaataagactagtaacatatgcccatatatactttgtaatttggtcatgcagtaaggattggttatatacgtggattgagactggagcaggtccatatatatatatgattgggattggttggttggatggattatgataaattaaagcactggattggttgtgggtacatgaggaggagggggagaggacggaaagaggacaactccgcttttaaattagtggagaaattgccatgcatatatacgctaattaatgactcacaaaatgatgtagaagctgaaaaatcataacatctatttttgttttggcaagcatttcaataatattgacaaacatgtgagaagtgacactttgtaataagacatactaccaaatcaaataatttagtgcctacatatatagcaagaacatgaaaggaataggtgaattcggtgcaccctctgaagcctaaaaggaagcagatccaatgcaacatacaaatcgtagaccaatgaagcgttcataaattcttactcctatctctgtaaagctagctatatattctcgtcattagaaaaagagtatcaaaatcgaggacatcgatatcgatcggaattaaaggtaggttgcgtgcatgcttggatcatctgcaaatatagatcgatgcaaggctggatgttgcattgactacgacgacgattgagcaagaatggaagcaagctggaggctaagctgctgcagagctgatcgatgaacagatcgaaatcgaagcccaaaacacggggccgagcctacgcacgtcgcggtgctctagggttgctccgcagctgttatataggacgccgacacggcacagatatcctccccggccgtactgcctgtgcctgcatgccatcagatcatcagcgggagacctggctttatttatttcatccaacctccctccatctcatgtgtccccaccacctaggaaacgatttattagctactcccggtctcgtaaaaaaccaacttctggcaacgtagttagaagttagttttttatgggatggatggagtagttttcatttcggtatgaaaagggactttaatttggaattgaaaacccatctttcttttcgaattctgaatggattttatttgaaattgttgaaattttggtagacttcaaacaaatttaaagtttgtttggcatggaggcacaccatgcatactggggacatatattgctgacctgaaattttggaaattttgttccgaaattgtgaatactggatcaataattatatactccatttgttgcggataactgacgctacctatatattttctatctctattgtattttgatcgcacattgcttttaaatgattgggtttcattgatcaaataacataacatattttcaagtatttataatttctttttttaaatggtcaaagtatgaaattgaacagtaccagtttcttatgtattagaatacagaggtagtaagattaggtcccctatgaatatatttgtggagggttggaatctcaggaaattttgtctctgaggtcatttggaacaaaggaatatgatgttcaaattctttgttggattgcgcgcctccctatgaagcaacgagataaaacaagtcaagcaaacattaactgattatatattaagatcaatttgatccattagtgaatcaaaaataatactaggtggagtaaccgaaacttcaccaccttgcgttgtgtaactgaaactctgttttcttctaatataatgacgtgtaattttttttatgcgttcgcgaaaaaaaatactattaaagtaataagacgaacatcgaagcaacagctgccaacctagatggagatatatatacatatgtgtagcgtgtctgccagtgttgatcgaagcgcttgatggccggccgcaaagctacagtggcccagatcgcgacgacgacgccgccatggacgacgtgccggccgctgtccatcgatcgaggcatgcagctaaataacgcgctacgatcgatcgatcgatggtaggccgaagcccatactccctctgtcctaaaaagactcaattcctgggtttttatgtacaacgtttgactgttcgtcttatataaaatttttttatgattagtatttttattgttgttagatgataaaacatgattaatactttatgtgtgaattatacttttaaattttttcataatttttttaaataagacggacagtcaaacgttggacacggaaacctagaaattgagtttttgggacggagggagtacgcatgtgtacaagtcttgtcgatccattcatcagtagtaatcagttgtagtagtagtacactagtactgcatgcatggcgaatggccggctatctgtctctagatggagatatatatctgctcatcggtgagagtgtgagacggtgaccgacgtgcacgtactactgacgtacatttcatataaacaatttgcctagctcgatcgatccatcatagagagggcaccacagtactttggcggcaacgtacgggtacgtattacccaatcaaatcaaggatgacggactaaagcaaaccctacatgacgacgtaattaacttcatgctgggctagctgaccattattacttcatccgttcataaatatatgttgtttagcagtaattaaggttacgaattgaagagaaggcttttattgtacccttcatttaaatgaccaaccaacaattgaagcgagataagaaaatgttaggtgtagttcagatagtgaaaaattttatagtccttatatttatcgataaatttaaaatgcttggaaatttgaatgcttctgtttatgtacagagggggcagtatactaaggccttgtttagttaaaaaaattgtccaaaaacgttacatcaaatctttggacacatgcatagaatattaaatatagataaaaaaaactaattgcacagtttgcatggaaatcccgagacgaatcttttgagactaattagtccatgattagctataagtgctacagtaatccatatgtgctaataacggattaattaggcttaacaaattcgtctcgcagtttccaggcgagttatgaaattagttttttcattcgtgtccgaaaaccccttccgacatctagtcaaacgtccgatgtgacacccaaaatttttcttttcgtgaactaaacacaccctaattgatcatgcgatcatcatcacgtgcattaattgtaggtatgacatgggtacgtgttgtgatgtattccctatgtcccataaaaataaacttagtatgagatatgacagttatatagtactgtctagattcatactattagaatgaagggagtatgtactatgtgtgagtacatccttttgtcgaatattaggccttgtttagttctcaaaaactttttcctgaaaaacatcatattgaatctttggacacatgtataaagcattaaatatagataattaaaaaaactaattgcacagttaggggggaaatcgtgagacaaattttttgaacctaattagcccatgattagacataagtgctacaataacccacccacatgtgctaatgatggattaattaggctcaaaagatttgtctcgcggtttccaaacgagttatgaaattagtttttttcattcgtatccgaaaatcccttctgacatccgatcaaacgtccgatgtgacacctaaaaaatttcttttcgcgaactaagcaggtccatataactcaatcttttttgttctattgaagaataacttgggtgatctattaattcatgcagctccatgctcctagctagttagctctccatcgatctctctcacctgtcacgagtttgattaatttgcttcaagtgcatgcgtgctagctacatatgtctcgtcagttcaagggaaacacacacattctgagctatatatgtagtatcatgcacgtatctaactttatatccctctcccagacactcagatcgatgactcacactcacactagagactagacaccttttgtcattattggcaggcaagacagaaatatatcatgtatgagatgatttgcctttggattgctcgctagattcttaatgtgattacttcggccatctttgatcatatgactcaatttgtgtttggaaatcctttattttcactttacttcaaaaggggaacatttgatgatattttaattaactttgtagtagttttcaaacaacgaataatagtactttgaattttttttttcatatgatctcatattttacaattacgaatgacattttatccatagatttttacaaccaaaattcaattttggagactcattgtttgcattaagtacatatggttaaaaaaatcaatgggggaattcttgttaatttttttttaaaaaaatacttataaactttatgtacaaattgaagacagagttcaagctaagaaatatagaacatatagaacaacaccatccatacggaaggtcaaggcaactagactgaggaaacttgattctcaggtatacaacacgtaaaaaattaatgttactagttagtaagatatgtcttgtgataaaataggtcttgactctcaggtatacataatatgtataattttccaacttaattcacatgattgacctatgcccataaataatttcattcaccgtgcaattcaatcttcttttaggaacatgatttttttttcgagaaggaacatgattttatgaacgtagtatttgacaatgtataagccatacattgattttatttacctagctagcttaatttacgaacatatatagctatggtagtagctatggatcttatacattaattgaagttaactcctaaaaatgtacttttgcaactatataattcctttatgaatggggacagaatattgcgatgcatggctagccacgctcaagtatgcatttagaataagtttgtagggaaacgagtgaggttactatataaagaaaaaacttataataaaatagaatgattatatgtctggtgtaaattgagataattaggagttaattgatttctcaataattttcctctacatgcatgaatatatatatatatatatatatatatatatatatatatatatatatatatatatatatatatatatatatatatataactttattattgtttatgattaattatacatcatatgagattatatgtatattcgttacatcaaccaatattataaaactcaagattggtagtcccgcagaattttataacacatcattatatacataatttattttaaataattaatagcttaaagtatacacggcacaaattaactcaaacaaaaaagaggtataacattggagatgatgcattagtttagcactatatattcagttataaaggactcatcaaatagctaattaatcacataaagttgtttaattttaacatgattacccgctaaactctccaaacgcatgcaagaaatatgtgaaacattacttcacattttgttgatttaggtcactgtgacaaaatagtttggccaatttgcatattaatttatatatatgtacagaaaataatttggcttaagctagttagccctaattgagcttgcccaatgtgcagaaaataaaacaaaacatgtatatatatgtggtttcaatctttgttcttactaatatttgcatataactggaaatatggttattaagtataaaataacacaaatatattctaaacaacaactcctttgtcctatatatctgatggaattctaatatacttatgcatattgcagcaaattggaggatattatatgcatggttttgtcattaaaattgctttgccctgatattaagaaatgtcctttatgctaaatttcttcttcgatcgatagtggcagagaaacccagagtctgaacaatgaagttaattaatcccaaggttttgaacaggagtgaatttttaaaattattgtcgtacatattgaagttaaattatattaatatgtgaattttctcttctttcctttatagtgacggattttgagttcatggaaggatcgaaacaagactcatttgcctatcacctcacaacccacaagaagcatatatagtttcaaattgtccattttggtttaatttcatcacttgtatggataattggatacttttcaagtactgttactcttacctgaataatacatgtacgccatgctgtcacatcatatccttgctgaaccaaatcttggaatcatttaactaaacgattatcttcacacgcaatcagttgtcatctcatgagagatccgtatgcagtcaacacgaccaagtcaacaactctctagctatagctagctaattaaccatatatatgacgactacttcaagacaaaattaattaagcttactaatctctcctaaattgaaaacaccaaacaaacaaatcaagccaaatcttacaaagcttagacagataagcaaaagcgagaaattaaaattaaagagctgcatgaaaccataagattagtcgacatagtactaagtacacatgcaaattaattaacaactagaagcgctgaaatgctgggcagagtagcagatcaagacctaatcaatcaatcaagctgcttataagctagctaattaagctgctactagctagaggagaaaccatgcaagcaagcaagctaagctagctgaagctaatattgcataccgtccaagaaatcgccgtcgtcgtcgtagtcgccgtcgtcgtctccttctcctccggtgttgttgctcatcatctcggcgagctcgtagtagtactcgccgagcaccggcgccggcacgaggcggccgagctcgcagccgagctccatgggcgccgatctaccacctctggggcccctcgccttgtccgcgtctcctttccctgatccggcggcgccgaccgcgaccatgtggtgatcgccgccgcgctcggccgacgacatgcgggtgtcgccggcggcgcggtgggaggaggaggaggggtcggcggcgaggcggtcgatggccggcttggactgggtgagcagccagtccaccgtcttgctggccttgtcgaagccgaggcggtcctgcagcgcgaagaagtcgcgcgcgacgtcgagcgacagccgcatccggcggtcgcgcaccccctgcgccgtccggatcttgctgtgccggtccgtcctgaacggccgcttcctcgccctgccatggccgccgccaccgtttcttgccgccgtcagaacagccgccgccgccgccgccgccggaacagcaggatccgcggcggcgccgcgcggcggcctgcagagcacggcctccagcgtctcggagttgaactggccgtggccggagaagaagtggtcgtactgatgctgctgctgctgctgctgctgatccagctgctgctgcatggtggtcgtagggtttggaggcggtggcggctgggcttcttgggagatgcagaaatggtgaaggttaggaaagtaaggcaacattttgtgtatcactactttgcactcactttgtgtactatagcttcctactgggagtgagatctatagttctagtactactgttgcaggcttgcagccacagccactatcttcttcttcttcttcttcttcttcttcttcttcttcttcttcttcttcttcctctcgatctcctcctctgttcttcctctcttcacatgagaactatagctactagcactactagctagtgatcaggtgatgatgagatcgatcaagatggtgatgtgtgcatcgaagcttaaggagaggggaaagaaaaggttggagaggaaaggggaaaggaaaggagctaagcagcacaggaagctgaaagatgagtactgagagagtgagctttaggtattactagtactagacatcaccatctctctctctctctctctgaccacaagggtttgtttgtttttggcagtgatttttttgcttcagagatcgatatatcagtgatcgatgaggagcaatggccggagtcgacgccggacaaaccaactgtttgcgtcactgcagcttaattgggggggttacaagctacgagagatcgatcgagctatggagtaaactagtggagtagctatatattagcaccagctgctgctggtagctggtgtgtgtacatgtgtgtgttggtgtgttcgtggtatggagagttaggaatggaatgatgaaggcattattgtggatcgaccgagggctacagcgatgcactgttgggacacgtggtcacgcaggcgtggacgtatgtttgctcttgcagttacatgtatatacgtatatgtgtataaacgtacgtggaagtgtacgtacgtatatacaccgtgatatatataagaaggcatatatatcacactttttcatatcatttccatgactggagagcttatgattatgagaaataactggttgatatcagtttttgagaatatgaaaaggttagattttcaagcttctggtttctaattaatttcctgaattatgtatatcgctatagattcttagaatctagttgggaatatggctatttggggagctaaagatcttgaagaaactgtaactgctagaaattaaactccccaaacatagtttagaagacatacgagagatggttagggtatgttcaaaggtagaccttgatatgagttcttagacaatacacgattatttagagaacgcgccattacaatagttaaaacaatagtgaccctaagcattaacccataaaacttctattactactcttttttttccacccgcatacatcaaagttttcattttatagaagctgagagtcgctgttaagccattgttaaccgtgataacaatgtctgtctcttctctttctgccatgtcagcaaacctaactagcatgactaagggcccactactattaatgactattgtatatgccggcctttagtatatactccctccttccctagatgtttgacgccgttgacttttttaaacatgtttgaccgttcgtcttattcaaaaacttttgtgaaatatgtaaaactatatgtatgcataaaagtatatttaacaataaatcaagcgatagaaaaagaattaataattacttaaattttttgaataagactaacggtcaaacatttttaaaaaagttaatggcgtcaaacattttgggatggagggagtacttgtataccctagagtttgtgttggaacataatttattactagcttgcaactaatagtctgatgcacaatatatctagtcaagtgtggtctgcaaatacttgaattgaggattaatttaaaattttcagatttgaaacaccgttctcaagaatcttattgacagaacaaaattaatttagttgtggtttacaagagctctcaagcgagacagcaaattaaatagattattgtgctttgaagtgttggtctcacattttaaaaagtttctttctaacaaaggtatattgttttccactttggcctcatcatgtcgttaggtgagacacagtatatatcttaagctagctacatatacttatatatatctagcttccagtgtgattgtgtatatataccaccgcaaatcccggtatatatatatatatatatgtatgcagttcatatatttgcatgcatgtccaagttgtagtacgtactaaaaggaccagactttgtacttctaaatatatagatatatgaccacaggcatgcatgtgacattttttaatttcttcctacgacgcactgcactgcccctgcaagcatgcctgctaaacaggaagctgtgcatgcatgtaatagttgaaatggcaggcgcgcagaaacctagttattcattttatacaagaaaataatatgctatataggcattttttagtttattattttttacgaaacaatgtagattatattaaataagaaaataaaatacaacatgttgttataagttataagaaagagatgataaaacctgccaatgcaactcgaataggctccacatctacgacataatgtgcgatgaaaaagtatatgaataagcatccgctatatattagtttctctaggaaatcattaagccggccggtatcactgaacaaagttgagagccatggaatctgcaatcggtgccgccaattagatcatcggtaactccatatatagataatctttatcgttgatctcaccaacacaagaatatcttctgatgaacatatggatttttttttaaaaaaaatcaagacactagaagaatctaactctataaactagcaaatatagttaatcctccaaagactttgttcgaaaaaagaaaccctaaaatcttaatagagcatatcagatgagtcatttcgcctcatcatcaccgagaactctaaagatggagaaggccggagaggggcccagagagctatatatgttcatgtatagtttgagttgcaaggtaacattttggcgagccctcttttcacgatgaacttttaccttatattttatcttatttcttcaatttattgttagatagtcaatctaatggtacaaatttgtctcagtaatatacttatacatcattgtcttctacctcttgaaaagacccaccaaactcctcatccacctccaatcatctaccgtctgtgcccatgccgcgacttctcctaacaatgttgcctcatcactagagggccccatgccctgctacatttgctacccctctcatcaacactattgcctataattcttcgctcctctggccctctgctatgttcctctcatctagtgctttaacttcattttttagttcttcatcaacaccgatcactatgcatgctcctaaagtgtttaaagcaggggctattatacaattatgttttacactagagggataatgcatagaattagaggactccaatgtaatttgtcaaaagctgggggcataatcctgtttggtctccaataagctccagatctaccctcataggtagggatgattatggactgacatacaggtaatcattacctataccttggttaaggattgttgtactcatgggttgtcaagcagggcttgttgaagttgcatggcgatagatcgagtcgaaggagaccatgcgcaaaaatattaaagaaactcaattgagtgttgaaatattaattttttgtagatttcatccaataattttctctcaagtagtaatacttaattcttcagccctccgccatcttcctctcatctagtgcttcaaccccacttttcaattcttcatcaacgacgatcactatacatgctcctccaatcccttttacccgatcactatacatcctcctcaaccttaaaacctaaccactggggactgccacctcatgatcaccttcctatagtggttgaggctcaaataatataatcctgagggagggctggaggctaatgtgtgtaagttctaagagactcgatctgatgtaatttctctaataccgggagacgaggaggggggataacccaatttggtcttgaataagctccaattctaccctcatatatagggatgagtgtggtagaccgacctacggtaatccttacctaccttggttaaggattgttgtacccatgggtcgacctcgcttgtagggtctgccgaagttgcgtgggtgttagagatggacaagatgaggtgaaaaaagtataaggcaacttacatcgaatactcaaatactaatttgtaaattttctctagcaatcgtttcgttgagtttgtgcggatgtgcttgccctaggcatgcagttgtcttgttgttcactccgttgaggttttttttttaccgatttccatttaaataactgtgtagttgtaaagtttttagcgcttggttttctcttattaaactggggcaatatatactcttatttttataataaaaaaaggatttccctacttttcggactttctcttccaaattttttcctctagtaagtatcaattttctatcaagtgaatgctacctccatcccataatataagaagttttagagttagatacgatttttaagaaagtagttagaattaagtggtggaagattgtgattggttgagaagtgaaggtgggtggaaaaattgaatagtggagggttgtgataggttgagaagaaaatgttggtgaaaaagttattatattttcggacaaattctaaaggctaaaagttgttatattttgggatggagggagtagttaattaagcactccgaaatatatacttattgagtacatgttattcaatgagattcgatcgaccctctgcgtaattttccggtgagattaatttccatccctgacatctcgatcaatcaacttaaccggcatcatcgtttggcatcagctaggctgcacacgtcgtcgtgcaataatcagctcgcccatatggtcaggggatcgatcgaaaggacgagtcggccgccggccggcgagaccgccgccgccgccggccccttctcccctgcagctctcacgcgcggtccatgtggggccccacgcgaccaatcccaccgggcaggtggtttcatggcgttggaccggtcgatctctgctgattgtgcagggtcacgcatgcatgcagttgcagatgcagatgcaggcggctgtgtgcatggcctgtggcccgagagatcgacgacgtacgacgacatggccgtacgctgcgcccatttgacggccgcggccggggcctccctctcccccggccggagacgagattctagacgtcagctgcgacccatgcatgtatggcctccgaccaaggcgcattagtttatgcatatctatgtttttgggtgtccctgtagattggatctgatcaatctgtggtctctctctcgtcgtcgtgatctcgctgtcatcttctgcatatgcacaagcgtctctagctctagcttcagtgcacatatatgcatttgtgtgcatcttattcgatccatatatagctcacgtacaccaggtagctggcttaattaattaatcaaccacttcaaattaatgtgcatcgtcgtccttcgtatatacgtacacgtacgtacgtacgcatatatactagtgtgcatataattaaatatatacgtagagaacactctacgtataaataccccacgtgcttcgatcgtgcactcgattatatgcgtgatgatgatactccttccatgcaaaagtttaaggtgtatttcttttagagatttgagaaacgcccggatcttccagctagctccacaaggtggtaggctatacgacctgggtttgaagcctcaccccttctaattatttaatatattatgtcattctctaatattcgcgtcttttagagatttgctccggtttagcaaaaaccaaaaagtatctcgaggtatcggttacctcacggtactaaatcgtacctcgagatatattttattggtccggagcaaatctctttcttttgtcatcaagaccaagaaaaaataattcattttgtatgtaacgaagcttatgactatatgcatgcatgtaatatatgagtattaagatggctgtttaggttccggtcaataatttaatctaaaattttaaatcaaaataacaacattttcatttaagtattggatgtatgaagattataaatatatctatcttgaaattaactaaacaaaagaaaaaaataatgattaagacttttggatgaaggaagtatatatgcaaacgagtagcaatgtatatgtagccaaaaaaaagtactctatccgttttatattatgagtcgtttaatcaaaattattttgatttaaccaagtttatagaaaaattgagcaacatttacaacatcaaactagtttcattaaatttaaattgaatatattttgataatatgtttattttgtattaaaaatattaatatttttctacaaaactaatcaaattttacaaagtttgacttaaaaaaacacaaacaacttataatatgaaacgaagggagtagcaaacagcaaaaagagatatatagaacatgcatgatgataacatcgacgatgtatagtactagctatatagtgagtgagtgacgacctttcggccgggtgatggtcgttgcttctcgaccttgtctttccgtttctgcatgccgccattgctgccttcttcttcaacctctcgccactacacacacctctctcaaacgtttagagctagagctagcagcagctggctacctagctacacctacaggcctactaagaccagagagaggctactagctactcctagctaagctatacatctctctctctctctcgtccacataatcttggcctgcatcaaacgtgcgtaaagcgagatgcatgcgtatgaacagtacacgcaccataccttgtgtgcgtgcttacacacatatatatagatatatagatatatccgcggctagctaggcttctgcaagtgtgtggagaagatcatcatcagcccaaaaagtggctaatatattatgatgcatgagttcatgcgtgccggccgccacgtgtgcgatcgatcgtacgtgcggccaccagtgtgtgcacacgtgccaccatcgacgatatcgatcattgataaattgttcatcttttctcatcggtcttaattttagatttagtactagttgttataaagagtatatttcagagttgctgggtagcatatgtgtatagaaacatgcatttctaaaaaaaataaaataaaactaggacttaattagttgctattcccttcgtctcataatataagggattttgggtggatgttacacattctagtacaatagatctgggcagacggtctcatcaaactcaatattataggacggatggagtaggatttaggaagtgcaaagtacagaaattacctaatggagttggatttggtcagtgaccacttcttaatgggtcgatcgcctcttgatttgtgacctgctcgatcgatctccaccgtcgatcggtcacacgcctgcctgaagctgcctacagtttgatctccaaattaaaatggcagctggttcatcgatctagctaacacagtagctggctagttaattaaagaaggatactgttgctagtttgggagagttcatgcatgatatctatagctagctgatcttcattttccctttaaaaaggatgcgaggatatatcaacttaactaccatcaactccacacaaactctgatatatatctgaagttttctccagacactacgcatgcgctcattcgatctccagacatcatttctatatggaattttttttcagctcagtgatcctctcctatttgatccactcacgggcaaacacgcggtgagggcgtagtaccgtcttgtagctttcgcattttttgcatgatatatgatgtgaaatcgtaactacatgcgatgcatcgtctctgcaacgacgacacacgcaatgtagcaaaatgcagtgcacgatctcgttctctgaatccgtcttcgacgcgtccgatccccataaaagggaagaatcgaaatctgtatacacctgtcgtctatgagcaaatctgatggctacctaattaagcttttcatccaccacgcctggacgatttgggcatttttctccgacacaaactgtcgaaatgttaggtgctgatcacagggatctgttcagcagatagctaggaaatgacgggctgaataattttccctttcatttggataagatatctatacaggatcaaatagttcagacaaaataaaatcgatggcctctaaaatatagcgtaatttgatactaatatactagatttctattatcgttgctaggaaacaggagttacttaagagaattacaatatcacatagaagtctatcttctagcgcacatatttacgtcgttactatctctgtttctaagtagtagatgacgtcacatatatgtgatacatgtagtcgaacattaaaatcttaaattattaatatatgtaaaaatatcaaggttttatttaaaaacgatggtaataaatttaccataaaaatattttcacattgttagaaaaagtatggagtggaacatagcacatgtatctatgtctaaaacgtccttaagtaaagaaaagtatggagcattttatgaccaattaatgtggatataattaacgaagagactgttgatgaaagtaaaattgtctattgcgctgtgcacatgttcttgagcgacatttgctgatgattggagagactttcgcataggagaaaataacaacacatctgtgtcaactgtcaaacgagatgagcaaacagtgaaggctgattagatcattcacctcctttccttgtcggtcgccaatgggttgctcacccccaaaatgtattaatcagatttgtctcagaaaagacaggagtttgacttttcagacaagagattgtcaagcttgacacagcgcagaagcagctgaatagatttaggatatcctctacatagccagatttatcaattgattaattcaagaataacatatattcactgggctggggcatcttgagaatattttcccaaaacaaatttctcttgcctaaacaaaaatggacatgtgtggctgaatgctcagcagaacagatcagtccacaggttgatcgatgctgccaaaattcttgccgtcacaattctgtatatgatccattacacaaaggatagccaaaaggcaaaagcaaaggtctacagcaacgaagaaaggaggcctacacatacatgaaagcaacatggataaggactaaaaaagaggggaaaaaaatgggggggtgacatcttgtgtcacccggagcaagcacgcatgcacctggcaacttcttggcaagcattttgcaccatgcatacaggtattggattggatgtccatgtgatgtgaggcagcatgccctccacaagaggtagatcattgcaggccacagggcatggcaaatcatagcaacgtgaccaaagaaacgaaaaggctgtagccacaaatgttgaccttgtaagctgaatcctcgtacggcaagggtgatctttccagtatatacagcataaaagtgcacatatggtgtatttgacatgcgcaaccggtagttgccctcatcatttgacaagaccaggagaaacctcatgcttcaacttaatcattggagatacgattgagcagataagagcatattgtcctttttctaagtatgcgcactgatgcagattcagaacatttggtctctgagctgcacaaatttatatacccatgaatcatgaaactggagcaatctgaagttcctgctgcacaagatttttcttaactgtgccctcagttggtaagattccttacatgggaaaccaaacatccgaactagcgaattgtgcctcagaattcaatgatttaagtggattttcatgttggcaccatatgcaagaaaagattccaagaactcgcacgcttcttttgcttcctttgtgtcatatcactcagggttatgtgtgggttagcgagcaagccttctgattttcttgtaccctactctgacacaaaagacttattctagcattcctttgaattccatagccaaaacaatttgtcttcctctctgtggtcatcttcgctggctcgagaagtaggtaacataaattcctagaactgtggtcgacatgtgaacatctagactgtatcacttattgaatcagctgaactcatagcatcacaaacaggtagcttgttctcaatactcactcgacaaattgggcatgaccggcacttatcagagcacgctctgcagggccaacaaaaagaactttagaattccacttgcagttaaacagaaacacacccaacatgtagcaacttgcaataatacataaatatatacaccttgcaagcttcagacgacataacatgtgaaacatacatgaatcagtgattgccaaagaagcttactcgcaaagaacataatggcggcatggaagcagaactatgcaaatgtctctctcaaagcatatccgacataggatctgttcctgtatttatatagaaaaaggttcttgttaaaagtaattgaaatcgaaaaagcacatcaactcttttatggatgagatttaacagcctaccactcatgataatgattcaatattaaaagaaaataaactccaaactgcaatactagaaataatattatataggtgcagcacagaaccaaatcaacctagagccttgtgtatcactctatttgaaattggacattgtagaatgctttgtctgagaagtgagaatggaaat

SEQ ID NO: 20893 - DNA, 1196 bp, Oryza sativa
cctctcttcttttctcacttctgcttatttttgctgcttgcttgcttcttcgtcttttttattttccttcttcccctcaattcatgatgacacgttcttccttccttgtgtaatttatcaccgttcttggcgttttgcctgatttagaatgcaactgaaaaaaaagaaaaagatcgcagaggaaaaaaaaaggcagcagcagtgggtggtgaaagtatggaaatctctcctgctagtatacgtttgtcgtgtcctctttgttgtgttcttgtcttggggtgttgagatcatgcgagacgagaggtggttcgagagcatcatgagcaatgggaaaatccatatctgctatatcttccctccgtatctctgcctagctgttgcgagtgtgagtgagtgctcgccatgatgtccgaggaggaggacgacgacggcgacggcgacggcgaggtcggaacggagacggcggccatccatctcctgtatgttgcttgttgagtctctctctctctctctctctctctctctctgtctctctctgcgtcgccttgtccgtttcgcctcggtttgatcaaccaaccctgtgtgtgtctgtcactgtgtggctggctgtgcacattgccattgccatgtcctgtgccatgccatcccatgacacggtgtgtgcgtgagagagaaggcatagtagtgtgctgatccgtggggcccacggtggaatggtggtggggcccaccaaagccgatgataccaatgatcatcgtcataaacgcctctccttccgtttcagagttaggagcattaatgatgggggaggggagagggaggtccgcatgtcagattacaggtctgattagcccgggcccaccactccgtgatactaacagtgattacggatgtttttggcttagcttgcagctttgcccccactgcatgaatatatactttacctgtgcagtgcagaaaaaacatgctctaatttggcaaaggcaaatctcttctcttgctaatggcgagtactgtagtactccacttacactactactaatactgttgtgagaaacatctcccattatcttaagaaagtactgtagttagagtaggtaggagtggatgcatgggtgtgtgtggccttggtgttttgctgtctgtatcattgttgtgatggggaattggaaatttgcattggggttgtggtagct

SEQ ID NO: 20894 - DNA, 4767 bp, Oryza sativa
ttgtcaaaatcatggcataattaaactcaaaagattcgtctcgcgaattagtccaagcttatgaaatagattttataattaatatatgtttaatactctaaattagtgtctaaatatccgatgtggctgggacttagaataagtcactgaaaccaaaaatgctggatcactgaactccgccgtactgtgcgactgtgcacacacacctcacttcacgattaatgtccacagctgcttactgctcgaatgctttttttctaaaaaaaatatttgccgtatatacgacgcgacttttgaccgtgacagaaatttcaaaaatatattttcaagtactacatccgttctaaaatatagcaatctagtactggatgggatatatccctttatctagatttatttattagactaggatgtgtcctatcgagtcctacattgctatattttgtaatggagggagtacttcactccccgtttgaagatttttaccgtttaaaatttatcagcatcaaacaatcacaactatcccgtagaaatttctactgtaaaatcagggggagtaacaaattatcacaagacgcatgctacttcctccgtttcaaaaataaattaattttcacccatcccgtatataccaatgtaaaacaaaaaaaaagaataaaagagcaaatacaagtatacaattgcagatttgtagagctagtacaaaaatgctaagcacatgtgaagaaaagattgattagatgatgtgtcaatttttagagttagcaagttgaccatactacttccaatgcaaatatttttttttactttatttaattcaaatatttatatttttataaactctattacaataattatttaaaaataattttattttgagataaagtaaataggaagagtaaaataaaagcttattatcggacggagagtgtagtacagtacggagtatttgtcagtgccagccaaacgcatgctcatgcatggagaggcgtgcgcatgcagcaactcgatcaatcgttcgaccgggaggcaatacacggtggtactccagtagcatagcacatatacgtccaacccagtcacggccacacctccggccggttagctacatgcgccgcgcgtgcaacttgtcgacgaaaaccatgccttgcacgccagaaaatagccagaagaaaccaaacccggtggttgtttaattgctgacttgcttgcttgcttccctgtctctaagacccatttcagtttggaggaatttcaacacacagaaataacaaaaatagagaaatagaaatacatgcccacttctatcaataggaattttttccatgagatttgtagggatggaaatttttgtttgttttctctctacaacttgtaggcaagaaaattttcctttggtttcattatttctaaatcctatgaaccaaatgatattcatagaaaataatccttagaagttaaaatcctttgaaatttgttcaaaacgaattggtcctaagccacgccgctgtcgtcgcctccatccctcgccggcgtgtaaacgccgccaccgccgccgttgattgggatggacggcgaccttttgttcatctggtgacaataggaaatcgatcgatgggtgggagttgattatggatagggccagcgagccatgagcgacgcgagatcgagacctctcttttgttcttgtcaggtggtgactggacccaacatcgtgtgcttgtgtagtggtatcctaccgctacagggaaaagactatgagagcaagtttaatagtacagctaactcccatgcatataaatagttaactataaaaatatactacaccacagatatccggtctcacttcttatacacacatagcgtcttagagtttgtcttgcagccggctataaatccgcagctcactttcttatcttttctcttttcttctcgatatatggttatagctggcttatagcctgctattgtacctgctctaaagaggcccacgtaaatactcctacgacgatacttattccacagtattactccatccgtcttagaatataagaagttttagagttggacacggttattaagaagttatgtataagtgagtgatggagggttgtgattggttgggaagagaatgttggtggagaagttgttatattttgggataaattttgaggtctaaaagtttttatattttgagttcgaaggaacggtttaacgatgacgtgctactgtgcggtaaataattggcgagtcgcgaaggtgtgccattggtgaagagaaaggtaaaagttgccggagtagttgatggagcaatgatgagctctgggccgggtttgtcatgtgatgggccgtgcagtctgttgtctgggcctgccactgcacagtgaacccattttactacttcatcgtttgacaagtcacacggatgaatggatgatcgcattgccggactagtcctgccaatgccctaccttttttcaagcccctgagcgaatgcaattcgtgctcatgagtcatgagtgccacttttactactagtagtaggataggttaacatacaaattctgatacatggcctaggcaggattaccattgatctattaactttcaactgaaatcataagctactaagagcaagttcaaatagtatagcaaactaccagctctaatttatctatagtcaatctaatagcttatttatataatagttacatactacactattaatacctggtcccacatatcatacacacacggcgtcttggagtccgtgctacggctggctacaaatctatagcccactgctcttctctctccttatttatcttcttaaaatatgtttacagctgacttatagcctactattatacctactctaatagcgtagtgatgattaattcctgagctacacatgccacttagttatataactagagatatgcaaccaataccaatcaaagaagtacaaggtagctatttacacccgttaatcaaattcagtcatatataaatcgaacggttagattgtatgcataacaatctattatattgttaaaggaacagaaaaagaagtctccacgttcgctctcatggcctagaaattctcacattaatcggagaaaaagaaaaggcagaatccatatagaaatacaatttaaaaatagctgaaattcagaattaaaaaataaggaatattagaagaggagactagagtctatatagaaatacaatttagaaatagttgaaattcggaattaaaaaataaggaatattagaagaggagactagagtccatatagaaatacaattaggaaataactgaaattcggaattaaaaataaggaatattagaagtagagtatagagtccatatagaaatacaattaggaaataatagaaattcggaattaaaaataagaaatattagaagtagagtatagagtctgtatagaaatacaattaagaaaaaaaaatagaaattcagaatttaaaaaaataaggaatattagaagtagagtatagaatccatataggaatttaaaactaactaaaattcagaataaacataataaaattaaaagtagagtttagagttcgtataaaaatataatttacaaataactaaatttcaaaattaagaaaaatatgggacgaagagtttaaagtcaatataggaatacaatttagaagtaactgaaatttgaaattaaaaattaaaaaatattgaaagatgagtttagagtccaaatagaaatacaattataaataataaaaattcagaattcaaaaaaaataaatattaaaagacgagtctagagtccatataggaatatatataatttataaataactaaaatttgatattaaaaataattaataactaacatgtatataaaatacaatatgaatattacacattagtagtttcgtaaagttatagcaaaatttaaaattatgttgtcattttaatatatttgaataatataatgagagaatatatatgctattatatgagagaaaatataatgatgctagccgcgcaatattgcgtgggccaccatgctagttttattaattccttccaggtagctgtcaaaggagtagtgtgtagtgtcgtgtggaattcgcgaggatgtgcatgaacttgccaaggcagggatgcagttgcgtgacaaggacacacgtgaaatgtagcgagagaagagtcgtagtagcgggcgcgaccgcgggagtgtatacggagagatgaagcgagctctctccaccaagcaaatcgcgagccaaaccaagaagacatccacatgacgacgcctcgcgccaccaccaccacgtcgcccttctcctctctcctcctcctcccgatctccccctccgccgcgactcctccgcgccgcgccaggacgccgccgccggcggtggcacatggcggcgtgcggtggacggctggcgggaggcggcgacggcgagggtgccgggcggcggcggcggtggtcgaggacggcgtgcttctccccaaagaacaggaggacgacgcgtcggcggcgagatacgactggagggaggagtggtacccgctgtacctcgccaaggaggtgcccgacgacgccgcgctgccgctcacggtgttcgaccggcagctggtgctgtaccgcgacgccgccggcgtgctccgctgccacgaggatcggtgcccgcacaggctagccaagctatccgagggccagctcgtggatggcaagctggagtgcctgtaccacgggtggcagt

SEQ ID NO: 20895 - DNA, 5487 bp, Oryza sativa
acacgctggagttcgtcgacaaggacggcaaggagcagtgcttctcggcgcacttcctctgccgccccgcggggcaggggaagtcgatgctgctcgttcggttcggatccacccagacgtcgccgctggtgaaggtgctcccgaggtggtacttccaccagaacgcgtgcaaggtgttcgagcaggacatggggttcctgtcgtcgcagaacgaggtgctgctccgggagaaggtgccgaccaaggagctctacctcaacctccggtcgtcggacacgtgggtggcggagtaccggaggtggatggacagggcggggcacggcatgccgtactacttcgggcacagcacgctgtcgccgccgccggtgccggccgttgtcgagcaggcgccggcgggggcggtcgccgggatgtccgcgtcgttcccggccaagggcggcgtcggcgccacgcacgcgcccaacccgaccaacaggtacttccgccatgtcgtgcactgcaaggggtgcagggacagcgtcaagaggtacgcctcgctcaagaacgccttcgccgcgctcgccgcggcggcggtggcggcggccatcctggcggcgaccaggcaattgaaggccgtcctgctggcgtccgcggccgcgctcgccgcggcgtcgtacgcgtgtaactgggtgctgtctctcatcacgaccaattttattaggacacacaggagactgtaaccgtggcaatggctgtcatgctttggcacatactaatagcaaggtagaatggtacagctatttcattatttttgcccttgtatatttgtatcactacatgagtaaacgacgtttagttatcgatagttttgttatgagtgatgaatgatctgcatcgtactgccaatgccttgcattctcaaatggttgcacacttgcactcatacaaagttagtacactccatcatattataaattacttttttttcaagttaaatttcctgaaagtttgataaaatttatagaaaaaatataacgacgcttataacactaaattaatttcattacatctaacattaaacatattttgatttttttttgttttgtgttaaatatattactatgtttttctataaacttgattaaacatataaaagtttaacttcaaaaaaaagttaaaatgacttgtaatataaaacgtaggcagtacaatgcgaatgtagggtactccatccagctgaggtaaaccaactccaatatatatacaaacacaaacaacgtacccaatttttactgttaaaatacaggcacaatgcctggtatcacacgttattaagtagacagactcgataaccatgacacggacaggacttcttgccactggtttacgcacggttaatattacagaccacacatagagagacggcttagctatttgcaaataagcttgacaagatagatgatgctccaaaaggatgcgatctcagcagttgagtacttacgctggttcatctagaattccctatcggggaagaggagtggggcgacaagggaccaaatgtacagacctgccgttgcccactgggttgcaatcctgacccaaacggatggccacccaacgtcaacaagctttccactctcaccaactgaggttgaccagccagtcaagagcatcgcggagtacatgcttgccaaggagaagatgaggtggaagaacgagtaggagtatgtcactggccttggcacatccttcttttccgcttcctcatctgccttactgaaaggaagcagtggcttgtcggcacctgaaaaagggcaatgtgataagcaacacaccttgcaaatatggaacattgatttagtagatagagcacgcaatctaaccagcacgtggtgagtctggggctgagagcacagttgcagatgagccagcacggacagccgaatagaccacagaaaggatggtggttagcaatcccagcgaaaggctaccagtcgacacagctttggaatggttgtgcagtccattgcattcataatccctcggctcacttgaaagtccactgtagcacaaataggtgcagtagagggcgataactgatgctggcagcaagctaccattgatctgcaaaattcataaaaaggaaccattcattattattacaagcgagtaaccatatttaagatgagatgctagcagctagagcttgtgggtgtaacagctataatttgataaaatgctagaaatcttacacaacaattatcataatgctacaatcttatgcagcaattatcataatacacggacacatttctgacagcttttcgtggtcaaactatggactaatgaactaaatactctatacacagaggctgtgttactatattataaggatacagaacagaccagaagaataatacctttgggtgcagggcgacaatagcaaaaacaaaaacaagaatcagtgtgaagacaatgaagaacagattgattccgcagtcatgtccagatggagtgaaccagtgaaagagcagacccgagaaagagaatgtgacaatgtaacagacaactgagacaaccaatagagccatgtacctgcagtaataaatatgaacaaattattaacaggttttgataaacagaagaagttcatactaaattaaggggacctgaaggtaaacaaggaaaagatcagctactaaccagaactgttcatccttggcaacccaattctcgttccatccatgaacaaagtccaacaaaagaacaacctgaacaagcaggaacagtccagatccaaacttggatattgattctgcaaaaacaaatgacagttaaaattaacaacctggaatggggagaactggctccaattacagtaacaaaaactgataatatagaattagcatataaaactattcaagaagcagcagagtgtatcatcaatcacaaaagtacaagcaacaagttcatccaacaagctgctaagacagtgtcacgtttaccatatatatcaaccaatcaccaataccaagcttggtactcatgtttttaattaccaaataaacaataattgatgatgtatcatcaagccccaaaactggagcaaatattaatactatgcagttagtacacttccatgcctactcacaaccacatggagatccaaaggaccaacggaattatacattaatagttaaaaacacaggcaaccacaaatgcaacaatgtcactcccaactttccaacacaatttcatcctctatatcaaaatactcaaccacaagaacacatgcctcttgaaacattaggaattactacaatttgttcagctaaaatcgcctccaaagttgcaaaacttaagtcttcttcttgataacgacgaatccacacacccacctaatgttttgcagattagttggttcataatttcatatttacaattttatgatccctatatgaaaatatgtcaaccttaaagcttgtatattctttggtttagaaagtgtatcagaccaataggaatctccttgttcaaaaaggttctagcgcagagaatcaaaagttaagacaaccctaaggaaactcctcacaactcccattcgcaccttctctttcactctagcagtgttgaggaaggacttacaaggaaccttttgccactcctatctttaattctctaatagcctatcacatacagatatactgattttaaatattagtgcaaccatctcccaatataatgtcactgcagcatctctataattgtgtttcagaacgattcaattcgtcgtatacacagctacataggtgaaagggggggcattaccgtagaagcttacgacgccgttgggcacgaagaacatgaggaagacgatgacaacccagcagaatatcttggccatccatccgccatggtgtatcttgtcgcgggggtccttctggtccttgatgccagccatgatgatggcgaggatggtgaagaagacgaagttgccgaggctaaccctaagcacggcatcggtctcgaaccactcgcggtcgggcgtcttgtggaagtggttaatccctgcacagatagccgcaagaggcgcgccatgagaaattccgatcgatttcgagagaaaaaaaaagaaccaaatcgaatcacccggaagggattgcgaaggcgctcacatgggatggattggaggaggggcgcggcgacctcgcggagcgcccaggaggcgaagagggagagcgcgaagaggccgcagtaggcgatgcgggcggagcggcggccgatgctgccgaccgccgtacggcacgcctcgcacgcgcacgcggcgcagcacgacgccaggcaagacgccgcccacatggctgctgctcgtcgtcctcctcctcctcctcccttgcggcggcgcggtcagatcgaatcgatcggtgggtgaaggagctcgacgatggctttggcttgttcggatttggggatttcgccgcctctcgggggaagaagctttggtggggatggggaacgcgtgcggcggaggggcacggaagagaagaggaaaggaagccgatccggttttttttcccttttcttgttttttttttccgttacggagtgggtggctaccgggccggttgggttggaccggaccagcccgggccgatcaggagaccgagtcagtcaactactgtattattccagccttctacgtccattacatcaggtcaagcaaaagtaacaggatataggttccgtttactacttccgtcaaaaaaaaaactaatataattgaagatatgacataatttagttcatcatactacattgagcctgttcggtagttctaatttacagccagccactacaatgaaatatagagaacaatcgtagcagctgcagctgttgcggctgcacagccgctgtatagggctgccgaacaggcccattgtgtttcatgtacagctaggttaggttttttggatggaggaagtaagatgaaacaaggatgaaataaaatgagttatctacttacttaacatgattaatttatattttgagaagtaaatttaacaaaatagctagaaacaagtgatctatgtaatgtaatgcagattttttaaaaaaagatcgtatttctagaagcatggagcatgatcaattgtatctgatcatcactttcgaacgggaccataataacacacacatcatcgtcagcttctggcagaataggtaccaaaatgacaatagggagcataagtttgtgagttcagaactcgaaacaatatggtcctgaacttctggcggacaaactagatatcacatcctatattttccctacaacagagctcctaaaacattacagccacagatcacactgtataaggcatgaaagaacaagcaatctgaagtcgcatgccacgacaaccttcaggtatcaaaatggatattgattgactggcagatgctaattgatactgcatcgaaaattgacattagaattttaaccatttcttctct

SEQ ID NO: 20896 - DNA, 2322 bp, Oryza sativa
ctatcattaacctcacttgcagccacagcgtgatcaagagattgctttgggggtagtaccttaactgggattggatcaagcatgccttgtccagaaacacctagacccattccctctcggtaccccatttttgccatcattttggaggcaacgcccctggtatggtgctcccactttgcaaagatcgcagtctctgtctgaacaccacttaaatttttggattccaaaaggcctagaccctgatgaacagattcatcctcttgatctccatcctcactaaaatcagatccttcatcacttgagcttccttcaccatcttcatcgctctcatcagcatattctgagattgaaagagaatcactgggaagccttgcagagctcccgtcatcttgaaaaacaacctggccaactttcagatcgtcatcccatgactcaagttcagctcgtctccaaaggccagaatgatgcccagaagcagccagtatgctggatcctaccaaggactgctgccatctagtcggagtgaattgcttcagggacagaataggaattacaatacctgaggataatttttggattagtcacacatgatactttatgtgcaaggggcagaaccaactgggacatcttatatgtgtaggaaaacacaaagatataaatccatgaaaatcaatacaatattcacaaaaaatgcaacatctgaaggagcaatccatcatatgaagttcacaccattttgtggtgtcatcattgcttcaggtgaaaggcaacggaacaagagatcaatggtttgaaggggtttaatccttagaagggtgcaaaataagcatttacataccatgggacaagcggcagttactaccaaaccgacatcgttgctggagaaaaaacttgcacatctgcactatgggcagattgattagttaatttgttggtaacaatgaaccttatgttctggacattacattccattaaccaacagaaaatatggttgatggtgaagggtacccacctgtgacctgttaacattttccccgtcccatttattcatgaatttactgtggtggtgcgatgcaagaggatagagggacacactcaggctttgctacaaggtttatttgggagcagatggacgtatggcttcattgcaaaataaaggactggtatatgcacaatgcacacatggttttaatgaaaagcaaatcatgtactgtcacattactttggagagaagttcagcaactgctcacacagaatagcctagaatcaatacagaaataacttgattatacaaccgctagaatgctgtatagctctgcagcccagcaaggacttgtattgcaaaagtaggaatttgtttcctaaagttattccgtcattccaaggacattcaacaaaataattgcacaggtcatatctcctatgtgctggagttataatatctcatgaaggagagaagttggaaaaacagtaaatactggcaaataaacacccatttcctaccggcggtaacatagcaagttacaaacataccagcacgtagagggttatgtttagggtttaccaggaaacatggagctactattcaaaggaaaaaataatggaaaaacgatagatcaagtggcgtgactcaccgacatgttttcagacgtaggagtcagaaatgagatccttgcatcacttgagccttcaagtcctataacacatccattataccagcgcccatccttatgcctgaatctacacttagatccaactgaaaattcctgtggctccaatggttctggctcaacatcatcgggtggatcaacagctacttcaggtgcttcagatgttggctcttggttaggaaatatctcatcaatttgctttactagtctagagcgtttcaaatggagaagtccctcctctgcatccttaattgcagcaagaagttcttcatggaccttcaaaacagtacatattgtaagttagcatttgcacaatagaagcatgaaatacataagtacagaactattgaagacaatggtataagggttgagattccccaaaaagaagctgactgctttctctgaatatttgttcgatatttttctctggagatattttggacaaggaaacctactatttggatattcacatctcaggaatccaaaatgcataagctaatcatctcacctacaggttacatcagtgagctatgatgtgaatatcactcaactcttgtcataccaaacttaaacatgttgagtcgatatctaatctaaacatactaaatactaatgtacaaaagttcccacccatcttcggctgatttggcca

SEQ ID NO: 20897 - DNA, 18197 bp, Oryza sativa
gtgttcactggcagctgtagagggcaattctcggtcaatttgaatatttacaatcatcaactgtagatgatcttgttcaaatatagcttcctttcaatcattcaatgacatcaaggtttcgtttgaatttatgtctttaaactcattccaatataacatgtaattttaaccagctagtgtttattatgagtgcaccatgaaaccaaacaggtttgggatgctatccacaccatctaaactatttcattagagttgccagcagtgaaccaaatggcaccttagttggttcggaattccatctcctgattgctgccattcaactcaacaattatttgatttctcacgatattagttgccactatattccctagcattaaccggcgatctgtgttacatgcatataataacatggatttacaaaagtatgttttgtgatgcaggtgtctctgttcaaaaggctgcttcaaatggtgaggaatttgagagcagaatcagatcgtatgcatgcattggcatgtatttgtcggactgctctttgtgttgatctttttgcaaaagagagtgttagaagaggtcagaagcctgttccaggaacagatgtgatctcactatttgaggatgcaaatgtgaagggtgatctaaacagcataacgagcaagagcttgttcagagaggagctagtcgcttccctagtcgaaagttgtttccagctatcactccccctacctgagcagaagaattctggcacagagagcagagttataggagcattagcttatggaactggatatggtgcattgaattggacagaacctgctttggatgtggtggaagtttgcaggccttgtgttctttgggactgtggtgggcgtacctatgcaattgattgctatctgaagttgcttgtacggctttgccatatatatgatactagaggtggtgtaaagacaatcaaagctggtgcatctcaagatcagattctaaatgagacaaggcttagaaatttgcagctacagcttatcaaggatcttcgtgaggttatgctcttagttaatcttaacttttaaaatctaaacacgatggcatgtttgttttacatgaacccacatagttctttatatttgttgaatgttgatgcttcgttcatccaccaaataaataaaacagtggtttatctattttatactatctttatggcaacccattagtttttctctgttgcactgaactcctatataatattacagtacatgattttgtttcttggcatgcatcattgttatgcttgtccttgtcttttccggcctcatggatctgactattgcaaaaacttgtgctctaaagtacatttcccataaacttctctcgttcaataactaaaaagcatacactttgacaaggctttactttagtttagattatattatggctgtctttgctgggctttccttttgctcttcttccccctttcttttttcaaatatttataaactagaactgcatcatctgtaaaagattcttttcctagttggtaataatcataaagtgccgatgttgacatgacttctactctatattctacttttattgcaggttcatacaccaagaatttcaggacgattgatatgggcaatttctgaacattttgatcttgaaggtctggatcctcttttagctgatgacccagaggatccattgaatatcatcatatctaacatgcataagattctattcaagatcgattcatctacaactacctcaagtaggatacaagatgtgcagtctgtcctcatatgcgctcaacgtttgggatcgagaaatgcaagagcaggccagctcctcactaaagaattggaggagttcagggcaagtacttcagctgattctgtcaccaagcatcagtcgcgttatgtcttgcaaataataaaatatctaacgaaccatcctgataacaggtgagtgtattctgaaactcgagtaactaattctttcacaaagggtcaccatttatttagatatatactgtcataaatgttgtacaacagagaaaaaaatctctactggaacatgcattaggaaattatgaaatgtctaactttccaatatttattcaggtgggttggtgtaggtgatgctacaggggattatccatttagccaccacaaacttactgttcagtttttagaggcatctgcagcacaagataggaaattggaaggattagttcacaaggccatcgaagagctttggaggccaaatcccactcagttgactctcctacaaatgaaggggattggtgctttgcacaaagagcttccaaaaacactttctttgactggcagcagtgatccatgctatattgaggcatatcatctggcagatccaactgatgggagaatcaccttacatctaaaggtatggcctgatcgatgcatctttcccttgtttgcttaacagtatattcattttattgtacttttctgttttggtctctgttaaatgctgtttagggacaatttagctcttaacgtggagatagttatcttggggggctggggtaaaattgccagcagttttttgccaacactgtaaatactatattattaaaaaataggaaccaatattcttatgcaacctattggccacagttttctcattttaaggccatattatgtgtggccttatcatgatggatcttcagtgttagctccagcactgtgcaattgtatttttgtatttgttacctggtagcaggtaggttgattttagaagttaaaacaaccatgtgtggttccacatatatttcttttctctgaactatagaattttttgacctggaattgtattatcatgttgtttgactagtttatgttgttgcagattttaaatttgactgagctggaactccacagggttgatatcagagttggtctctctggagcactgtattatatggatggattctcccgcacagttcggcacctacgtaatcttgtttcccaggtgcttatactaatctaaatgtgcctattttgctgatgttcttagtataaactatacaattacccatcaataatttaaaactagtgtagtgccccttgtgttgctagggatctgaaatatataacatcaccataaattctgaacttaaacaaattaaaataattatcctcgagtataaaatttcacacgcataattcacatattagatcaaccaactcttattttaatccaccttatgtggaaaatgcctttccattctgcaggatccagtccaaagtagtgtaactgttggagtttcgcactttgagagatgctccctctgggttcaagtcttgtattacccattttatggaagtggagggtctgcagactatgaaggagattatgcagaggaggactcacaaacagttaggcagaaacgctcacttaggccggagcttggtgagccagttgttttgcggtgccagccctacaagatcccccttgctgaacttctcttgccatatgagtgctccccagttgagtatttccggctatggccaagcttgccagccatggtggagtgcactggcacatacacatatgaaggtagtggtttcaaggccactgctgctcagcagtacgacagctctcctttcctcagtgggttgaagtcgatttcttctaagcccttccatcaagtctgctctcatttcatccgaacagtagccgggttccaggtaagcattttgaataatctgtgtcacttgagtcatgttaccatcctctttattctttcatatacataactatcaaaattcttgggttataactcatttgatctcctacagttatgttatgccgcgaagacatggtttggtgggtttgtgggcatgatgatctttggcgcaagcgaggtcagccggaatgttgatcttggcgatgacacggccacaatgatctgcaaattcgtcgtgcgtgcctccgatgaatccatcacaagagagatccaatcagacctccagggctggctggatgacatcaccgacggcgccgtggaatacatgccggaggaagaggtgaagagcgcggcggctgagcggctgaaggtttccatggagagaatagccctgctcaaggcggccaagccgaaggtgccaccggcgaaaaccaaggaagaagaggaagaggagaagaaggagcaagaggacctggacgagtttgggaaccccaagggcccctcgacgctttccaagctgacggcggaggaggccgagcaccgtgcgctccaggccgccgtgctgcaggagtggcaccagctgtgcaaggagaaagccttgaaagcacagtgaggcttttggttttatgttgtgattttgagtgccatttttgttcttttaacccccattttgtgtatgtattagccctgctgattaatttcactccatgtactactgccgatttgttcattgtattcattgttcacagataacatttgtaacatagatccaagctttggtgtgaaaatacatttttttccccggtgaccacactatattcctggtccatttttcgacgaaaatctacaaagaaggtgtgcataacataattcctaatgtttgactgacaggtggggtctggtgaattctacctgtctattccaatgacatgtggggtctcttgcaatggccccacaagccagtctctctcttcgcggtctgcgtgttcccacccctccaccctcgagtcccccgaccaggcgatcaccccgtgggcggcggcgccgccgtcctcaggccgccggccgccgcgtgcggtcgagctgccttgccatggcaaggccgcagccttgctgatagcgaacggaggaaaacgaccaggctgtatgcccgcatggtgttcgaaggggtcgggagcgatggctcggggtcgggggcggtggctgctgccgacgcggctgctgaacgtctgcctcgccgcgctctgccgcggggggagcctcgccgccgcggaatccgtcctcgtcgacgccatccgcctcggcctgccacccgacgtcgtcacctacaacaccctcctcgccgcccactgccgcgccgcgggccttcgaggctggccctcgtcgtcatgggacggatgcgggaggccggggtggagcccgacgccgtcacctacaactccctcatcgcgggggccgcgcgccgcgggctcccgatacacgccctcgacctgttcgacgaaatgctccgttcggggatcgcccccgactcctggagttacaaccccctcatgcactgcctgttccggtccggccacccggaggatgcctaccgggtgtttgctgatatggctgagaaaggcattgcgccgtgcgacaccacctacaacactctcctcgacgggatgttcagggccggttatgcgatgaacgcatacaggatgttcaggtacctgcagagggcggggctccccgtgagcattgtgacttacaacaccatgattaacgggctgtgcagttcaggcaaggtgggctatgcccggatggtccttagggagcttgggaggactgatcatgccccaaatattatcacttacacggcagttatgaaatgctgctttaagtatggtaggtttgagcaggggttggacaccttcttgtcattgctggacagagggtacatttcggatgtctacccttactgcacagtgatcagtgctttggttaagaagggccggttgggagaagctaataattattgtgacctcatgctacaaaatggatctaggcttgacagtgtgtgctacaacacgctgattcacatgcgatgccaagaagggaagctggatgacgcatttgagcttgtgagcatgatggaagatggcggcctggagagtgatgagtacacattcgcaattttggtcaacgggctgtgcaagatgggacatatcgaggctgcagaaaagcagctattttacatggagatcaagggcatgcaatctaatgttgtggcatacaattgcttggttgatgcgctctgcaaatttcaagaggtggatgcagctatcagattactgcagtgtatgaaactaaaggatgattttacttacacatcactagtccatggtctatgtagggtgggtagataccatatggcatcaaaattcttgcgaatctgcttgcatgaaggtaataatgttcttgcatctgcaaagcgtgctgtcattgctgggcttcgtagctcagggtttaaaaatgatttgaggaaagtccgggtagcattaaatatggctaagctgttacgaccataatccaaggaaaatggcctgaaagatcaattcgcaagagaaatgactggataatcctgcatggagtttaaggatgaatatcttgtcggtggctcagtgcatcattctatagaagtaaaatgggtatactctttttctggagaaactgtaggatggtgatcttgcaatatgcaatcagccttttcactgtcagtctgtcaaacccaagcggaacaaaattaaacatcatgggaagctgcagacatcaccactagttggcgaacggtatcggctcagtatgtgcacaaagccaccactaactggtgtatgccttgccttggattttgttgggaaggtaattgtggatttatattttatattcaagtcttctgcttaaattagttattaccttatcgttgtgtcacagtaaatcatgctaagtttaccctcttttgggtggttgttgcagattgattgggtttagttatctgttgctccagaccagacgatacagagcaagcaattaaaaagaagtacaaaaagctgcagattggtacagaaaaacccatttgtacatcatttttttgtctgttctttaattcttatgaagcagtggaaaaaaaaatctctttgggtgataccatatgtcacagttttaacatattgagcaagttttatattccaatgaaaaacatagcaagaggacagatatgtttgtggtatgcggcagtgctacctatccttgaaattttccattggacagccatttgttggagctctgcatgtcagtggctgctgagttcgagccgtcaattgaaacaagtcggcaacctcttcgtgatggagcatcgtagattggtttgcaaggtgacatgaattttttgaactcaattgaggtcaggtttgctttgggttgaagaattggggtgatttgggtagatcaggagatgtttggttgattggattggttctgggacgtatagtttgctaacataggtgggtctggaaacagtctagttttttaggcattagcaggtctagtccaaatatgaagttattgtgacattctaccaattcttttccctacctttgaaggacatcttgagtgggataactttaatttacagaacatggtaaatttaggttcaagatggatttacaaaagtattttctgtgacccagggagtcttcatacgactgcttcgagtggcaagaaacttgagagcagaacaagatcaaatccatgcattggcatgtactccatttgtaggaatgcttttttttttgccgattcatactttggaagcccattcgaggaacaggtgtgatatcacctttgaggatgcaggtgtgatgatacaagctgaaaaccactactgacgagcggccgaagatttacatggagaacgtagctcaaggcagcaaaactgaaggaacctttgatagcgacaagaggagaataatgagcggagagagtccaatttcatgtgtaattctttcgacatgaattttgcaaaaggagtccaatttggctttgatttgggagaaacgaattcgtacattcggaactacgcgaacatgcatgtcagatgaaggcggggccgtcctttctgttaacagacagtaaatttcaagatgtcaaatatacgagtttcaacacaaatcctacagagtttctgctacaggaaagtgattttcaccgttgtacagagtttctgctacggcattggtatattctatccttttttaaaaaaaattaattaaaaattgatactagcaacctactccagtcctgatccgagtttgtgtctaatccagtagtattgttatattttggatcgaaaaagagtagattttctgaatatagcttattttcagctggtatcttatccatacagaccaccaaattatcaaaatcttcggaatctgaaaaaaccccaacccaaacaaagcatctcgtgtccctatctttcgggtcatttgaaactggagcgaataacctctcgactccaatttccacacaacccaccaaaaagtctccgccacttcaccccgatcgccgccgccgccgccgccgctcgattccccgatggccgcggagccggaggagcgcctcgacgtcctcaccgccggcggcgagaagacaggcgcctccaaggccaggcacgccgcagctaccccctacccagcttactcccgccgccgcttcggttggattccattcgatcggatcgcgtgactccgccgccgcggtttgctcggttttttttttcattgcaggtcggaggtgcacagggacggcgactaccaccgggcggtgcacgtgtggatctacagcgagagcaccggggagctgctgctgcagcgccgcgcggactgcaaggacacgtggcccggccagtgggacatctccagcgccggccacatctccgccggcgactcctctctctcctccgcgcagtgagctcgctaccccttgctcccttgatagaatttcggaatgcgattatctgaattctgcttggggaatcgtagtggcgattttgcctagcagcgtggagaagcacttgtcactctgctttaagtttactatgcacatgggcatgacactcattgcttatatctgcgggagttgtagtctctgagatattgcggttcatctgatcgatgcaactgctgaaacttgattgaattaacttacgtgatgaatgggttgcacacgtgctattatcacatagtgtttgagacgctgttcatattttattttagtttattccacaggttcactgacttgcttgcatttgttgggttggctattactctattgcgtgattctttgctaggctaggtaaaaagggtaatattaaaatgatgcattctaattggtaatagcatttgacatggatcatcaggcgggagctcgatgaagaactaggcatcaaacttccatctgatgctttcgagctgttatttgtttttcttcaggaatggttagtacctctatctcttagtccatcatcttattgtgagtttgcaaactacgatagaaaacgattacttttatcttttttgaccgggtattaaatactattctatccctcatcagtttaagattgtatagcagcatattctgatcataactgcagcggatcttttacaatttcaaacagtacttactgagaggcttgctaagtgctaatatttcatatttcatcactttatgttcacatgaaatttcacactatcagtatctgcataaagggacgttatataatgttatcctctgattctttgctgcagtgttatcaacaatggcacatacaccaacaatgagtacaatgatgtttatcttgtgactactttaactccaattccacttgaggcattcactctccaagtgaggatacaatgattagtaatactttgcattatgtttttttcacttgctcttgcatattcatggttgtcaacatcaacaagtgtgtattacaagaaaaatctgtacttatgttcctggcaccaaaggaaatatatctgagcaagtaaatttatcaacatgacaaaaggaacactatcagaattgtccagtatataaatatttatgatgtaatttctttgttttactagttgtatggtttgtttcataatcaactgtagaagttttaattataggaaagtgaagtatctgcggttaggtatatgcatcttgacgagtacaagagctgccttgcaaaagaaagcggagaatatgtgccttacgatgtgaatgggacatatggccaactatttagtattattgaagaaaggtaagcatccaaattatttgtccagtcatgtttttgtcaatttgtggcctcgattgtcgaagggataattatattcactttggaagaactgaaatgacttttttctgtgatcgatatgaaatttactactaccaacagtctgtggtaacaaaggtgctggtgacaattaaaccatgtccaagctctcatttgacctccaggtttaggtttaaacattgggaagctggagtgagtatttgtctctaggttgacacagtaggttcttaggagttaggatttattgtatagttttttttttaactcatcagagttttaagttgaaaaaaaggatgtggtgtcattgagcaagtcattcgatgggtaagtctctaaacaaaaacttagcatttggtgaatcagggacttttactgtatgttttgagcagcatctgctcctgttaacaacccaccagaattagaactttcaaataactgtttctttgtcttcatctcttgccagttaccactttgaagcaattcaacatatcattcccttggcaatccctgttgcaccacgttttttgtcaaaattatcttgcttcaacctttcatgccatgtttataggtacaaagacaatatcgaatcccgcagtttaaccttgcaaaagcaaatcaaccgttatgctcccatccatttggaaccagaggtaagctgtctatattttttgtcagtcaccctgtagctctggttatttattttccatttcatatttgattatttatgtaactattcttgcctatttggcagccaccaatattcaataccaacaaaattatatgtatgggaaaagggaaacattcacttcatttatgcacatagctactaggtatgccatatgcaatatgcattggatgtatagcacatgaaagctaggtgcgcattgcacaaaaaaaaaagagtactgtttgtatcattatggtggtctgatagttggaaggaatgatatattgtgtcaaattgtctactattgggtagcacctaccagtttcctcaccttttcttggattaatccattcaagattattatttcttagaatattgtatgatacatatactatctataatctgttcatcataaaattctgtgtcataaaagaaagcaacagtttgatttcacacactaggatcataatatttagtttgaacattaggacggaaacaggaaatttgattcatcattcctataatatagtactcacatgcttttttttgtccctggcacgcttgacatttcaatctttggctttgcagttgactagtctatcagaaggagacagggaagccttgggatatattcttaaagcatcaatagttattgatgacatcttttatgagcaggtacatctttcaactttcttcatttttttttgaaacacatattttttattcttattcgttggatatgtcgtttacaattagttagcaaagattatcttcagtgataattattatttttactgcattgcaacttcttactaccctggttctcgattaggtttggaatagcaactgcacgctgagagactggctgaaagcacgtgctaactactcttcttttgataagttgaagtggttgtattattccattaataagagtccatggtaatttattttctattgaagtttcttcacgcatgttgactactttaggtttatttgtacattggatattttgttggttgcatggtgacttgcctatgagttaagatcatgatcttctgaagtctgcatttagtatttgtcttgtgttgccacgttgacgcatataagtttacatgtgttgtgtggatggatatagtttgtatcctaatttttgtgtatctacatctttatgagaaaattaaatgttttgtattgaagaatgcatactttctcagatgttctgtgcagaacttcagtactccatgcatgaaaatgttctttcataccactgttatttaaccattaccgaacaattggtttcatttattaaatttcttttttggtattcatttttttcattcctaaatttaatccttccaaaccaaatattcctggatttccggcctgtttggattaaaaaataatgaaatttgtcctgcccttatggactctaatgaatatgtacttgtgaaagatatagcaaggagcatatttatctatgattagggtgtttatgagcacaaatccattttttattcctactttgtatgcttgtttcgaactcatattatctaattagataatgtataactactatgtattttttagcatcttgatagatgttattatttgatattttcccataacaggtcctgccttgatgaaaataaggcttttctatcgactgcagattctgctgtgaaattactcacagatgccaccaaatcagtttcaggatggaaggggattgagtatcgtgctgcatttcctcgagataatcctcccggggcaaacttttatcctcctgatatggacaaaatggtaagattgtgcttagtcacttttctgcttcccagtgctcaaagtatccagtacaaatttcatatgcagtagtacggttgcttactgagtactgtataagtacgtttgatgtgtacttggtaccgtagtgactgaagcagggccaatttgcatatgttttgtatgtctgtaggagtttgaattatggaaaaatggactgcctgaaaaggagcaaaaatatgcaactggattttttactgtcataaaacggcatgatgccttgttgccttcaatactagcgcagtcagatggatcaaatcaaaccaagacatcagatgatcttttcgttgttccatactctgaggagtacaaatcatcccttgagaaagctgctgagcttcttcataaagcatctgaatgttctgattctccaaggtaagctagtacttcctccgtttcacaatgtaagtcatcctagcatttcccacattcatactgatgttaatgaatctagatagatatatatgtctagattcattaacatcaatatgaatatgggaaatgctagaatgacttacattgtgaaacggagggagtagtaatataccagcttttagtttctgaatttagaacttatatgcttttatcttcatgtagcctcaagaatttgctcaaaaccaaggcaaatgctttcctttcaaatgattactatgaatctgatatagcttggatggagctggttagtgtcctaactctcagttttagttcattattttctctttaaatttacaaatgtactggttttctcactagcttgattccttcgttcttggagaaattgttcttgaatgttttaaggcaatttgcaatcttttttttttggaaaaagagaacagtaggtgagttccctactgtagaatgtattgtcaataacacaaataatacaaggtcaagagttttatggtgaataatgtgtggtttatgagcactgcagtatatagtgtagaatatttgttgggtgtatattcataaaattggctgtatttgtcagatttaacagcaatgtttggcatgtacaaatcaggatttgctcatataacctctgtatttggcatttctatctttataggactccaacttggatgtcactattggcccatacgagacatatgaagatggtctttttagttataaggtatttgtctctctttcgagatctacaaagaattttctccttgggatcctttcctacctgttcttgtcatctacctatttgctggtcaagtatttagcatggaatttgcatcaaacaccacatattattttgaaacttcagtaagcttgctcgttatcacatataatgcaggtttgcaacattgttgagtgtgtgcctatttcctgtgttcaattgttatttgtgtttattaactaaatgcccgcgtgcttgctactgataaaaatgaatcatacacatggagcaaattaaatgaacatatgccctctccttttttttttcaatgaaggcaccctcaatacttttatcacagggagtacttctaaaactaactttaatactacatatacatgtgacgttggtcatcttagaccctttccgaatttaagtttgtactttagagaccaagaaaatgatagtatatgaagggacttatatgtaatattggcttcaggaagtatttggtaaaaaatatagtggggtggcagattcactgctacagcccaccagcaccattgacttcctttaataggagtataggtcttttgatggtcatgatattattttattctagtagctatgattttctcttcatacctcaatgctggggctgcccatattatttgggttaaatactaggattttaattcagttaggcaccaccttatccccaatgaagaaagtatggcctataatagtataggaatagagtaggcgacattaccatttagattagggcatgtgtttaaacatgtgtacaggatgtgcacatgcacttttatatcttgaatcaagtttatctacatactaagtttatgcatagagttcaataaaatatatcatttgtttttactagtattttctactattttaaaggcaacctttgaagcatttgttggtgtacgggatgacattgccacttctcaagttaaactcttcggtgatcaactccgggtaactctaatttattttctgtagaaaagtaccaacttttgatttacatgaaatttgatcttaaattcaggatttagagaagcatcttccactggacaacatttacaaatccgacaatgtatctgctgctccaattcgcgttatcaatcttctgtacaactctggggtatgtcccttttgtaacatttctttaatttttggggttcatttaatgctttattttattactgtgaatttgtgatctccctagtcatttgttaaatttctgtttcgatttgaactcattggtacttaaagttttgatatttgtagacacagaaaacttgcttgttttccctttttgcttggtggtagatgggcatcgtcaaaaagaagcttatgcccttaaatccctgagaagcaagtattcagccttttcgtaatatctaatgacaattgatgacacaccatgatttcatgacttttcgtaatatctaatgacaattgatgacacaccatgatttcatgagaggattgctttcttccttttgtttttatgatcaaaggagaaggttgtttactttgtgcttttcttactactgccccagttgcatgttggccaaagaattattgcttagattacttcagcttgagtttgtcactataattggctaaaccattctttgagatcttgagacaattgataggctgagagcgcgtgcagggcttgtgtatgtattgcagatgatttgttgtgccaacagcttcatgatgaactaaacagggactattgttgcaggatgtgaaaggcccacaaactattgcttttaatttgcccaatgatgagcggattgtgaatgaacgagggacctcgatggttatgcttaagaacatttcagaagctaagtatgttcttttaccgattattgtctataaattttaaattggtgactcaggtgatccacactatcagtggcaagtggcaacaaaagtatgggagttcctttttggatgattctaaattttctttacttttcaggtttaagcatatcttaaagcctatagctaatgcttgcatcagagaggaacaggaagattatgttgattttgagccttattatacacatattgtttgccatgaatgctgccatggaattggtcctcattccataacccttccaactggtaaaagatcaacagttagaatggtacgtaactttgtatattcatagaaataaacataaaccaatgcatgaaccttaggtgcactataaacatgtgctttgtttccctcaaaatttgccaccaccttcaaccatttttttacgtaatgtcactaccaaatttcttgtcagattattgacaaatatataaaaataaccaaatttataagtatggatgttgctatagaaaatgcagcatattcacttagcaatggaaaataactttgctaatactcaggtacatgtaggaaaaaaaagatgtgcttatttatctgtcttcacactttaaatttgaaatgctggttatttctctgttatctgatttatagatgacctcttcatgaaaaaacaggaacttcaagaatttcattcagcattggaggaggccaaagctgatatagttggtctatgggcactgaattttcttattaaaaaggtcagttgctttcatcaactatcaagctaccatggcacttagcttagtcgagaccaggcagtcaaatcctgctattgctgtatatgcataagcaaattttcatttggctatatcctcgtttgtgccgtcattactacttagggaaaaacagaaacagtttttccaaactgcatgaactgcacattgcatgagcaccaactgcatgcaattttgcattgactgggttgtgcaaaaccacttaacccggttttgaatagccctactaataatagcacatctgcttctgctctaccagggtttacttcctaagagcctatcagaatccatgtatgtctcattcctggctggatgcttccgatcgatccgctttggactagaagaagctcatgggtgaggctttattttccctgttagcaaactgaattatgtttctggaaaaaaagggaacgcaagtacttctcaattctcatagaatctgtactgtcctgagctctttatataaatcactgttactatgtgtgcagaaaagggcaagctttgcagtttaactggttgtatgagaaaggggcttttgtcttgcattctgatggaaaattctcagttgatttcacaaaggtatttctctcttttttttccttaacattatcattgtcatgctgtcaattctcattagaactttgtgccatgaaaggttgaggacgctgtcgagagtctcagtagagagatcctgacaatacaagcaaagggcgataagcctgctgcccagtctcttctgcagtcccatgcaagcttgacgcaaccactgcgtgtggcgctggacaaaatagaacacatgcaggtagctttcaaatttaccggttcatactaaaagaaaattgtaaactatttttcatggcttctctccgagtgtttgattgggttttattttccttgtttatattaacatgttcttgattattttaggtgcctgttgatatcactcctatattcggcacagcaaataagctgcttgcaaacgatcagtagggtgctcggtttagcaagctacgtgcttcagtggaactctgcaagaaaacgtattttgttcgatcctaagatactccatgacaagaaaagcgaaacgggaagttaggaataaatggacaagttatccataaacaataatgttcatgtcttatttttatatttattacgtctttgattgcgagaagaccccttgtaatatttcaggattatcatcagactgctgttgttctatggtgcatgagatgaccggggaaatcacgtgaaactacactggatagcagtaatacactgatcgttctgtccacaagctaaaagcccgagaaatcacattcaaacttattttgctttctaaaacattcaaacttatttgttctctttttgaaaaaaaattcggtgaacttattttgctttctaaaacattcaaactttcaactgaaaatgagtgcgacgtggactttctaaaaacatgaaactttcgattcaaattttaaacttccaattcaaaatttcaaaactttcaagtcaaatttaatacttttaactaaaaatttcaaaactttcaacttaaatttccgaaaatttcaactcagaatttcgaaaactttcttatcaaatttgaaaacttccaagtcaaaatttaaaagtctcatatcaaaattgaaaaattctcacatcaaaatttaaaacttttaatatcacaatgaaaacttccatatcaaaattgaaaatttcaacccaaatttcgaaatctttcaactacgaacttaaaactttcaactattttttaaaa

SEQ ID NO: 20898 - DNA, 12207 bp, Oryza sativa
tattttttaaaagtcttctaatcaatatatttatgttttttaaaacaatgctaattatggtaactaatactaattacggtaattaacgttgattaccataattagcggcgcattgtgggcgcacactaggaaactcacgccgcggcctccatcgacttcttccttcctcctcaaaaccaaacgtccatggcgaccaccaccaccactgatatcaccaacgccgccactcctcttcttcaaccctcgatcctctttggacacccacgtccacatcggcgaccgccgccccaacgccaccaccaccgcggaagatgcccagatccaggtctccatctccccggcttccccgccgaacccctcccgcctattcgtccgccgcctcaaccgggacaccgtctccctcctctacgaggacgcccagatcgtctccgccgccgatggcctcctcctcctccgcgtaaccatcgtcaccaccaccgcgccatcgcggctggagaacgactacttcgtctacagctaccagtggcctggacgcccctcgctccgccgtctcccctcgccgccgttccccttccacgacgacgaggctgggatccttccccttcccgttcccggcggtgagcagcaattcaagatcgccgtgctatccgtccgcctgaacgggttcaacctccgattgttcgattccgcgtcatggagctggaccaatgtcggcaaggtgatcgtagcttcgccgcagagaccgttcccaatcaagatccccaggaacgccgctcgcctcaaccagcacatcacaacaacggcgatcacgcttggaggtgaagatggcacgatgggctgggtcgatctctatcgcggcatcctgttctgcgacgtgctaagcggcggcgatcatcccacgctcgttggtgttccattgccgctgccaaggagattggtcgatcgcggcgcggaagtcgaaggatgccctaaggccaataggggtattgctgttcttgatggttgcctcaggatggtcgaattggaagttcatggcgagatacttcctacgcgtgaccctgaaactgggcaccttgatcgtgagatcaagaactgggagctctacatgtataccaacagcaagatcaccggtgcttgggaggattggcaattggtgcacggagttgaagcttctcaaatcaatatcgaccaagcgattcatgacagcttactgcaaccgggattgctgcgtgataaaatgcaggatggcaaggagaggaaattgcacaacctcctcacatctcaacctgctctcagcctggatggtgaaggtgttgtttacttgctgacaaaggccaaattcatgcaacgtcaggcttgggttcttgctgttgatgttaagggcaacaaaatactaggattagctgagtttggcactgacacatacttgggtttgtccctcgcgtattgtcctagtaggatctccagttacatggatgcatggactgtccagacaattagttatattttagtactatataagttcctagtcctatgatttatttgcatgtataaggagcaatcgataggataattggttcatcgaaaatatgctgaaaagaggatgctccattatcgacaggatgtagacttcaagttaattttagtctatgcatttaagaattcaccgatgttcaaaaaaggtggatcaaatttataattgctttatagtggcctactgttacaactacagatctacctagtacctacccatagaagtaaattaccctagaagtaaatgtcttcttagctggtcactgtggtatattatagaggtgggcaaaattcaattgagaagatcgggggacctgaaataaattgagaaggtatttcttttttttctcaacattattatagtcatgctgtcaattctcacgtgcaattacactggatagcagtaacatacactgatcattctgtccacaagctaaaaaccgaaaaatcacaagcacagatacgtaataacacccccaacaaccaagaaaccggtactgaattgaattttccatatacacttcagagttcagagagcacatgggatcgtcaaacacaggacaaactgttcactaacattgaaatggaaaaagaagccatcacaattgttgtcaaacattgcacaacctggtgaacaacacaactcatggattgcaaaaggcacgatatatataacaaaggtcatttttctcctgctaataagtacagagatatcaaaggaacgaactgcctgaacatatgcagaacaccatcagctctctcacaacttatctgtcgggaaaagaaagaggtagtacagcacgcccttaaaccgaagaatactacgggtactcagatattggaacatgatcagccgttactgaggtcaagaagtgaaatttggcaaacgagttcccctcgttgatcctcttcttcagtgaacacatctgcctcttcgtccgtgggaacttacacggccttcggatgtccttacacgtgtcacacgacagcatgttgtacaggaacacatcctccagattcacggccacttccatgatacgcttgataaacgcaaccaagaagtcttcagattggaagcagaagatggtgagaacggacaggttgtggtgcttgaaatcctcagcagaagattcccactctacactcttgttcgagctgtacaaagacgccctcatctcctcgtccttttccatgttacaccaatgatcccatacctgcatgaatgccacgcatatacaagaaaatggtgataagaaataagtttgtggttttgcttgcagctgtatgaaaactgaaaaagcaagcaaaagttttatatcaggtgcaggtgcttgcagctgtgtgaaaatggagtgtcagatagcaacacaccgtcatgcgtagctccttcaggaaaggcgctgcttcgagaatgaacattgtccatgtgagatcacatccttcaggaacacgaaacagattcacaagccttaatttgtagaaaacagatgccagtttttgtggtaattctggttgaacccaaatctggaaggaaaaaaaaagtgagtcgagtagagaggaggctagctcagcaaaaacgattaccaccaacttaccttttcactcttaaaattcaaacgtagatctcttacagagatctttccaaggatcttacttagcttgaccaacttgtgccttttaagaccaacacctgcaagccgtaccgcctcgagtgagggcacataaccaaaagtcaggggatcttggaaagatagccaaccctcaaccatcaattgtgctagtttcggcaagcagttgagcttgatgctttcaaaacggcagctggcaatattgagcacattgagctgtggatgttcaagttgcagcacggtcaaatttcctgaatcgcagttgaacaaacgcaaatactgtaaattctgacaggtcttgaggacgttgtggatgtccgattcaccaaatcttagattccctattatgaggcgtgtgagaccaccaaatgcagttgggcaagcatcgaaaaatgacatgaatcgtctcccgtaatcgatcaaatcatcatcagtgcaacgggtgggtagcttctccactataattgtgaattcggccatctcaaccttttgtgttgtcatggcatgtccaacagtttgtccaattgagatacagtcaccttcattcaggtagaacagcatgcgcaagaggtggatggtatattcatctggattcctgcgttccaagatgctcttcgttgcttcaacaacagcggcattggtccagaccaacacatcatcagataacatggatgcaccattaggcatgaagtgaacaaagtctataaccaattgagaaagcatagaagggagatgcctccaccgtctggagaggacactggttcttgcagcatcgcggacatggagccggtcaaggatgttaagcagaatatcatcaggtaacttgcttagcctgtcactgcctttctgcatttgaccaccaattacaaccacaatcaattcaaaatttaagcattattactggtcaaaagtaaaagagtaatagatgccatgcaaatgatatcatcctactcctactgggcacataacatagcaggcaaaaaagggagggaaggagatgacttacgcggttcatggttgctccaatgcaatggcccttggatgccgctctgttctgcttgccctctatgaaatcttggtggtacaaggcaaccagcagttcactatcttattttcctccaaccatagaatccttctatgaacgattctgtacaataaggaattgttagattgatacccaaatgtgttccaaaaaaagctgataaccaaataaactttaccctttttggcaatgccagtgtaattcagtactgtttgattagcttccaattaagtcacagtgttttgccgcatgatttccgtgcagccttgctcacggctgcttcctccactagatcaaattcccaattgccccccccccccaccccaaaaaaaaaacaacacatcaatctgacggaatttctcgatccaaccgcatacaacgaagcgtgcactatccaatacagcatgccaagtagagagactagagagaggggagcgacgcaacgtactcacaggttgacgacgagcaacgcgatgcaccggtgatacgagcggcggaggaacgcaggcggatggccggccgacggggaggcgaggcggcggaggaacgcaggcggacggctggccgacggggagggcggcgccggcgacgtgagcggcgcggctcggaagcggcccgcgctgcgtcggcggcgggagacgaggaaggccgcggcgtttgcgccgcgtgacgtactctattgagtgggccggccttaacggagcaacgcgagatagtttatatacccaatttaaattcgaattcatatttaaatattttttatagagtgaagtgcatgagcgggccctaaacttgtgcgggcgtgtcatctagatctctaaactctcaaaatacatttttagtcctcgaacttgtcttgagatgtcatctaggtccagaggagctctaacccgctccatgcgctgatgtggcatgtcacgatagcacctacgtgccacgtgtcaagcacatagaaaaaataaaaataaaaggcataatttctcctctctatcttaaattttttttgtcttttttatgtttacctaagaggagaaaatatggtttttaattttattttttatatatgcttgacatatggatttcaatgacatgtaggtgccaccgtggcaatgccacgtcagcgcatggagccggtttgaaccggttaggacctaaaaatacattttggaagttcaagaatctagataacacacctacacaagtttagggaccgctcatatactttactcttttttatatataatattcatacggtatactatatttataaatataaaatctatgcacatgaatatatttttaggttattagatttttatctagtttcttttaatttttctaacttgtttttttttaaaaaaaattatggtgcaggaggagcgtatgtgttagggggagggacagggtgcctgatcgaccacagcgatcacccgtccattagccctcccttaaacaaggtctcaaagcgtttgtttgatctgatcatcgtctcacgtgacgttgttgtgacactgattttgataattgaaaaacacgttatatcgtgcattacggttcaagtataattcaaacttgcgtcaatataaggttgtgttcagcacaaggagattgatatgaaaattctttaattttccacacacacgcttttcaaccgccaaacgacatttttaaaaaaaaataatattcatattaattattttaaaattttaaatagttaatatttaattaatcatatgctaatgatttactacatccgtcccattataagtgcagttatggttttccgtgtccaacatttaaccgttcgtcttatttggaaattttttatgattgttagtgttgttgttattagatgacaaaaatgaataatattatatgtgtgtttaatttttctatatttttttaaaaaataagataaacggttaaacgttggatacgaaaactcacaagtatatttcaactagaaaaaaatgcccgtgcgttgcaacggatgaagtatattttaatcttgttattgttatatggttaagttaaaatgaaattcattgtgggagttcgcttggatatatatatatttaaaaaatcattagctgtagttaggggtttgatcgtttcaagttagcatgtgagttttttaaaaacaaatttcttatatgattccttctatattaccaaaagtgaacaatcttgaaaaccgattcaaatacgaatatgtatttccaaaagcaaacgaacttaaaaactgactcatacacggatgacgtaccaaaataccggcaaaaacatcttcaattttcataataactagaaaaatgcccgtgcgttgcaacgggtgaagtctattttaatcttattattgatatatggtttagttaatatgaaattcactgtgagagtttgcttagatatatatatttttagaaaatcataagctgcagttaggagtccaatcgtctcaagttggcatgcgatttttttttaaacagatttcttatatgattccttttgtatttaccaaaagtgaacgatattaaaaaccgactcaaatatgaatatgtattttcaaaagcaaacgaacttaaaaatggctcatacacgatacacgaatgacgtaccaaaataccggcaaaaacatcttcaacttttataatagtagagatagagatatagattaaaaccaaaacataaaattaaaactgactcaaacacggatgacgaattataaaaacatctttaatttttataaccgactcaaacacagataataagatgtgaaaagatcttcaatttttataataagtacggatagtgattgggacggaggtggtaactcgttttacctatctttctcaatctatcctattcgattctcgtcatcggcgcatcgcctttttctccaccgcttcacttccccactagccacaaggcccacaacccaacaaccttccactgatccacacacagccgcgaggagagagaaagagagaggagagagagatggcggcggagctgacggcggcgcagctgcgggcgtacgacgggagcgacccatcgaagccgatctacgtctccgtccgcggcaaggtctacgacgtcacctccggccgcggcttctacggccccggcggcgcctacgccgtcttcgccggccgcgaggccagccgcgcgctcggcaagatgtccaaggacgacgccgacgtctccggcgacctctccggcctctccgacaaggagctcggcgtcctcgccgactgggagaccaagttccaggccaagtaccccgtcgtcgcccgcctcaccgaatgaaaaaaaaaaatccccccaaatcaacccttagattattgtatcctcttgtgctctacagcttaattccatccgtaattccatgtgtaacttattattacttctccctgtgtgtcagtgtgtctgtgcttgcagctttgctctctggttgcttgattagctgcccaataatctgaacaataagaaatctggggagtaatttaagtattggattgtctggtctttcttttttgtgattgccgcttgatttcttgtgccataggttgttcttaatcttgatctgggtattcttgtatagaagaagcaatgtgctgaatgccttgaccacagaaatttcatggctgttgtttgctgtacaggttcatttggttgtgttcatcttggtgctgtcatagtcagataggtacaacaaaagcaggttctttataagatttttttcttgtggtagtcgatggatggatgttagtgttagtttttcgttctttcatttctggtggatatgctagctttggcaagtgattattttttggttttgtgtgtggattgataaatcattgaagcaatgcacagagacatcagacatcaattcagtcgttaactattacagttttgaacaatgaataattctatatagattattgggatatagataattgttttgaccaatatattgtaaaagttgattacttgataagctttatgactatttcctgtgtcttcttctctctgtcttacctgtttaatatctgactgttgtacgtggaggaagacatgaatgaataatgagtttagctcctaaatgttctcgtggatgttctgattggggagaaaaggtttgttactgatatttggtttgtgtaggctgataattccagcagtttcctgcatcctcgctgtgtgtacattttattttgtgtgaaaaggatattgatatatatggactctggatcgtgagaggggggtatcaattgttataaaggattcctttctttgttttctttccaatttccaatcagcttccatgtgtgttctgaacttctgatacttcaggccgggaaggtggaaaattcgctccgttcccatgaaaaccctacccctcccatggggagtttttctattatattaatatgaaaccctacccctatgagcatcctatggggagtttttctattatattaatatgaaaccctacccctatgagcatcaatcctggagatattgacaaagtttccgttaaaccctgaaaaattcgctcctataggagtcgaatccaggacctcagatgctaccgaggctcttgtaactactaggctacatgccctttcacaggcacaggcaaattgtttgcaacattgttctgattcactgcatatctgaatgaaaccatgaatcaccttacagatattttaacactagtgaatgcactgtgcgtctgtgcccactgccctgttacgaagaatcattatcgttagtttcggtccaacccttgttacgtgcaatcacattggccccagttcatcagttagaacgtgttcacttttgttaccactttcaaacataccaatttttaacattaccaaattaattttaataaggcaacaaactaaacacatccttatcgatgctaccttaccaaattaacttatacattagtaactgtagaattttctacttttaaaaaatctaccaaatattgataaggcattaaatttagggcatgttcagattgtagccaaaataaaccttaccaaattttggcaggatttcttatgtatttatcaaatttggcaacaaactaaacatagatattttttgaaaactttaaaaaaaatggtatggttgaaaatagcatcaataacagcccctaaatacaaccatcaaaatgtgtcaaaattggcagggttaaaagtggatgtaaactgaacaaacccttttactattttggccgccggttgttgggccgagctgcttcatgggccgtgcacaccggagaaggagatgatggactgatggctagttggacaaacctgagccgtccgatgcagatggacggtggatggagtggggggaaccacacgccgctgacgtagctacatgaagtcatcagactccagccgatccgcccacacatgcgcgacgcgcgtcccacgcagccatcaccggctcaccgccgccgtcgcctcgtcgccgccggcccggccgccgcctcccctcgagctcgtcgtctcgaggagcgctcgggttccggtcgcctcctcgtagggaggaggaggatcggaggaggaggggtttcacgccatggtgcagcaccagtatgtcccgcgcaagcggcgggccgagcgctcgttggcgccggcggcgccggcggcgatcttcaacgtggaggcggaggagggcagggccggcgatgtccccttgcacaagcgcgtcaaggaggagctgcagctgcagccgccgccgccgtcactgcaggtagattagattgaatttttatttttatttttttgttttttggttcctcgtcgtggctacgtgattgcggaatacttagcctgttccctattctaaggaaatggtgttatggatttctccattgagaatactaatatattttatccggattaggagtgagatcagcaggaactatttcgtacggtcagcgaaaattaccaccagaaatatcttacagaaatcacttataacgatacccaaaaaaataaaacattgacacgggttgtaaatatttgtgctccttgctttaatctggatatccaggccaacgtgcttcttgatggagattgtcaatccaattaattaggcactcaagggtaattggagattagtgaggagggatattatattggttaagctttgcgtgagagatgctattattacctttttattttgtttctttttcttttcagctctggcaacaaatggatttatttccgaacaaacaaaaaaaaaacatcctaattgagttgctagcgttgattttaggagacagactgaaatgggtaagccaaactttggcgcaacatgcataaaggtagaggatacgagtccgcaattgtgatattggatttgggatggattgttttgtagggttttgtaacgtaaagtgcggctggtaaccgaacacacccttcgtctatgtgagtgaatgctactactacattgaatgctactttattcattccatatctcgctaatttggatgtttgctctagacgctccagacaaattaatctggaaatggaaatgccatgacatgtcctatatttgttccatatctcgctaatttggatgttttctttaggcgctccagacaaattaatctagaaatggaaatgccatgacatgtccttttatgctcagtttgatgacacgctggtaaaaatatatgacttgacatttactggtaaaaaatcaccgtgatacttcctctttagtttggttggtgcgggtatagttgtatgttctttgcaaggtggtcaccaagaaggagaggaaagcctttgatgcaggcctgattttggttacttggctgatttggaaggaacgaaaggctcgcgtgttcaatggccgagcctcgtcaccggcctgtttgtgtacgacgatcaaggatgaatgggaaacgtggctggcggcgggtttgatccctcttccttgagtcggcttgtttgtagctctgttcggagaggtctctgtgtgtttgctccccatctcctttgagcggcggttttttcgcctcacttaaagggatgtggccctatttgtaaccaataatgtacattctttgctcttacttaatatatttcggccagtattttctttgccggcccagcggaagtgtttgaaatttcattgctatttgttcagttattatgcatgtccgttttttataccgttaatgagcgattgtggcaaaatacttattgaccgtgtgtatgggaatatgtaaatcttatagtgcattgttagacattattataagttaggagtttttaaaatatcaaaatctgaaaaattatcagttgtaaaatggggcaacatacaaaatatatctgaaaagtttgggatttgattaatagcgttgtatctatatgtatttgtacaaatatccttttgcgtgctaacataataatcatatactatgtgattagctaacacttcaatttatcctctaagtaccaacatgatgttttgcaggacatgcacatcctcgatggaagtagcccattagggttgagattaagaaaaagtccatctcttttggagctgattcaaatgaagctggcaatggaaaatacaaaaaaggaagacataaaatctaggtctcttattgctagtgaacgagtgaaagcttccaactttgctgcagattttttgaaaattggcacttgggaggtaagagatttcctgttaactgtgttagtactaatatatatgttatcatgtaggagtagtaagtacaacttagatgctctctttcccaaaattttggtttaacattgaaggaaatattgcttatttgcagtgcacgtcacagtatgaaggtgatttggtggcaaaatgctactttgctaagcataagcttgtctgggaagttctggatgctggtctcaagagaaagatagaaattcagtggtcagatattattgctttgaaggcaacttgcctaagaagggctgcaggaat

SEQ ID NO: 20899 - DNA, 14180 bp, Oryza sativa
  unsure (1)..(14180): unsure at all n locations
ataagcttctattcatttctgaagttggcccgaccaccaactttcttcaaagagactgatcctcaaccaagaaaacatacactgtggcaagttgcatcagatttcactggtgggcaagcaagcataaaaaggtaaaatattagtttgtagtccattatatatagagccatgtgcccatgtttcatacattaagattggttgcatgaaagttgtgagctatgagcctaccgtggtactttttgctgaacatgttttagttttgcatacatgattattcttgtgattttttatttagtgttacttttgctagttgttccacttatattattatttgtttttgctgggatgaccgaaggaggtcatctaatgttattaagataggaaacacttattgaccgtatattaagataggtcaaccatttatattattattattatctactgacctctttattttgactactaaaatgaaaatgattgaaatgcaggaggcatattctacagtgtcaatcaagtttattaagcaagaactttgaaaagcttattcagtgtgatcagcgactaaattatttaagcctccaaccatatatgatagactctcctgttttcagacctaaaacggaaggctctatattcgaaaatccaaataaatcaaagagctatcatggttttagttacttggaaggtgaacatgaatcccacttatccaagtatattgatcatgtatcaccatgtgattttcctttaatgtctaaaaaggatggaatgaaggacgatattgcgaaccaacaacagtcattttctcgaccaatcaattggggtaaattattctttcctccaagacatggatgatatgtttatatatgacctactatatctatctaattatctaatattaaatgttttcaggagccagtgatgtagatttgcaagttgatgtatctcaagaactaaagagccctcaccccaactcattgagtcaagctagatccttgtccatagatgacttgttaagccatctagatgattgcatagttgagcaaaagcctgcagggaataacccttcattgcccattagtgaggcatcatccaatgaattgttggagaagattacccagcagcttttgagcgactcacatgttgcaccagcctcagatgagaaacgggtgatggcaagggttggttctcttctttctctgcttcagaaagacgcagtgccagccaatttacccaagtttgagcccaatgacagcggcaagattggtgtagttgaagtgggaatcagctcagcacttgatatgggaatcgcaaatggcacaaaccctcctggcatctcaagaaaggattcctacgaggagcttttgtcaaacttgttcaacatatcagaggatttcgatgactgaagcaggttggctttgcggttctcattccaagaattagatatatgctatgcaaaacatgtaaatatgagtgataagttagctccttcaaaacaaaaaatatatatattttagcatctcctttgtaaacttttaaatgattcattagattgcgttgcgtattcgttagttcattgctgagtaattttattttgcaacaatgaactgccaacttgttcacattcatcatttcaaaagggcatgcatttatgtgatagtactgttctcaactagcacttcctagctgcatgtaggcttcaactgaaggtgatgacgagtgcatgtatgctgctacctgaaattacaagtttattatgtttttgttcggaaatattgcatgggttatctagtgtgggagtttgttgaaacaacatgaatgtttggaatacaagctatatttcctcagtgtctcctattataaaaagtctgactatttttttaaaaaaaaatgtgcaagagctaataaatgtggaattaactataaaataaattgtacaaactgttgatatggttcttaaattgttatcctaatttgaaatcatcttgttacttttaaactctgaacatcaataactaaccataaagtacactatttactgtagttctcatgactcatatctgaagacataagtttaagttgtgatacccatgaattagatttgaaaggattgcattggattcagaagcattacgctatgtagcaaaagagctcatgcaaggaaaaggagtcttgcaagagctcttataacatgtaaacacttgcatttaaatagaatacattacaagcatctcgcatacacttgcagcctagaaacaaataggtacagcaaacagaaccccttcatctacacacaagccataaaataaaataagataaattgaattttacacaagataaagacatctgggaatactcttaaactggtatccgaagatgtgtagaacttggaaccttgataatattacttaatctaagcctataaggtatcaggtggtggtgcttctccctcctcatcaaaggcttcattttcatcgagcatgttcatcagcatagatacctgctcatgaagcatggaattttccttctctatctccgttcgcttcttacgctcatctgcgagctgcttttgtagaagctcaagcactcgggagtcttcttccaactgttcattcaggccattgatctcacggtcctgccacagcatttccatgaatataggagtcaatgtatgcttcagtgagcaacaaatagaatcgcatataattcaactttgggtttaactagaccaacacacgtcgtaaattgaggataaagttagttttttcaagccttgatcatcgataaaaaaaaaggaaaaaagtataccaaatgcatcacgatattgtgctagtatgtggtattgtggtacggtagcaaactattaaaaagatcatgaacctttctgttcatttcttggattgctatcctcctcatgctctccaccacatcaacattcacaagcttgcgtttcttgccaaccagccatcccttgggatatgacgcgggctcaaagtctggtggtgggagcaacatttcagcagaactgcgcttgccgttgattggttccaaaggctcaaacagcgccttcctcttctcagataagttagcttttggatctggatgaacatcgtcgtcagtacttactgcatttgcatcatctattttcatggcctcttcatgagcctgattgttcagttgttcatcagcagcctctttgttaagttcttgttgcaagctccggccattggctggaacatacatattgttagtcagattcaagagtcagtgcacttctctagctaaaatctaatgcatacaggtgaacattataactacatgattatatggaagttctttaatttcagagtgtgttctgctatcatgacagcctgataacttgttagcatacatcagctcaagaccaacgaacggtctctcaatgtatttatattgacatatgtagaccatccttggtgatgaagcaaagtatcaaggtacaaaaacagcaactatttggaacatgcacaattaaacaaattatctcctgcaagttctatgcattgacaagccttacattttcaagagcaaaaactgattgatttactttggcctaaggcctaagctaactggtcaacaacacatgttcaaaaaaaaaaaaaggttcaatattgccacatgcaacgacaccctaaccttatttaacactgctaactgctaaggtcgacaacatgctatttaatctgacactctgaccccgggaaaaattattgcacgtgaggccataattactgtatgcgaccaagcaagttcgtctatgtctttgtcaataccaaaattatctagatgcagttgcaacttaattgggagttgaccaaaagagcagtgaaatcatagaggatacatgagcaacaaaagaagtagcagccagatgcaccaataaaaaatctcattccacaaagcaaggcagtaccaagttacggagaggaatatgatttgtttctgcaagcatattcgcactagcactggtaagctacctagcaccgacaggtgcagtttcagaatcttggcggtaaagacaagcaaattaagcaggccacatcctcttagtttagttatcaaggcgcctctaagtcttaatcctcatgagcttgcaccaaatggaccagccaaaccggtgcgtgattaacgtgtacggaataataattatatatcgattcagtgagctggcaataatttaatcccccacgaaacatctcactcagaaattattccatgctaccagctacagtacgtttagcagcaggaaatttcgaggatactaacttgtaagtagccaagattaccagtaattaggtgtaaaaccgtaaatcaaagtgttgtatggttcatacaatttttttaaaactgaaagaaaatgcagagaagcttcgaaagggactgaatttgaagctagcgagatttaatcaacaagagattatgagagaaggaatggatatctcatatctgagcagagcaagaagaagcaggagtcgaaatcagcatgatttacatttgaatgaagcatgtaattaacaaagcacctgaggctgatctcctcctcgacttccagaaaatccgcgggggatcagccgaggccggctcctccatggcttgctcttgctcctcctcctccttcactgcagcagagagaatcaaatcacacaaaatcagcttggcctttgatttctcctcacctccatgagcctcttgagggggtgaggctctcgactggggaaacaagaaccacaccaaagcaaaaacaaacagagagaaaatcaaaatcaaaatcaaaatctcacctcttcttcttcttcttgattgcgaagctacctggacccgttctatctgcttgcaacctgagctctatctctctctctctctgtccctctctctatcaatctatgggtgcgtgccttgtgagttgcgttatcttgtggttcttggctgaggagggttgctacttgctaggacggcgagaagagagaggagaggtgggtcaccgggtcgccttcgccttggaagcaactcccgtttgtttcttgaccgtctcgcgtgccttcgtctccgaccgcctttggctttttacttttgaagggacgcagagagcgagggcagtgtagtgtgggggaaaggctgaaacggcgttggcgcgcacggggggcgttggcgttggcgttcgttggttgcggtcgcgcttggattacccgccaacaacctcctctctctctccggatcctctgtggctgcttctgtgttgtttgtgtccaatcctctttcgatgagatactggttcttcgtcctaaaatataacaatgtattaaatgtgatgtccatcttatttaaaagaattttgtgattagtatttttattattattagatgataaaacatgattagtacttgatgtgtaactatttttttataaaaaaaatcataaatatttcaaattagataaacggacagtcaaatgttggacacggaaacccacaactgtacttaaaatgaggcgaatatagtattactgttatgaatctgaatactatgtccagattcatattgttaggatacgtcatcctttcgtttatgctcttcattctaggaaaaaaaataaatttagaattgaacttactaatactcctttcgtaaaaaaacaaaaaaaaatcaacttctagagtttgaattttgtcccacaaaaattttactatcctatctaccctcagcacgtaaaagaagaagttttataccttcaatactctttacctacctatcacatttattatttttttattgattaaggacatcttaatcactcttcattttcactaatttcacctcgggatattaggaatggatttttttttatacggagggatattaggaatgaattttttttatacggaggaagtacatctaatactaaattcgtttttagtcggaagcagtactgtactaataggataaaattggagacaggccaccagcagccgtgcaacccaaagctgctaatcatcatcaattccggtgtactggcagcacagcgactgacaccggcatgcatggaaggatgcaggctatcaatgcgagagctaccgcatagccatgtgaacactagcattggatttgtaccaagccgcgagtacgtagtactactaccgtccttctctccaaccttttccatcttgggggcccaacactcactgcactgggccatatctgagcccaatacctcaaatagtagttttgaggctttggctggcccagttaaagacatcagaattctcttcctcaaaaaataaaaaaaacaaaaaaaaaacactaagttatgcattgcccagtgcccacgctgctacaatgactggcaaccaatagagcggttttatcccctgctatggcaacaaaacaaggcacacggacatgtcaaacgatccatctcactatcaagacccagagattgctaattacatcatctaaagcagtcaggtaaagaaaaagggactatccaactccgacttgagccataattgacccagaaaatttctaccaacagattattgttgagacctcaacctcccaacctacattgtatcctaaaacgaaaacctgtaacctatatcatggttcatccggtacaaatcgatgctgctgctactgatcgttgatcagtgcaacgtcaggccttggcagaatcaaggcagccaatacactgggaaggctcagcgaggccgtaaatggcctcaatgcagctgctatggaatgcatggtggcagcccaggacggccgcgactggaggagcattgtcgcgagcatcgtcaccttgaggcctgaatgctatatcgagcttgcacagctggcaccttgtccccaatggctcaactggtggcgcctcatccttgtccgtcagagctgaaatcgcaacgaagaaaatgtgatttaagtcaaatggttaagacggacagcaaaaaagtaatctttgccttgcactgaaactgtgatgaagaactttacctggtcctttgatgtggacctgcggttgtgaatttgccgatttaaattgctgcagcagctgttcttgctgcttgatcaacaatgccttcacgttcgcgtaagcaggatctgagagaacattggatgacgagcccttagctttcccgatctctagtttcggtgagaccaatggagcagttgcaccagcctggccactgggctgtttcctagcaatgagtaacttagcaagcttcctttgaagatcatcttgcaagttttgtctgggagctgcaatgaccggagaaggcaacttattgtgtgcagcaacttgctgtgctctgttggcaatagctttggcattgactggagcaactggtttattaacaaggcttgttctgttgatcatagcttttatatttaatggaccagctgagtggttgacttggtgagttctgttgggtatagcttctgcagtgactggaaaagccgacagattgacttggcttgatccgctggcaatagcatcagtagtgactggagcaacaagcagatcagcttggtttgttccataggcaatagcttctgtaatgatatcattggaattattttttgtatcaagctgcagctgctgtgcaagttcagctgactgacaattgtcatttgtagtagcaggaccaatttttgaggaagcaatgacagaactctctccgctttcagtctccaacttaaccatagacagtggagcagctaatttaccgtccttatttctgatagttggtttcctttttggaagtacatcagaagggctcttgcccgtttgcagcttctttgatggagatgggatgactgccccatccaactgatcacctttgctcgcgctttcttcatttctctttttgcctggaataaaataatcaaaatttggattacaacatgaatgataaaaatgagttaacaaagcatctagtaagcacctctgtgaacagttgggctatcttcagcagcttgagacgaagcaactctggagcgcttggcagaaggattggttgaaggaacgcttgcccgcttcaggtcttcactcataacaataggctgggtaaggggcttccaagcagatgaagccactttatgaggggtgcggacacgggttacagatggtcttgcagcagcagattgggtgttaaagcaagggtctgtagaatctctacgcttgcttgtactagcagattctcctcccttcacatcagatgaagcagcagcagcagcagtaggcttacgggtcatagaccgagtaacagggcggaaaacctgatgatgagcaggtgtgctgcaagatggctcagcatggccagcatcgctactcactgaaatggaaaaggaaaatagaagtcagaataaaccatccagaatatcctttggatgtaatatcagcagacattaacttgaaagaaagtggccatttttaataaaacgggtaaatcttcctctaaataaaataacaaagattctgagaaattggaactctgatttaaaaatactccattcttaagacgatatagctgatcctctaacaaaggatgacactcattgcagattaattcagtcaacggcaaaatccagtgcgatgcagaactctacacaagagagaagcagcacacaaaataaagaaattaacccatctagtaagttgtaacatctcccgaaaaacaaatggccgcgtacaacaaacaacatgttcagaccaaattgttggccactcatgaaagtgtagcagagatatttatcagtggaagcaaaggcattgtagcaatgaaatctgactaatgatttgatggttggaacaaaaaaagttcccagtattctggcatctaaattatgcacatataatgcaccaacagaacatattacaactttacaaggcagggttacaatgttacaagcagagctgaattcaaccacaacattagggaggtttacacctaatatacaagagatacatgcacaattctatatcaggcaaaaaaaaactggggaaaaagaggagcacatcaacatatagcttccacatagcacgtgcacacttacatttcaacctaaacaggaccgaaccttcaagggaaaaagagcagtttgattgccaccaattaacagttcatacagccaattctcaaggaacagattacatttctttggaaaggaaacccagcagcatgatattttttcttttagtgaaacagaccatcaaaagaaaggcatttgattatgtagctccccaatccaacacaaataaagaaacacctgcccatctttacaagattccatagcataacaatcaaaacaacagcagttacttctgaattatccctacatagcggccgctgtggagccgcgtgccgaattcccaaagccaaaaaagaaaaaaaaattctggcccggctgcgtctttcctgatgacatttctctactcccagtactaaaaccactcgattaacgcgacatcaggatccgatcatggatgattcgagcaatccgtactcaagtcgcaactaaaccgtggggcacatctacgcgaaatcccccccgaaccaagaaccggaatctcccgaaccaaagccatcaacacaacccaacaatgcatcggaattaccaccagcccgcggccgcaacgaatccacgcgaaccaaacatcctaacaaaaaaaaaacacgaagaacccccacgcggaggaggattgggcgggggggttctcaccattctccgcggcggcggcggcggggggagggggattcggggccctggaggcgcgcggcattggattgggcgaatcgggggcggcgcaatcgcagggagcacgaggagaaagccctaatttattttttttttctcctcctcctcctcgtcgttttttttttttcttttcggggaggaggagaggggggaggctttccgtgtcgatggagaagggagagaggagggggttagaggagaggaagagagaagggaagagaagagaagaggtggcgggttatataggcttcgggcgtgaggcgtacgagatgggcccacacttcaggcggaggcggcggcggcggcgtggctatctgtgtgaagagacgactcgactcctctcactcctctcggctcggtgggtttgtgcaagtgctccttagagatggagcccggatgtttttttttgttttgtttttaagacaatagcccggatggtttttgaagtgtgttttggatgaaacaaactcaaggagggatttcggcctcattttcttcgcttatattttatacttaagaagatataatttgaattttcaattttaaatttgaagttgattttgagacttttcatcgaagtttattttcagcatttacttttagatcgctaagaacatatatagaaaagttttattcacaaattacttctttatttacaaatatgtcgtttgccttattccacgaataagctaaaccatgaggccgttttatcttctgcactgcattgtcactgtgtgttgtattttggtgagatcaaatattattattagttgttttacattcacatatgtaattatgtgatgtcactccggttgaaattctacgtcttgttacattttaataagatagattattatttttattatgagataattcaagaaatgctattgacaaacaccaaaatttaagagatgctatcaacgagtgcaagttctacaaaatgtcattgtacagtcaattttatcccataaacgccatcatcattggggtgccgttcatctcgcaccattaaatgaattgttcatcttatagcacttaatgagggctactaatggaaccctaatggtgatgttttttgggacaaaatcacttgtataatgatattttatggaactcataattgttgataacatttcttgtaattgaatgtttgttgatgacattttttggattttctcttttattatagaagatgcaattaaagttctacaacaattacaagtagtacaacatataccaatggtgtttaaagatatatgcaacaataaatgttctagttgaagtgaaggtccactttcttaaaaagaaacttctattaagcaatagaagtttgtttttgaataagtgtttaaaggtatcccaaacatctaattaattaaagaagtgttttcaatagatgtttgggataccaaatttaatattgggtagagatatcataggtaacatgatagatttggttttgcttttatttgttgtaggatggactaggtctattttacaaggcatgcaaaacggcaataaattataggctcatatttagctgcgaggcctataaaacaccttgagcaacgagccattttgatcctaagagtaaactgcattctgcatctgatattaaggctgtctttggttatttatcatttattacaactttgtttttcgcaatggcaaggattggtcattgcctaaaattttggtaaagattagcaaggcttttgtttggtctcctattaaagcatgcaatgggctaaggcaaaatagggcaaataatttaacaatgccatttaattgattccgactcccaaacctgatgagtaactaaattttttgtttgccaattatgagcatgttaagattgggttacaaatcaaacatatcctaagcctaccaatatacttagaaaatttcctatatagccttaaaattttaacctatccctttgatgcatcttgagttttgttcattttcttatctacattccaaaattagtttagacttccataccattttcattagttcactattacctctgtcccaaaataagtgcagtcgtggaaatccgtgtccaacgtttgaccatccgtcttatttgaaaaatttatgatttttttttaaaaaaaactagtcacacataaagtactattcatgttttatcatctaataacaataaaaatagtaatcataaatttttttcaaataagacaaattgttaaatgttggagatgaatagtgcaaaactgcacttattttgggacggagggagtattaactgacctaaaatttttaagagaagttcattatgtcctttggtacgaagagacatataattataatttttttatggagtgcgttgttggagtatcaaaatttgttgtatgggactattatattatatttatgagcttgtgtatgcgagatattatttatgacacaaaatagaggtggcataaaaataatatttatttttcaattactaaaatttgtatatttcgtattttgtacagcagcataactttttatatggagtatttttttcaatagtcatagaggcagggtgtgcgagtggtgcattcataggggtgagtgtgcacgcgttgcgagtgcatgcgttgtactgtgtttctaaaaaaaatcattacaaaaactctatatttaactattttcgagggacaaaaatgtaaaacgtaaaatcagggtcacaggcggaaagccagtgaactgttccgggccggttcaggcctgcactgggatgagatccggtctgcttgcacgcgcagcccaccaaaggcccatcaagatcaccaaaaggcccaaacatgactccggactccggagtccgtaggccccaacaggccgcaaaagaccaatcccagaagcggcccaccgaaaacgtggcgagtggagaacccagatcgccgccgcggccggccacgggcgcgaaaccgatcagccatggcatcttcctccggcgaatcgccgggttttcaggaggcctcgccgcgccgcgcatcctcctcgtcggacgcgatgccttctccgacaaccactaggtgagtcgccgctgttttttccccttaatctcaggagggagttggggttttggtagtgcgtgcgggttgcggcggcggggatcgcgagagggtggggggggggggtcggcgattgatttagggttcttaggctatcagcgctactgcctactgcacccgtcaagtatgattcccgtataaccgtattagttacgcacgtgacatcatttcaatctagtatgaactacctgtactagtacccatcaagcaaaagagtaccaagagttagctttttcgctggctataactaattcataatagagattgtggtaacttttatggcagttcttccaggctatctgtgggcttcatcaggactactgtaaaatggtccagcgaaatttcgctttatgtcaggttatcagggcttctttgagactgtaatttggtcatgagaaattcgctttatgtcaggttggatgctgcaaattatcgaccaggacattcattgtccctatctgttgcttgttgtctgcttagccgtgattttttaggttgtcaatgatgataactggagtatcactgaaggatgatggtaaagatcgttggagtgtcatgtacaggcccttgcagacatttcggtaaggtcctcctgttgctgaaaagaaactgtctgctcatgttattatctccctagtacttcgtatctgttggaaacttagactagggaagacctgcatacttataaataaaactaataattctgcattggtttgttggaatagaaaaagctgcagtgctccattccattattgcctttcagcctgttcataatatcccacaacaacgatcattaatgttgatgataccataggtgctcaaattgactaacaaagtcttccttttctagaaagggaagaactcctagaatataaaaaaagggcatgtttacctgtatgttgaatcaagttgtatttttctaccacagaatacgagcactcttaagattcagttaactatgccctggtttcagactgtcagttgagttcttcaagaaaattcctcaaagtaacatccaataaatttaccgaaaaaaaacaaggtaattgctatcggtccataactaaggtagttttggatttaagcttcaatagccacctcacatgatctttcgatctctgatggaaaatatgagagcacatcaggacattttgctatcatatttgatgtatgaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20900 - DNA, 4806 bp, Oryza sativa
acttaattaaacatactttaacgaaaaatcatactatttttcgtgcagagtgggagaagctccccaccttagtgctttaaaagtacggaaaataaagtatgatatcaaaacattaaaatcaactccaaaaatacctaaaaatcatatctaaaattaaaatttaaagagtagttaaattctataaatctacaattaactagtttataaaaaaactatcagtaggctgcgtattccatgaagcattaggagctaccacaagaatatatagcatatgattttattagaaacctacaacctatatatccgaaaaatttggggccactgccactacacttaagttcttacaagctaggctcacctacatggtataaaattactttttttggataaaaaaaatactatttgttattcttgtaattttttatactatttgttattcttgtaaatttttgaagtatccaaaatattacaagttgtagcaaaattgggctattcagcaggcgactgctgctacgtgtgtgtgtgtgcggtactgttcatgctggctgtgacgcagctccaaacccaacagcgaaacagtctatatactcatagtttcgtgaaatttatttaaaacttaaattttggctagaactggaggtagtgattgcaacgcagctccaaaccctctagcgaaacaaccttgatacttagggtctgtttgttagagctctaattcataaatttaactccagcttcacatctctagtttattttgtgagagaattttatctaactccgctcccattttaggtgaagcaatggagctggagctacccttatagttccgtgaaatatatttattatttaaatattggctaaagctagagttagtgattgtgacgcagctccaaacccagtagcgaaacagcctcaatgcataatacagttctgtaaaatttatttaaaatttaaattttggctggagcttgggggtagtggtcggttgctgtgaattgggatgatctgatgcgtgtgaaaagggaagggactgatcaatggaaggaaggaggcatggtgagaacgagtcaattgttgggcagatggtgctaggagtacacttctactaccactgcctgcctactccatgtgcacgcctgccccaggcgaccgcatcccaacaccggcccacccccacgcgaccaccaccacacgcatccaactcgggaccacccacccagcgacccaaggacccaaaggccaggccacacccagccccgatctaccctgcactgcactgctcctaccagtacaacggaaagatgagagggatttgcactattactactgtacattaggatactagcagcagctccttcatgttcctacagcttcgccaataaatacccaacagtgccctagtacatgtatatgtacgtcgtacacccctgtgtccaagtaagtactcttgctgtattaaatcctaggccctccatcaggaaatgttacaaacattttaggcctccttttaattggagaaaaacaaaggaattaaaatcctacactattcatgcctttgatttgtaggaatgagaaaaggaaaaacgtaggaaatttcttattcctacaattctagagcaaaaacgtcggaaagttaacatccactctaacctcttggaaaactttccttagtctatctctatcatgtcattcctgtatttttcctgcggtctaatcaaacggtcattcctatatttttcctgtgttttgtaatcctatgttttacacttgcaatcctattaaaatcccgtatttttcctattcctccgtttttttcaattctgcaattcaaaggggccctaagcatggagaaagtaccaaaatataaccaaatataaattttagagttttttcaatcgtatatttgtcttttacttcccttgtcttaaaatacgtgataagacatatattattattatgaatttagacataaatctgctaaatttataatattttgatgtatccactattctatactaaattgctttatttttgaacgaaaagagtaaagttctagctttatcctttaaacctgatatgtactataaaagttttatccaagtcagtcagaggccatgggaataggcttcaccgctaacaaaaacaagcagatgtgtggaagggtgtactaccatggtttgctacggagaagtgcgcagcgttttaattgcaggtccaggcatgtggctggggcacttggagggtgaatttagttcgtttcgtcggttgcgcgcatgcatccgcccgagtgggggtgtgtgtggggtgcgggtgcgtgcatgcatgcacgaacgcgtgcagaattctgcagatggagcgtgcgacgcaacggacggacggacggatcgatgatccgtgtcggcatcgacatccttccggataccgtaatggccaagcccggtttttggccgtttttgtcggagtagacgacggatacggcgctgctctgcctgccgtctcagccatcaccaaaccgtttaaatgggattaccgtcattctacgaaaaccggaaggttatcgtgaaaaccatacgtttaccgtgaggtttattatgattataaaacctaagaagattagcacagatgataacggcgagaaccgcgagattttacaaatcctgcctgccgctgtgcttttcttttgcccatctgagagcaggtacttgtactctctccgtacttaaaaaaaccaacctagtattaggatgggacatatcctagcgcaataaatctgggcatagagcatgtgggctacagatttatagccagctgcaacacggatttcaagacacaatatgtgtatgataggatagaatcagatattaataatgtagtatgtaactattgtatgaattaactattaaattaattatggataatttaaagttattagttggctatataacttgctgtgagctgatgcatgatgcaaacgctgaagcctgaagacgagtctcttatctgatgaaaccgtgatggtacagggctaaggggggcagggagctcagggacaggggtagtgttgtcttttcgcagccactgatctggttttagggggcactgctgggtgggccccctgtcactgtgctcaatatcagttgctatatgttttttcttcccctctgtttcttggctgggctcactaggaatacaggtttaggtcactgtgccaattgaagtgcctgcgatcgatgacagattaactcaggtataattaagagcaagtttaataatatagcccactgctagctccaatttatctatagccaatctaatagctcattcatataatagttatatactacactattaatatctgatcacacctgtcatatacacgctgcgtcttgaagtccgtgctacaactggctacaaatctgtagctcactgctcttctctctccttatttatctctttaaaatgtgtttgtaactggcttataacttactattatacctgctctatggggtagtgacaacacaacttgtgtttgttcggagtggctacctataggataggaagtagaagtactgtagcgcaaccttcgtgttagaataaattttttaaattaatataagatgtgacatattttaacattatgaatttgaacagacatatgatgagattcgtagtattagtgtactagattaatctattctaagatggagggggcactattaacttagtataattatttaaaatttattatcactaatattaattgttatctcacctgtactcatggagaaaagaatgaaaacgagggaagaaaaagtatttatggtttttatggttttctcggctttatcctcatttaatttccaatcgtactttacgtttgtaaaagttgagtagtctgcatagatatgcatcggatccatattaaaaggaatgattctttttttttttgcgagtagtacgtacatacgtaccttgatcaccatccatatgcatcggatccatattagtaggaaagattttaatagatttaatctaatggtctaaaatatcgggtccaccaatttaagtgaaaatcaatggctagatgttttgcttttttcttagaatttctttgatttctctaatttattagagcaccaagtggcggcttaggagcgtttgtaggaagtttaatggacttttagtatataataatagatagatagatagatagatagatagatactaagttataatgacattgccaattttccatcattttgaaatacgttattcgcattactagtattatagtgaattatctacttaactataaaaatacattatttttttaaaaaataaacttgataaataatttagaacagacggtctgaacaatgtggtagaaaagaatatttttttaaaaaaacatactgtaattttaaaagcatggatcaaatacaaataatacacggtattaatccaacggagtaggagtacacccctgaaaaagtgaaaacaacagggccaaagtgagtgctggcctgttgcctgttggcagtggcctgctgatgaattgcgccggagtagcaacaacttcaaacactgtatcctataatcaaaagctctctccatgctgctccggccggagtggcgcacctacctcactatacctctctagcgactaatcctatacgtacttgcagtagtacattggtactggtatttctacagtcgtaatggtgaatgatggctggtctggcagcttggctggtttgccctgctgcttggacaatgttagcaggcgagtctcgttgcacggttgcc

SEQ ID NO: 20901 - DNA, 12178 bp, Oryza sativa
  unsure (1)..(12178): unsure at all n locations
atgtgactaaaaagttgtgtgtgtatgacagattgatgggatggaaaaaaaaaagaaagtttggatctaaacacagtcaatatagtttattttgaatatccaaattcattgtactagaatatgtcacatccacccaaaatctcttaatatatattaaggtacggagggagtagcaagcaagcagcgcagagcagttggctcttggcaagccggaacgccgaagaagtacttagcgacgacgagggatgaaagcggtttaaaagttttcggtttttagacgcgttttagaaaatgggaaatatcacttggaatttttcggagagtttcataaatagaaacgaaatcaattttttttagaaaaaatgtaaacgaatacgatcaggctatcattttgaaaatgggaaataattttcaattattttgaaaatgaactcagattttttttcttggaatcggaaatgaagtacttttcatatttttctagtacggcgttttagatctatttttcttttgactgataaatattttttgtttttattaggccacacatactacttagggccctttaaatcgcaggactgagaaaacataggaatagaacaaacacaggattttgatgtgaatgcaaatataaaaaagggattgcaaaacactctaataacatatgaatgaccatttgattggatcgcaggaaaagcagaataattagaggagagataaagatttgaaggaaagttttcacgaggttctaccttatattagattttctccaaaacttgcaaggtattaggcattccataggaatttcatatcattctataggatttatggatttattttttttgattcaaagggttatatagaaaagatttctataagaatgaaatcctctaaaattcctatgaatttccttcgaatgaaagggtcttatagtcttttacttattgtagttctcatggaaaatcaagtgtacaactagatttttctatatggtttttctggtggatggtatttttgttggatggtcttcctcgtgggttgattttcacgtgtaaaccctaatttgagtgggataatgtttttctttttttttttggttgagatggtgtttttagggagttgttatttttataaggaaccatgatagtgggaaaaaaggggtagctccgcttctaaagtagtacatatatatcaacccgacatatatcgaccaagttcaaaaatattccaacaaaatttttatttttttcataaaagttgttcaattttcttggttcgtggtaactaagcttactgcaggaggagtccggctcaggtgcagggaaccctgcacatagtaatatacaggccaaatcaaatcgcgacacctgtacacaaggtaggtccacccaatcaaccaagtaacaatgtaaacggaggtttaaccacgatcccacaaaatcaggtaacagaaccattcacccgtttagtcctcgttaaacctccgttgcatgcgtaattaagtagggccaccctggacaggtgtcgcaatttgatttggcctgtattttactatgtgcagggttccctgcacctgagccggagatgggtaatccctcgctccggtaagataaacctgatttgcatgcggtggtgctagtcttatggccgtcttggctgccgctgccaccgggcatgttccggcctgcccggccattgccagtttgccaccaagctgtagtgccccatatgtagcagcaagtatttcttccgtcccataatataaaaaattttaagtgaatataatatattatagcacaataaattttgagtggtctgtccagattcattgtaacaaggatgtgtcagattcacaaaaaaattctcttatattatgggatggagagactattacatactccctccatccaaaaaaaaaagacaaaccctggtttccgtatccaacgtttgactgtccgtcttatatagatttttttataattagtaattttaatattgttaaatgataaaacatgattaatgctttatgcatgacttgtttttttatctttttcataattttttcaaataagacggatggtcgaacgtttgacatgaaaatctagggtttgtcttttttttttttttttttttnnnnnnnnnnggacggagggagtatacattacatgtagtactggtactgatgtactcctacatcctgcagtaagtaaaaacggagagtaaaaaggccgcacatggcacagcgaagcaaatttccattttccagcagcaatctgacgggcggagctcttaatcgtacgggcaaccgcagctgtgttctgtgaccgccttacagtagggtagtaaaagtacttccgcctagattaaagagtactcactccggcacatttcaaacgaagccataagttttcatgtccaattttaattactgattttatttaaatttttaatgattagtatttttgttgttattagatgataaatataaataatactttatatataacttatattttatatattatatttttttaataagactagaaaagaatctcgtgactgcgtttaaaattagggagcactaaattttttctttcacagacagctgccggcccatgcttgcgtacgtacaaaccgtcgtcgccaaccggggacaaaagtcctataaatacaaacaagtggcctgtatgctgtgacacggccatgagtggtaaactagtacgggtgccaaaatatggctcgctgattatcgatgagtatgcaggccggcccggaccactggagcatgcagtctacttggatcacagtactactatctcagaatggcattgtacagtattagtatcaactgaaaccactaattgaaatatgatttcactaattgatgaaccttatcataaatttagttagctttttttttctctttcagctggccgacatgatagggtaatcaaatggattaatcaatcatattccctagctaagctcaccagtgtacactgtaactcgagcagagcacagcacgcgcgcggcagcatttccttcagttttaacgacaccatcgctgcagcgtactccgcggttttctttctccgcgacgagcatctcgaggcacccggcgccgtcctctgcacgaatctcaacgcaccacgccttcgccgttgccgtagccgcgcccgcgcgagctttcacacacgctgtcaccgacaaagcaatcaccgggagaggattaattggcaatggtggaggatgattagggcacccgcaatggttatttatatgctttctataagagatccatgccagtatattttcctacttggaagagattaaatgaagagagagtaaagctatctactaacctggagatagtctatagagaaaaacgatgcaatgcattagagagctatagatacccatgtagacataatattgaggtggtttactattaatctagtatattgctgagatgtacatgttttatagagagcaccttactttaccattgcgggtgctcttagagcaagtttaatagtatagccaactactagctttaaatcatctatagttaatttaatagctaattcgtacaatagttacatactactccctctagttctatattaattgacgttttggacaagattgaggttaaacttttataactttgaccatcaataactttaaaaatatttagtttaaagaaactagaaaaacatatatagatttgtctttcaaaacactataataaaagtaaatatgcatttatttattgtatatattataatagaaaaataaggtcaaaggtatatcttgtagagcgtgtcattgttcaaagcgtcaattaaaatgaaatcggagggagtacactattaatacctggtcctacttgtcatacacacactgcgtcttgaagtccgtgctacagctggttataaatatgtagtctgctgctctttttctcttctcttttatttacttaaaatatacttatagctggattatagcatgctattatacctggggtgatctgattaactaaatccgggtgtttatctcgagatcgtcaggtcgtgagcttttggagagcagctatttcatggcaaaacttatggatttgagctcttttcctcctatacttagaacaagatatcaacagggtcaatcggaaaatattattttcttttattatgaatttctggagtggtctatttcatactgcgtagaccattatatttataggttcataggtatcattggtgctatttaagagatatggagtaagattaatgcaagatatacaaacattaaattacaatgcatttaatgacatagaaaatcccggtattaattgcatcagatatgatatagtaatggccgtcttgtaattgcacaagtatcattgctttcatgttccatctctttttatattgtataaattttaaaataaccttatttcctgacacacgtttagaatcgatacctcatttatttataaatttgatagcactcttctgttggtaaaactgacaacattcaattaataggggcataaggaaaatgcaggggataattgtcttgaagtctatagacttacatttagaaaaaaaaattaacatattcaaagtaggtactattaattttctccatattgtcccttttttctttttacaaattgaaccttttccaactcttgatttgatttttcttaggttccttttttttcgttttaaccccctcaccccctgtgcagttacaacctgtggactagcaaagattgatacagatatatacacagactgactatcggactgaacttcaccggacatcgactcgccctgtttagttcacaccaaactttccccaaactctcaactttccatcacatcatatcacattcaaaacttttctactcatatgaactttcaacttttttttccaaactaccaactttcctcaaacttcttcctaatttcaggaactaaataaagcctcactgaacggctgaacctgaaccaagcaagaaaagtgaggcgctgagctgagtgcacactgcagctggaggcctcccatataggctgccgctggagggagaggcccatcgggtaactaatccacgcgtcaaattacttgcgtgtttgggcccacgagatggaactagggagcaaacaaaggtatatatattgcttcatataatagtctcctgtccttacattgattggttcagagtggattggttcagagttgaatctcttccgagaggctgtgaattctacaaaaaggtttgagagagtttgtgcagatttatgaaggggatatgtaagttaactattcttttctgaacataccgtaatgctgttcttcctgcaatggactcatgatatttctttacatacagtatcacatttctgacagtaacaatggacctgcagtgcttgctcatgatcaagatactatcctccttcggcctttttgtccttgtcgacaaaacatgctagagattgcccaaactagaggctgtaattgcaatggaagatgacatgagctcttgtttacaacgtgttgaaatttgaaaagctcgagtcggtatttatgtaatcatcttgtaagcaaaccatcagaaataccaaaggagaaagagtgtctaatgctacaatcttttgatcgggtaaaatccatctagaaaaggacgaaaagagtgtgcattgctacttcttggtgcatttcaggcagtggccacgccgacaaggcttcgttttttacgggcaatgaacacttttgaaattaaggactggtcgagaaagtgtttaagctcataagcaatctgtagctgcaaaatataaagccagtcgacacgattcagacattcagtcgcacagcccaatccatccagagcttcagatgagagggatgacggtgaaccacatcgtcgccgggcggggccgcggcgtccagatagctggggcgatggtggctgtggccgttgctgtggtcgccgtctgcatggtgtgcggcggcgggtgcaaggcggccagcaatgaggaggatgcgtcgtgttcatccgtcacttgattctttttaggggtggagacagaaaatagtatgagtgagggctaaggatttaccgtttaggtagactaaggaagtaaaaagtgtcaaaggggcatttgcccccagtcacctaaattgagtggggccaagggccccgctggttacactctagatccgaccttgattcttttgaagtactccctccgttttatattataagtaagttgaaagtttcaaaaatttgaatgaaaaagtttcacaatttgagttgaaattttcaaattttggctagtgttttttgggtagatttttaaaaatttggagctaaaagtttcaaaatttgaattgaaaatttcaaatccgagttggaagtttcaaaatttgagttgaaagttaactcacttttttaatatttgaaataaatctatttaaacaagtcttggttacaaattatttctcgaatttcagagaagagtagaaaattatagaaataattcaaaatatatcaaaaactttcaatacagtatttaggtaacttccaattgttcaaaatgaattgaaagaagaaaaacaaaaaaatatccatacatgggcttgacctataaggcccataagctaccaggagagtaaggcgcagctgcaccgaaaagttctggcgaaagttattaggccggtccctcccaactagaatgcataggatgagagagtcgaccttgcttgagagagagaccaaaatcctcgtgtaatcccgttctcattcctatttctctgaagtttaggtaggataggatagcaattatgtgcagagagaacaccttcatagttcaaaggctgcttgatgttgaatttttttggataatgggcttggtgttgaataaaaaaggcttggataatgacctttgttagactagacgatgtgcaagctacagatggcgtggccctaactggctcttggggaatgaagtgtgttatttagttcaattcttgtttgcaaaattaatctctcttcacaatttacatcgaactatcataggagcaaagtgcatgcaaggtgttatgatgccacatatgtagcctttgaatctcattatttccaataaaaaaacttatgatactacagtttgcaaagcacaccattagctatatttgcccggtccaccgtagtatacatgcatactatcatcattaagtccatagtcatcataggtgtataattttggattgtcgtctcgaggatgggcactacggatgcttggggtaaccagcttgttgttctcatcttcaatagcttgaatattcctaacaaaagctgctttgccaaatccttcagaagcgaagtgcccactaccaatttgtggtgggtccgaagaagctgttggaccttgaacatatccaccccaaaatgcaaaattacatttgtccttcatggatgaaaattgtgaactcggccaatatccaataggtgtattatttgaaccatatgctagccaccaattcttagtctttggatcctaatataaataaaaaatatattgtaaatactccgtagtttgaagtaaaatgagcattgaacactaatatgtcttgagttatcaaactcggaaaaatgtaattagttcatcttggtttgaattggtttgggctagtttcatgatgtatgacaattgtagccatattgattccagaaggcaactaaaatggtttcagttatgcttactcgacttactatagttatatatttcatacctagacaattcaaaaatatttttcatgcccaaacattttttatgttgatcgtgcacaaatattatataattatttatgtgggtgagccttatgtagtttctcttgttttaatggaattgtaacaaaaaaattcattttaagaaatttacttacatgcatataaagtatctgagtatgagatgattacttaattatcatagatagttcaactaatattatagtgaactgactagttttgcaagaaaacaaaaatctaggagctttaccttgtacaaaaactgcatgcctagacatggaaccaatataactaatcatacatattttaagaatagaacaataccttaaaaataagaacatctattacatattgtggtccattatagacggagataggatgtactcttcctccaagaccaacactgcgactaacttgcacgaaaccaggacaattatgatcaatacaattttttttcaattcttcattatcctgttatcaaaatttattgcaaagtcaataaggaaatatatcaaatatatctatgatatccctattttaaaatttatatggtcattatagatgcttattgaaaaaaaattatgcacatggtaaaaaaaaattgtttatgccttacccaagaaatatggaacctagcaaagctgtcgccactgaagcttggataaacacatgacccagcacctatcccaactcctttgcctacctttggcacactaccaatttgtatccatgatgcactaagatcattgctatcttgcttcacttttggttcatagacatttattgacgcctgtgatccgtatatctcatcccaatatttgattcctgctacctgcaatgaaaaaaccaatgatattttgttgtgaatgaaaagagtagcataagcactatagagataagatgatggagttgaaaaatatcattggtatgtccaatgtgaggatgacaatgtgggtcctaggcccacataccatcctcacattggatattattttccacttatgcatgtttcagtgctacaacatgatgacatattacatagaagtcaatcccttattgtagttaacttgatggcatatctatactcacttcgtccgaaaatataaggtaatttggttggatggaacacattttagtagagtactacgaatctggataggctcccttatattttgggacagagggagtaccttctaagttggagcctactagctctaaagcttaacatgcaaccataccacatcatcattcactataaactgttacatttaaagctcatgcaagcatgacacatcatctacaacttattacattctatagctcaacacactagcatgtcaaatcatcatctcccacatattttctataatatttcaaaatgtatccatccatcatttcaacaatactcaacattcaatcatccatatatttcaaagcaaagcatgaggcaccatctagttacatagaagttccaatcccttattgttgtcaacttgaaccaacatcatttgaccttctcaagaagtacttgtaaaattgggtacaataaaagattttatagtcctttcaatgccattgaaataatattcatgtgagcaaatatcatgtttatggaacagtatcaaagtttcagaatgattacaagctacttgttacttaaaatagcactaaagctttgaaattatagttttctatataactggtcctaccaatggacacaacatatatttaatcttattgtttatcattaagaattttaatgttaacatccaaagattgatttgaaaatgatcatattccataaataggttatgaatagtcacaatcgtggttttgaaaatagtagtgtgcaacatgtgttcatgggactacacacaaattcagtatgatcgtaatcagactttgatcattatataattttaaaattttatgagaagaaacttaccagttgttgtaaatcattgctagccaacgtgctgataccttgcaccatcgtggtgtccagtttgttgttacgcagaattggaattgttcctatggggcagtcgatggtagacaactgtgcatgtgagactgcagctaccagtggcgatttgatatccaaccttatgggggaagagcttggttccatctatttgagatgtaaaactgtgtcaccgtatagtaaatgattggataaaatccttatttgctcttgaaagttgaccgtatcccttattctcaatgatatgcgggtttgggcccaggtgtcaatgactcgtcatgggcaataagggatagggtgatttttacatgcacaaataacattatcaatatagacttgacaaaagacatccatgaagtcttcgcatgtatagttgataatagcatagttacaaaaataagttaattatttcatttcttaatgttaaatgagagtttaagtagtagataaataatgaatattaataaaatgcactcccctccgtttcatgttgtcagttgttttgggtttgttctaagtcaaatttgttcaagtttaaccaactttatataaaaatatagtaatattttcaatagaaaacaaaatatactatagaatatattcaatggtgaattaatcaaactaattgtgtgttgtagatgctgctacttttcctatagacatgttcaagcttgaagaaatttgaccttgggcaaacccaaaacgttttataatatgcaacgaatgggaagcaaatagtatggcttgtcgtgaataaaaaccaatttaaagaattttgctatcatgattttagctacaacttgcagtacctatttattatatataatcatgaatttgaaagaatctacatataatttttggacgaaattaaactaaatcaaatttagccaccatgtgaaagcaaataatagctttgagaaagtggtttacctgaatttcatggtctttgaacagcgggtgtttaaaggttggctgttgattgacgtcaacacaatcgtatatatcaccatcttctgtctaattttatgttacctatgcttgttagacatcaaacgatgcagaatacaccctccaaaaaagatcaatagtcttgcacatacctgaacagtcttattaacttgttgatttgtgaatgttagacctgtgttttctccactatttgtggatttgagctcctttcctccgatagtgagaataatatatgacaaaagggccactcggaaaatattgtttcctttcattgtggaaatcttgagtggtgtatttcatagtgtgtacaccattatatttataggttcataggtacaactagttgtttaaaatgtattatgctgcaatcaatgcaagatatttaatgcatttatttacttgtatagaaaatcctattatttattgcacaagatatgatatagtaacgaccatcataattgtaggtatcactggttccatctttttatataaatgcctaaattttaaaataactttgtttctcgatacgcaatttggatcgatacctcatttattgataagatggacaacattcaattaacaagggcagaaggaaaaggaaggggacaagtgtcttgatgttctatcaaggtttacatttacataatttgtaacatattcaaataaggtggtattaattttcttcaaatttatcactttttaataagttgaatctttcccgattcttgatttaaaattttcatgttagattcttcaaaagaaaattgtgttagtgtttgagttgattatgtgtataaagttagttacaaattaggatttggattggctttgaactttgtttgagatttactttaagctttgctttccatttttccctctctcgattttcatgatttggctctatgtgaatggattggattttgggacttgtgcttggacagcttggtgcattcttgctagattattgagtattagctttcaacccaagttcttttactcttttgccttactggttcattcatttaagtgagtgaaaacccaatcccatagtcgtatttctgcagctcttttttagagatcgatttgtctgcaccccattccattccatcgtgctgttattttttttcgcccttttctcatcaatgtctacccaagaggcctaatttaataacaatttttttttcatttttagttttttttaaaatatttacagaaataaactatcggccaaaaaaattataaaaatagaccctgccgcccacctccggggcggcaaactgacgtggcaaacgggggagggacgggcggtgacggagggaggtttttttgcaggaaaacccttgccgccctctgttggggcggcaaggggccccaatgcaaaaaagccagccggggccggccattttgcaggc

SEQ ID NO: 20902 - DNA, 16712 bp, Oryza sativa
  unsure (1)..(16712): unsure at all n locations
cagcccccagccctcattcctccccccacaaatccagtaaaaaaagaagaaaggggaggagaagagaagaaggggcgaagccctgccggattcagacgccgatttcaggtaatattcatagatcctatatgtgactattgagttaaatactgtgtattttttaaaaactttgtttgaataaatgcattatatttttagggttttagttgtactaatctagaagtgcgtattgtagatatcggtaactacgtagatctgctagtttggaatcagtactttaccgttgcattggcatacacaagaagatattacgttgtagatgtttattgcatgaaagagtaatatgatctagttattttgttgacagatatgtcgaacaaacaaatattccaagtttaccatggcctaggaaacgtccgttacgggccaactgtggtagatctgtcagaatttattgtatcaaaaaggggaattgatagactggctgagaggagtgtaccttctataaaaggatggttaatgaggggcttgagagttgatccacagacaagtgacataacaatcaatgttatagtaagtcaggtaactgagggtttttattgggaactaatgccagttcaaaactctcgagtgtggagatggtatgtggaaaatgcattgcaacgcgggtggtctctagctatggttccgtttgttcacccgaaggatccaggtgtgcagatgaacatggatgatggtgagggaccaagtgctgaagtaaatgagacttctgtggaagaggtcaacgcacgagaggacgggggcgtagtagctccagtgggcattcaaccaggtggagtggccgacgagggggagattgtctgtgccattgtggatgaaatggagagggaggattctgacaacgagcgtgtagaggaaggtgattcgtcagatgatgagacggatattaatccagcagattgggctagtgaggatttttctggtttggtcgtctttgaagaggatagtgtgagatgggagtacaaagaaaatgaggttattcagggagcgatttatactagagcagaaaatatgaaggaggcggtaaaacattttgcagtgtcacttcatagagagttttgggttgccaagtccaaccggtcgcaatatgaagttcggtgtgttaaggaaaaagatggttgtccttggagagtgcacgcttataagggaaaatggaaggattattggacagtgtcatttgttaccaagcatacatgttttccgcacggaggtaagtatttttaaggatttttttgtacatgtctcgcgcatctatgtgagtcgattcatccgattgcttcagggtttcgtgcaccgttcagcaccccgccttcctcggctaggccttatgttgtgccccccacaggtacttaaaaaaacaacagtacttcgacaatcaatttacatgcattttatgtcttagcttataagggtcccgttgtcgatgtgtaggtttcgcccagttcgctacgacgcaggccgcccacttctcccaggctgcagggtcagtgtctcaggcagctgcgtcgacctcgcactcagcgtagttctggtagtacgctgggacttcgtcacaggcagccggcacgtcgagtcagggtccaccactggaccatgctgggacctcgtcggaccacttggtggcttccaccttgctcttcgacatcactgacttcgacttcgcttcaggctcgacagaggacgtcatcggcccctcacagctgggaggcgcaccgccggtgcagacgcaggaccaggcgcaggccactccgccgccagacactcgtgctacccgtgctgtgccaccggatcgtttcacctactcccaagaccacgtgcgagcacaggcccggaggaccaagcgtggtcgcggcgcggggcagggccagtagagcagacttctctttgtttatttgcttcacatgctagtactgtatgcttgtgtaatgaatacattgttattatatgtgcacgatacctttcggcacatgtacgactactttctgccgcaccgatgcagcctcctttattcgcgtgcgatacgagtatttgcccgccattttccgcatacgaccaatgtaactttcggcaccaatcaggcatgtaactttcggtgccaatcaggcgtacccaatatgccccgccacgttcacatgtcagggatatcactcgatttttggtgcctatataagtcgccttaacgagcgaggcctcacaatctttcagaactcaatcacattcagtactctcttccccacttgcttcattacaaatcctaccggctttcgtcaatggctagacgcctgggcgttgaggatccgaactggcgtagagatccttgtgtatacctactaccaccttggtgccagcgtcctctctgcctatgcggtgatcgatgccaactaatggcttcgaggaatcctgatattcgaggaaggcgcttttttaggtgtcctaactatgaccatgaggtattttactatctgcatatgcttattcattccgtatgggcaatcgttttattctttgtaacactactctattcggcagacccgcactacagcttgcgcatacatcgagtgggtcgatacagaaaatctcgttctcgacctaaccacttgtttacaagaaggtcgctggtatttcgcatccgaaagtactgagcaatacttatagagaaaagcggcttacgaatgacaatgtcgtgaacaatagtgcgactggcgggtgctaactacggcactacctccatgggaagcccgtccaagatgcaggtgtggtgatcgttgtcaggttcttcgttccataaagcctacaacattgggtcgaaggttctttgtttgtccaaatattcttgatgacgatttcatggtaagaatattttgattacatgaatccttattttctcacaacatttactaattttgctcgcttcacatctattctttcctcccaggaaccaccaaggagatgtcaatatagagaatggatagacaccagaagtgttctaactccacctagccgtgttgtgcagcttgaactatcagagcaatacagggttactaaagcgcggtttgagagaggagagggatcctcacgtaggggttagctattatcggacaacttggcatattgaaatttctactgtcatgcttccttatcccattactacatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctacgaccgagactgcgataggcctatatcaattatccgagtactaatacgtcaaataagttacaaaataataccttacttaacatatgaaattgcgaaacaaccaacttcaatacatttttataacaatattaacaagttttaccaataaatacttctttaattattattaacataatatagaaaaatcatttgggggtactttttgcatatgggtcccttgccgccctctagtggggcggcaaggggcccaaatgcaaaaaagtacgagccccgagctttttatgggctgccaaaattgcatttagccttgtaggggcggcaaggggctaaatgcaattttggccgacggcggcagacggcgcggtcaacccgccgtctaccacgtcagcttgccgcccacctctggggcggcatggtctatttttgtaatttttttggccgatagattatttttgtaaatatttttaaaaaaatctaaaaatgaaaaaaattcatttaataactagagaggcttgtttgattggagcaggaacagccagatcgaggcccacggggaatccccgttgggttaagcccagtagggattctagcccggtcaactacggcctttccttcctcggtcggctgcggtgcaaggcgatgttgcgacggcaacacagcactgccccttcggtggtcaccttctccgcagtaagtttctttcttccttcccctctcctctcctgtgctgtgtgttatgctagaaccggatgtggcagtgcagtatgtatgatgagaatgacgtgtagagcctaggctctcatgtcaatgacacatatgatggtgtttttcaactccgagatttttaggatggtttcaaagcaaattggcccttctggccttctcaaaatctcaaaattgttgatgtatgaacttagttgaggtttaactgactgagtgctcgagtatgttctgaaataggcacgagtggcatgtttcttaatcttgatcaggcaaggctgtgagtgatttgaaatattgcagatcagtttctgtaaacgaggttgcactaattgtattacctggtttatctctactgaaggcagtaaaaaaaacttcattcgtttgcttaggccaaaagtgtactttgcatgacttgggttgagttcagactctcaagtcctttcagcaaagttcatacttaagttggttgtttcttaatgaatgtcaagcacatgaaaaacatgggttttgtggatatggatgtcgtgaaccagagtaccagtggtctagtgctgctgattggttccttaaataaactagagcaatgaagatggtagatagcttatctgaatttattatccaatcactctaaataaaatggatattggagagagtttaattaaggcatgatgttgttttatgcattattaaatcatgctaaagatagatctggttgaaattttgttgagaattactgcttcagatgctatttatttcctcctattcgtgcagtggttcatggatgtgactagctaaacacctttgtgctgtgtctgtttttgactattcagggccaatgtttgcaatttaattagatttgaaactaatgaagcatattttatctgtggtgcattctgtaaattcatgaannnnnnnnnnnnnnnnnnnnnnnnnnntgcaaaattcagggtcgatgctggacgacagataggctggagagaaggaacatacaaaatcatggcacctgcgagttatgctcccgggaagaagaatcaatcgatcatctggttgccgttggtttgcaataatgtgctgaatttctagttatattttgagggaaccttatcattttagttattttttatgctcttggaaatgcttctgatgttacattctaaagcttagctagtgtgcagtgagcatttggagtcctacaatcacattgtttcttgattaatgctctgattatcttaagtggttgctgatcagataggcacgacaggggaggggtgtgctttttgtgtatatccaatattactaatgagatgatttgtctgggccatccttctcttaagattttccgtgaatgattttcatgatattatgctttcaggaacgcaagctgctgactggtttaatgtggttggatgaccatcagagtgtcgtaacaccatttttgtttgctctaaaactttgtctatgttcttgtcataccgcgcgaatggatcatagtctgctagaaactaattgggaatttatagtagatccctccttatcaaactgaaaaagcatgaaaatcgacagctatatatgtttagagttttgtcccctcaatagatgttcggttttgtaatgcaaatttattacaattgtcacgtcggttcgaaaagatccttgtgcaccgaaagcagttataacttggtgaatggtgatgctctatgttcactaatagtttattgcgtaggaaactggcaccattatgttcagagctgatttataggtttaattaatcggtagtagcaggggcgaagccaggaaaaatagttaccggggccaccactaactgactatagcttataataatcttaagataatcctagaacaaaactatcgaccatataatatgataaaataaagtttttttagtaaagtggttatgttttacatgttacaaacttctcatgtgtacagttacgatccttcatcttgtgaaaacgaacaaccacgtcgtcatcatttggaactgtagctatattttaaaacgcaaggagtaatccatatatttattaccgatacgattgcgtgcagtattgtctacacaactttaattaccgagaaggttatctccaatgataaaggagaattagtaccacatgaactagtaagtgggtatttttcttctcaagaatcacactccattatactttgcttgcctattaatttattaaaaaatggaatgattaatatgtaaaacaaaatacccacgctgctgtagatgatcaaaatcactaatttcttaccttccacttttctagaaagaataaatttatgtttatgtaacagaaatttggagaaatttcatatttcagaaccctaacttcctaaaattttggacttgagaaaccagcctacaaccaatttgtgatgataataattaagaaattgtgatggggttagtgggttacccttgccaatcggcgaagattgggcgaagcgcttcgagccagactgcactgcagcaggaatacagagcagcacaacaaggcaatttgtggacttgtttagcaggaatacaaagccttctgggctcaaatctcatacgtatattgggctgttgtataataagtgctagctaattttctatttactacttgttagtattgtttagttgctaattgagcttgaccagaacaatatcaccggaccaccggggtctagtagtttccttgactggggtcgtagctggtaaattagtgctggtacaagatgtttgtaaaaaatcgtcggggtctactgaccccgataagtgactctagcgtcgcccctgggtagtagtaaatcgtgcccaacccaaaaagtttgaaatcaattcctgcacttacactcccgtttctggcaccgagatattgtaaacttgtgatcagggagttgagtgttgcttttgcttgcctattcagcatggctgacctggtatctccatatataattcgttcaaacaaaataaaataaaaaacatggtatctccattaagaaacctataaaggttcgcacgctgggcgtcttccggggcgagccacgtcagattactgtgcagtaacttggtaactgttgctgtcctacgtggaccaattgccgcgcggctttgtgcgcctagcggcctgtttggttggagggagttttgcctagcggcctgtttggttggagggagtttttaggagggattgggagtttagaaggatgaggctattaaatgttttgtttggttgagagacatgggaattttggtgggatggagatgaggaattgaggaaggaactccctcctttttaatacctgggtaggggcaggtaattgggaggatgggagggaattcctcctttactttctctattactttctctaagcaaatctcagtcatccgtttttattaatgacctaatctccaactaaactccctactaattttcattacctctaccaaacaatgtattgggattaaaaatcaaatttatatcttaatctcatcatcacttctcttatgtaaactctcagtccccttccttcgagttaccaaagaagccataggtgcaggtgtggagcagttgggtagtggcctcgtggttggtaggtgcatgcgttttctgattaaatcatcgttgctgcgtatggtggtttgcggtgcctgtgtggtgggcctttttttgttttgttgggtccattggtcagcgtttgattgagtttggtttcggttgtacttcctccgttttaaatgtaagtcattctagcattttccacattcaaattgatcttaataaatctagatagatatatatatttaaatttattagcattaatataaatgtgagaaatactagaattactttcatggtaaaacggagggagtagtatttttgttgcttgcacgtatcgtcgcttcggctgccgcgcccacgcttggtgcgggatctgagttgccaatcgcgtcgcttggtctttgctaggcccacggatcattggctgggtgagccgaagccgaaggggcgcgcgggcgtcgtcgcctcgagtggaaggcacgccgtttcgcataccgcacgagctttggtaaacttgcatctgcatcaatcactgcagcgtgggcctttagttatgtgggcccatagatcagacaaatctttatatacgatttcaggggtggaaatgaggcgtgtgattgggccacgtggctcactgattatttagggttagttcatctgaaaatcagccacgtgtccctgtgcaatcttagatagtcagatcagtaacttctcaagctggcctgtcttctcctacctgattggtccacatggacttacaaaatgttgacatgtggaacaaagacaagatgcagcctgcagctagcctgctagctacgctctgctttcatggttacaatcctctagatacttccaagctcgtagaagtatagtcaataaattaaattaagaacacctagatcctttggatgatctcaaaaatattaaccctagaataaacattacacagcgaaaaacgatacagcacaaaatttaggaaaaactaggagaaataccataaattggaaaataaataatgacatgttatagtgaaaaaatagttgtcaaaagaaataataaggccaagactttcttttgagaaaaatcaacaactcaagtctagagcctagatgcttttgagctaagggtacaagcggctacccacaaaaacccacttataggctaaactaacctgcaaactcgtttattttgacctataagtgggttcgcgggtgacccgcttgcaccccaattttgagcaggtctttaaaactggagctcaaaaaataaatagagaaaacaatggaaaattaaaatgtaaaaaaaaacatatctctaaatttgaagctccaaaaaaaagataacacaactgaaaatcaaaatatgtaaaaaaaaagggagctaaaaaatagagaaacaaaccaaaatccaaaatgtaaaatttaacagcggagcctcctctactgtgttccttaaaaaaatcacaatgtaaaagaaaaagaaagcacccatggatatcagttgcactgtatagctctgacgatttcagatgctagatgtggtcgattgactatgataataattgaaaatccaacagctcgcaaacaaaattttccaatttatgaaagctacacgtaatttcttactgaacatgcatttttaaataacaagtaggtaacataataaggcatatattactattgtatttccactctcaacctttgataattaaattaattatgtaaaaacttgcaaaattattctgatcatgtcacaggctataaattttgaagcacgccaactggcgtgctgatgatttttctagtattagaactaaagaaagaagcgtggggatggaaagcgtaggatcaatatgctaagctcatttatttgctcacgttaccttccaactcactgctcatctcctctaagagcaggtttaagagcaagtttaataggatagccaactactaactccaaatcatctagagccaatataatagccaattcatacaatggttgcttactatactattaatacccggtcctacctgtcatacactcgttacgttttggagtccgtactgtagctggctacatatctgtagcccgctgctattctctctctttctttatctctttaaaatatatttatagctggcttatagcccgctattgtacctgctctaatagtatcgccagctacaggctataaatgtgtaccatgtcatcttatagctagagagtacaatagtaagctgttgacacgttaaacaagtaatatctttattaattttttaatcacctcaatctctttcttctttacccttccctctctcactccgctgcaagactgacaaaaagcaatgcacaggcgcctaggagctcgtgtgcactggcgactaaggccctgtttagatgggactaaaacttttaagtccctattacatcggatgtttgaaaattaattataaatattaaacgtagactattaataaaacctatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtttatatttaatactctaaattagtgtctaaagacagggactaaagttaagtccctggatgtaaacaccacctaatttaccgtccgctcgcaccctctttcctcccttctctcgtccatgtcatcatccaatctgacgtgtagctcatatcgccggctcaatctaccttattaaacctgctctaggagcaaggataataatatagccaacttcctactattagcctatcttaaagccaacatatataatagattagctataaggttggtacaatttttttctcctctctctatctctcacttatacatttaatgtatttgtcttggagcttgtgataagctagctcttgtatgagagccaacatccttaatttttcactacctctcttatccatctaagtttatagtaggcttataggtcactattatacttgctctaagggcacccacaatggttatctataggttctctacaagagatctatgtcaacatatttttctacttggaatgtattaaataaagagagagagcaaagctatctactaacttagagatagtctatagagaaaaacaaggcaatgcatgagagagctatagataccaatgtagacatactattattaagatggtttactattaatcgagtatattgttaagatgtacatgttttatagagagcaccttactttaccattgcgggtgctctaagacaccgctgccttcgtccgctccggtcgcagccggcggcgccacaactgttatcctcccactcccaccagccggtttcgcccttttcgtcgccatccgctccttgtcgccgtattggatgagaagctccacggtgccgccgagctcaaccttggcagattgagggacggtgtcaacctcggcggcggattgaggcggcccctcttctccaccccttatcggtgaacacagatgcaagtggtgtgggtcgacgactgcagatcgagcgatgaataacatctcatttggtcatggatcctgacgggtgagatctactcaggtgaagtttccttgccgatatgtttcttggtcttccatgctcacgtttgattcgttctattccttgtctttgtttctatcaacaaatttcaattgttcttcgtttggatcgtctccattactcaaactcgcagctattttgcattcgtgcatggtgggtaccgactcaccatcagcctctccaccacttacattttcctggtttttcctgcttaggtaagaacgccataagatttcctgtttgttcctttggtctgcttctgtcacatccttcgctcacatgccctcgtcgatcttttctccagcagagtttgatcgttgcgaagtctctaggccgcatcccgtgcagctgagcgcaactggcgctctggagactcggatctggtgtacctgcgggtcagccatcgtttagagagcaatcttctttatactggaagaggtaagaaacatatttgattgactgattgggtacggtgttctaaatgccattcaaacaagtgtttcgttctgctcctgttgttactgatctctgaaacgtgacttgttccagctttggattttggagattggtctagattgtaatcacagttgttactgttattaatgaagtgtgcgtgtttatatttttcttttggatgctgtctgaactgagagaggccgacctttgttgcatgttgtaaaatgttgccttcccctgcatattcagcttggataataaccatcgtgtggaccgcaagctacatgttctcattcttttagcctaatcagcttatcagcatagacagatcattaatcctatactttaaattaccagtccgtacattacgaaaacaatatatgagcaatgaacattgaaacaacttgaaggacagaatcaacacatgcttgttgttcatatactttcttccaaatacaattagaattgtaagatgctctacatatattggctgcttgcttgtgttctctggaaataagcaggagttggctttccttaaaaggaaatactctcggcaaactcagacgtggctggaaactgcgcgcggtcagggggagcgactgcgactggaaggaatacttcctgccaatgcgtgtcgctacccagcccaggaaccagcaaagcgacacactgatattatacatgattgtttcatcatgaggttgatttttcctttttcagcttgccatcagtatttagattcgtgctgcttatgtttatcagagtaagcttttccatgttagagtagtttttattttctacttttatggctgacagggcctttgatttggtcccggtctaggtctagctattagcttgcttgatctgatcaaacaaatcaatttctttgttcccttggaagcctgtatgcaagtttatggaaattgaattgtgcctcactacctcccaccatatcgtgcgctttcagcttgaaccatgaaaccaacactatattcatggtcccaatgccccaatgctaattttatttttgtgtgcctgttcttttggttacccacacattccctggtgtggttctcatcaatcaaggtatagattttaatatgaatctaaaacactgaatgggacctcaaaactaaccaactatatggtattataaatttaatacattgaacaatcccctattagtgtaatacttctttatcataagactaattccatttccaatgctgcagaaatcatggcatctatggaagacattggaagtgcattaatccccctagtgggtattggtgattaatgacaaatgtggttaagagattaatgagtttattgagctactttcagatgcattagtccaaggtgtggaaggtggatgcttggagaccccccaaaagtataaaatcaaagcggaccggaactcgagaagtgtatatgatagtttatttattgcaatcgagtttttaggataaaccgtactattaagagggattccaggtgatgctctgagatatgtcaagtgctcttagcgtgaaccaagtgtcaaagtttccctaggagttatttttgcaaatactccatctgtccaaaaatgcaggtccggaacttcttgtcttccaagtccggaagttccggtctgatgaaagaaattttcctaagtgttatccggaagttcctgtcttctaggtccagaacttcatgtctagtttccagttcaaaattgagtaacggctagatgacgtcacctagccgttaaacatatacagctcgtttccagctcgttttttggccattccactttcacttttcatccctagagctgttgctagcctctcctaagtgtttcttgccatctccactcaatctagagcctaattcttgtgagaaagagagattgagagggagagaggaagatttggagatgtgtgaagactaggatcttgggtgagcacttggaatatctcgtgggctgtcatctcggtgcttattactcttggagatgatctcctagacggttagatgtcgcccgcgagaatccgttgcatattgtggatgtcctgggtaagtttgtgaaggatctcctctcctccgaaagggaacgaggtaagttaatgaagttcttgtgctgagattctaaaggttttccaagtagagcaacctacacttgtggcggatttctagaagtaggttgagttggatcttggtggtcactcaattctagaaatttgcctaggagtgtttggggttgaaggttgtggatttcctctggggttttcgcacaagtgaggcaaggggttaatcgagacccagctctttggagctcctcaacggagagtaggatcacaagatccgaacttcgggaaaaaatcgctcttgtctctttctgtgatgtttttgtggatgtttctgtgatctatcccctgcttagaatacctgtgcatcatcttgtgaagattggcttagtctcctgttttgaaatttgattttcatccttgttatgtaacccggaagttcctgtcctaacaacactggaagttccgggcctggcaggccggaagttccggagttccttaccaggaagttccgggtctgtttgaattttaccgctgcgatttgtttttaagttttcagggacagtctattcaccccccccccccctctctaggcttcatcagcacgttcagacatcgctgatgaggatccccaggtagatcaaatggccaatggaggagctccattagctcgagcaatgtggatccagaagggagctgtcaaagttctatttgagtttacgtctgatggatattatcctcactgccgctgttccgtcgagagagcaatggagatatacatgaacaacctcaaggaactcaaggtggatgagccatgattttgctatatctcttgtgatttgccctttgaatacagcaaggtacataacttactccttatcatataatattacaaacagcatgtattcatatcatcttccccatatgattaatgatttcctacttcaccaggtcagttcgatgcttatactttctatcctttttataataaatcgaccacataacgtcaaagctatcagtacaatagtatctgcagtatgacccttccacttgtatatttcaatcaatactataccctttcgtaacgtgtgcctcgatacataaatctacctatgtacctaaacttgccaacagtatagccttcttgccttacttgtataattatgtgatgattgttctcctgtaaaaatatatatgtatctatgtagcaagttattggtggtactatgacgagccttatgaatctagatcagacactcttccttctgagattgctgcaatggcataacaaatatttacttttgccacctctgtgaggttgatgaaaaggaacatttctttaatagtgtcgagacgtttttaaagggaacttgctattctagcaaaatgtgtttctggttctggtgctacatcttcaggcacactgcacacatggtacacctgataatcttattgtcaataaaaaagggtgtcacttttgtgatttgatgttttattttttttctctgtgctttttaagtcaatgtacatactttccattgtgattttgttctgtttttctttcttcaccatgaacaagctttctgctttcaccttatggtcaaaaggataaaagtagaaaaaaaaggaaaaccataagatccaacaacattttcatctacttatacccattcgtaaatttattaagttgcttttttaaagcatgaattaacaatactttttaaatgtaattactcaactggtagcatcttacttgaaggcatcaagctgtaatgccaaagttatatataccatacagatgatgttatcgatccatttatagcccgcgaatattattattcatctgtttatgaacaaacctgtgtttgaaatggtggcgttgttcctctttaattatattagtagtaccgtaaatggttgtcaatatttgaatggttctcctacaggtagaagaatgatgtaaaaattatcatgcatatttgactacacatgaatttagattgctaccgtggctggcaaattttgctgtcaaacttgccatgtagacaccaaggcccactacttcaagcgaggactcctaacggacaagctatatgatgttcatatttaggagtaacaacattcagcaacctatatccccaggaggcgcgccaatgctagcaggaaactgtaagatttatttctatggagacgaaacacgtacctactctgccactgttactatgctaattagtttttgcacctgaagtgcttatcatgcatactgcactcccttgtcaatataagataccatctatgtatgtacctgctgctagagaccacgaactaccaatctgcctatatgtagttaacatggcgattacatgttttcttatattttgttcggtatgtgtctatttgcctttcctaattttcagctccttctacctaactgtctactagcggcgcacattatcagcgacggttaatattatgcttccaccgctttctaataatggaatcaacttttacaccacaccagctatatgcaattggcgcgcaaaggcgcgccacaggctctagtaatattaataggtagagccgtaatcttgagggtagagagagccgccgcccgctgctatctttgttattcttgcatactgctattggtgcttcgaccttgtgtgaataactcaccttctcaattccattttgtctctacatgttaattaatgtgttcagctaatgtctttccgcatatgttttcaagtagatggatgagtctgagtcagagcctatgagagagcattcttccttctttaaattgtcattggttcctcgaaggttagtgatttttttgtactgtaggtg

SEQ ID NO: 20903 - DNA, 5848 bp, Oryza sativa
cattgcacgactttagatacctgtagaaaagctctatatttatgggtcgtaatatatcatatgatgaactatgtttttattagacatatagaaatatcatgaaattgtcctttccctcaatcagggtatccaacttttcttgtattttcatgtctcgcatctttagaagcttgctccaagttcgcataaaaagatggccctgaaattgacttcaaatggtgttttgagaattttgcttcaggctccatcttgttccatgcttgccacagcgctattgttagatctgcatctcataaccggataagagtacaatatgatccatgcatctcaaaattaatgggaaaccttctggtttctatgaaatcacaacctggaacatggcaggtgcagagggcttggcattaatcacaactgcaacataggagcaaaccttctggttcctttcgccgtttccataggcgagctggctgggcaaaagacttagcccagtatacatataagccctgtatacatagaccataatatgataatgggattaactcttaatttatttttcttaaaaaaacataggacttggtaaatagttagttagaactaacctatatttgcaagtaaggttcaagtaccatgtagaagatcttttggtttccaaagttcagtcatctcatccagtggctagtacatgcttattccacaatattttctcataaaatacacaataatttaatttatgactttgaaaaggactggacaaacaattacttcctccgtttcatattataagactttctagcattgcccacattcatatatatgttaatgaatctagatatatatgtctagattcattaacatatatatgaatgtgggcaatgttaaaaagtcttataaactgaaacaaagggagtagttaaattctgaatctacgtgaaatcaaccattagtttatcatgaaacttataatggcaccattagaccattgggcgaacaaaatattaaatttaaagtaggtgctttctaaagttgactaataattattattattattatcatgcttgcacaggacacaacctaaatgtaggtagaatttcacttccaggttgttacatagtatgatactgcactaagcattataagtttgaagttgataagcaatccacatggttgaacacatctcagaaagttagaatcagcgtctctgaagttccgagattatttgtacattttagtaccaagaaaaatattacctggtttggatggtgccagcttccttgttgataagatctgcaagttccaaaactctcaaattttaacagaggagatacttttacggttttacctttggggagataattgcacctgttgcgtctgtaccatcatttgagggtgtttctatcataggattcaaagtatatatttggggggaagtgaagccaaaacactcagtatgaaatggttagtatctaacctgtgaaaaagatgatcacaataccatttatttggggacatatgttcagatgtcatctgctaaaccagtggaatcatagcttaaaaacaaaaggttgagtagatacattccaatttggttaaatgggtatatacaacattccaatttgattaaatgggtatatgcacaaaagtttgggtggtttctagaaattttgaaaattatgctttggaggcacaattgaaatgctttcttaatagaatttgtgtgaagaaaataaaaaggacttgatttaatgacacagtcaacaacaataaatttcttgttctatcaaacaatattattcctcaacaactcgtatccagtttttaccattcaagaagtactaatgttcatgattcataccttagatgcatggtagcaagttaaataaaaaatgaaaccacaaattttgacaggacgtttatttcataattgtcacttcaggcaaagaccaataacgcaaatcaatattacagtcattgctttaaaactcataacatcaagaaaaagaaatacctgataatacaatatttgattgctttattatttgcttcataaattatcaaaattcattcttaatcagtgaatacacccttcacagcaaaccggaagctaaatgtgtacttagagtcaaatacatttgatctttaatagtcaaatttcatttaagcttaagcaaacacattgtagaattatcttttataggtttccactcccctgcttgctgcagctttgctcgttagacaaacatatatagatacacaaatatagcaatacaccagtcatttatataatgttaggagcaaccttttttttttctaaatgcatgaatagctagtactactccttactttttttcgggaaattattagtattagttatatcccggtgaaccactgccatcgaattgattcagtgagttggacgttgggcatccggaggaaaatactatttcaatccacttataaattcatttgttatcacacatatctttgataactattgaaataattgtatgtaactatttataattaatgaacctgaagttacattttgataggatgcattctttttacagtgctcttaaatgaaatttgcccacccaaaaactgaaattacatgagaggcttaattaaggactccattatagaacttattgatcacctttttagtctaaatcaacttcttagcactaggtgaagccgtggttcctgtacatcgtacatgctttaccaagacgaacaccgtaaggagcaaggagtttagatacttaccacagctgtcgatgttgggactttttgtatttcccttggccatcgtcattggagaagtggcgctgcagagtaggtcctggggaaccagaggcactcagatggagatgcagaagataaggcggcaagtgaaattccgcgtgcatcgccgtcaggtcgagccatacctcccgaatccgaatcagccccaccatcgccggatccagaacaggtaggaggaggtgatgccgcagtagtgttggggatgggaatgaggaggaataggatggggtgtggctagggcagggggaggtggaagcggagaaaggggaggtatggattcctttgcttcccactgcaggctcttcttcttacctctccggtccccattgatgtggtggagattgggaggagacatagcggctttggagatgggactagcacacaatctagcacctccgcctcccggtcccgggagtgggggcggcgtagcgaccagggaaggggaggcggcctcccgagacggtgtcgcaacagatccaggtagcaggggtgaaaatgaaaaatggtaatactagggaggtggaaggatcttattgcgaaagattttgccaatcaatgaatccaacagctcacatcatctgtaggggcaatcggacggcctatgtttttctgatgacgtggcgcaatctggtggcgaaaaactttagtttttttcactactttagatttcaaattaaagtaattaaatcactataatttgttcggttggttcatagatgataaaacaattaacacaaaaaattttaattaaaaattaggtattcgggaaatatatctttccattgcaacgcacgggcataatgactagttttttttaacatgaaaagtacatttcattcattaagaagatcatctgactaaatcattagccacgagaaaatatgttttcttcaactaggaggtcataggttcaagtcctagttcttctcacacatatatatactagggtttggggaaaggggtgagggttgcaaaaacaacccctaaacttctagttttcagagcgcggttcaattttccgttttttcgcttcttcatatagaatattgttttcttaagaggtcctctaagtaaaagcgcacaacattagaactaaggaccagggatctataacaaattatcaagtaaatgaagggtgtttttgcaaaatcaccaacgacgacacggacgtgcgggagctcacgaaaaccacccgccatccagcgcctcgctgacgcgtcggcacgcgcaggtggccacgccagctcaaaaatctccaggagccgcaaatctcggcaggtttgtatataagcgattcttccgggattactaaataatgcattttgcaggtttgattgtggtcatctccgtactgctcgctgcagtgacccttgtttgctgcaccggctggaaggccgccgcccggtggtgggccgcagggaggagggctcgcacggtacaccccatcgacgccgccaccgccgctgccgccgtcgtgccgactgcctaaagaagcatgttacagtatatatagtgtgttgttgtcatagtgtgcctcgtcctatgtgttatatagtgttgtattgcgataaaaaaatgtactgcatgttactgcaataagtatgattgtgtatgtatttttcttgaacaaattatgtatgtgttggtgcccgtaaaattgcatgttactgcagaagtaaacggatgtataggcaatcccaatcgccgtgccttttttttagatcaaaggcttgacgcctgttaacaatgaaatttggtaatcggcaaagacgtcatcggcttagaatcattattggctgcagcatctcggaatcagccgatgggagttatcaagtcgccaatagtcggattcctgctatatttggttaaggaaatcaatgtactaaaggaagcttatccctaagtgaccgagtttaaagaggatgcggcatggcagtttatctattaattaggaatagtttgttagtttccttttatctttaggaaaatgtgtttagtgtccgataagcactttatattttccttttatctttaggttagtttctttcttgtccgacaaggacttgtatcaacccctgggtataaatatgtacacccggggtctatgtaatgaatcttcacgatcaatacaattcagcgcatcgcccaccctttttacttctactttttttttacgtgccggcggaacttggcacccgacgtggggctgcatcgtcttcgatctccggcgaagggataagtccaatgttccgtcggcccaggcaattgtctcatctacatcggcgtcgttcaaggctgcatcagtacattcgacctcttggattgctctggtttggatgatatatttgctacctatttatcatatgtatctattaatctagtcttagcatatcaatttagctctatcggttgcttctcgttttagggtttctgccggtattggctaaatcacgttgctagattagattagcttagatatctaccacacctgaaaactcagtcaaaggcttaattgtctagatattatgtctcttttcatatttagtgctgcatcagttaagtttgatctactaagtcgtgcttagaaccataatctctagcctacttcttgattgccaataagggtttcatcggggtttcagccggtgagttatctggacgttgcatcggctcataaggattgcatatacatataagttgtatttagccgatgacaacaaaggtttcactgtttaatctgatcttgtggatttcatgacatcagacctccagccgatgtgtgctttaaccttcggatcgatgcttatttatcatattattgctagccaattagtttatacaggactatattgttattttattatatcatcatcagccgattgcctttatatcattatctacattagacatatagccgattgcttaaaccatatcgctatcggctggtatcggcatcggctattatcggctatcggctgacattgctccatcggctgtctagccgatcggctgttttgtctgctgtttacatatcttgtcagttgca

SEQ ID NO: 20904 - DNA, 14553 bp, Oryza sativa
agaactccagaggactaacaactgaaaacttaaaggagctcagcctattcctgcctgcgggtggaaccttcttgtttcctcaagcagtgacgaggtcacaaaactccaagcctagggcgccctttgctctcactagtatcttctagtgctgcaaaagggaaatcacacgatagattatcgtgagcggcgacccaatcaatttatcacgaaaaatcatgtcattcctagttagccagagttgccagctcacagctgccaaaaacatccaactcagagtattatgagaattgtcattaggtttcaacattgatgcaaaaaagtgatcaaaggatgaaggaacaaagttccagctaaacccatctctagcaaaacaccatataaaagatgccatgggacaagtaaaaatgacatgttgagcattttcagtgacaccacaaagctcacaagcctctaaaccttcccagtttttttgtcacaattgttcagtggtttggatccgatctttcattgctagctagagaaagtgtttttgcttaagaggaatcggtagtctccacagcatattcattttggggtcaagtatacctctaaaatttaacaactgatataacgatttcgaggtatagactccattctttccatgaacccatttgagcacatcagcctcgtcggtgcaagcaatctcttgtgttagttcagataactccactcagtcagctctacattaccaaaaagtcttctgaaagtaaggcattctaacccctcttgagccacctctttcacaattattctttgttggttgcaaatttcatagagccccaggaacctaattctcggggggcaattacctatccaaacgtcatcccagaacaagatatggtccccttttcctagagcccattctcccccaagaacaaaccactttatgatatttagtaatcctctccagaattgggagatccctacctctgaaccatagaaaaagcctctatctctcatatacttgtttcttaaaagatcaagacacaaactcttttcttttgattcaagtttaaagatccatttggccaggagggctatattgaaagctctagtttcagtgaaacccaggccaccaaactctttagggaaagctaaattcctccatcttatcatgtgatactttcttttagaacttaggcctgcccaatagaatttgcctctaattgagtccattttctggtgaatcccttcaggcagtaaatataagcccattgcataagtagggatagaagagagacaagagttgataagaacagctctaccactatagtacaaggaacatgttttccaaaaaccgagtttcttgaccaacttctgtggtaagaagtctaggtctgcattcagcaacttgtttgggctaataggaagtccaaggtacatcataggaaactctcctaggggacagttaagcatatttgcaacactctctctgataatttattttcatcccagaaagctcttcaaaacaataaaggaggaactttgttatcacaatctctctgtcaatgaaaggaataaagatcacagtgtcgtatgcatattgcaggtgtgttaggccttcagggatgagatggggaatgagcccaaacagaaggttagcagcttttgcatccttaaagatcttcgcaagggcatcacttactaaattaaacagcaggggagagaggggtcaccctgtctaagccctctgtaagtccggaagaattcacttctttcaccattgatattaacacacactcgtcgtcgctctcttcatcatcttcagcgccatcggcttcatctgctagcaaaagttagggatttgttccatctcgtcttttttaagtttttttatgtttacttttggactttttgtctatgtgcccacaagcagaagctggagatataatacatttttatcattttaaaaaaatcagcttcatctgctgctcagcagctgctgtgctggaggaccaccacacggtggttagcagcagtgaggaaagcccggagggtgcaccctgtcgacgacaccgccgccgacgccgcgccgttgccgcctgcctgatagaactgccgccctgcctgctaacgtgatttcttcatcgacgcgtgtgtatattttacagtgtgctgaacagaaaaggggaaaaaaaggagttatatatattccctccgttttaggttacaagacggtttgacttcagtcaaactactttaagtttaaccaagtttataaaaaaataataatattttttatcaaagataaatttattatgaaaatatattcaattattgatttgatgaaactaatttagtattataaatattacaatatttgtccataaacttagttaaatttaaaatagtttgactttgacgaaaatcaaaacgtcttataaacctgaaacggagggagtatatgcttagtgctggggtgtgtgtttaagttctgtaataagtgtgtacggccgtgtttagtttgtgtgccaaaatttttataagtatacggacgcacatttgaagtattaaacgtagactaatgacaaaacaaattacagattccacctgtaaactgcgagacaaatttattaagcctaattaatccatcattagcaaatgttttctatagcatcacattgtcaaatcatggcgtaattatgctcaaaagattcgtcacgcaatttacatgcaaattgtgcaattggtttttttcgtccacatttaatactccctccgtttcaggttataagactttctaggattgctcacattcatatatatgttaatgagtatgtctatactcattaaacggaggaagtatttatacatgtgtccaaacatttgatgtgatggaattttcagaagtttggaggaactaaacactacccacgtcaaaaaaaaaaaagaaaaagaaaagcaagcatactctcgcgacgctgcagccgcgcgccgtcactgttggggtcagcggcagtgcatgagaacttgagaaggtaaccagccagccagccaaccggaacaagcgcaagcaccgtgccgagccgccgtccgccgaactggggtcattcagactggagtgcccactaacgacggattgcgtgggcttcgacttcatgtcgccggagaaggccgcaatagcagcgatagccgccgagggcgttaacctggacctcatcctcctcctcctcagtccagccctcgtcgtccatccgctggctcttctccggctccggcaatgtcatccatcccctccgccgtttgacctccgacgaggaagggaccggagggagaggaggagataagaggaggggagtgaaatgacacgtgggccgtgctacttttaatttacctttttataaggaataagttcacattaggtccctctatttgtcgcccagtccgactttcgttcctcggtcgcaaaaccgggtatgatgggtctcccaacttacaaaaccgtgcaaaaaaaggtccctcggcagtattgtgcccggttttggatgacgtggcgcctacgtggctccctttgactaggtcctcgtccaacgtggcattgacgtggcaaatgaatcccggaaaaataataaaaaaaacatgagacccacatgtcagctacacaaaaattataagaaaaggtggggcccatgtggtcccacatatcagccccctcttatctctatccccctctccctcccttacagaatggcgagcggcggcgcagaggggggcggtgggcggagcggccgggtgaggaggggcagcttgcggcggcacagagggggggcggtgggctgagcggcgcatggcatgcggcggccgggcgaggagggaggcggcgctcggcagctgggcgaggagggagacggtgcgcggcggccaggcgagaggaggggccgcttgcggcggtcgggcgaggagggaggcggcgctcggcggccctctcttccgccctctccactggcgcggcgcgtgccgccgcttctctccctcccaccagtcggccggcttgcgccgccgaccctctcccgccggcaaccgcgcaccgtagttcctctctcgccctcccgccggtcgccgacccaaacgcatcgccgctcctctccctccctcccgccggccggcgcgcaccgccactcctctcgcgttggaggtgcatgaagcgtccttggcgaggtcgctgctccgccgtgaggatgaaggagagccgagaagaagaggaagatctgagagtggagagggagaggggaggggagccggcgagctcgagctcgccatcctacccgcccgtcctcgccgaccactaacagcggacgcttgctccgcccctcttccgctgcctcgacgtcgatccctctcgagttcatgtcgagaacgaacgagcgagcgaggcggcgaccttggccggtgagcacgcctgccaccactccgcccgtcctcgccgaccactaacagcggacgcttgctccgcccctcttccgctgcctcaacgtcgatccccctcgacttcatgtcgagaacgaacgagcgagtgaggcggcgacctcggccggtgagcacgcctgccaccactccgcccgccgtctgccgtccctctgctccgcccgccacccgccaccgctccgcccaccgctcgccgccgctcccgccgcccctctgctccgcctgctgtgcagcgctcctctgctccacgcgccacccgccaccgctccgcccaccgcccgccgtcgctccgtcaacagcccaccacccgtcaccccctctgtgctgccgccgctcgccttcttgtagtatagaggggagagagaggaggaaggctgacaggtgggaccaaataggccacaccttttttaattattttttttagctgacatatgggtcccatgatttttactattttttcggataaaattgtcacgaaagcgccacgtcaatgccacgtaatcgccacgtcagtgccacgtgggtcgaagacctagtcaaaggagccacgtaggcgccacgtcggccaaaaccgccctccatactgccgagggacattgtttgcccggttttcgtaagttgggggacgagtcatacccggttttgcggtcaagggacgaaaatcaaactgaccgacaaatagagggacctaaagtgaacttattcctttttataactagcatgtgggcccatagtttttattattttccacttcaaattacaacgtaagcatcaagtcaacaccacgtgggacaaaaactagtcaaatgagctacgtaggtgccacatcagctaaaactggagacaatactgccgagggaccttgtttgcaccggttttataaactgggggacatgttatctggtttttcagttaagggcgaatattactgggcgacaaattaagggacccaacatgaacttattctcttttgttgcaagtttgtgaattcttgggtcatactgggccgtcctgtctgcatgggctgcaagtagatagcccaggtcgacttcttttctgcttttgactgttccgaatataaaaataaattatagtaaaaaaaaagaaagaaaaaactccaagcaggaatcaattccacgagatcaagaagaagaggaagaagtcgcttcgcgggcgatggcgagcagctcgtcgccgccgccgccgccgcagattcgttgcgcctccttcaatcaggacaacaggtacgaccgagcgaacgacaagtaactggattcggggggagtcggcgattctgaattttgggggtgggaagggatttcttgggtcggatccggcgacgaagaaccctaattgtgattgcgtgccggttgatttgtttcagcttgttttatgtcgggacgaaggatggattcaggattttcgatgcccatacagggaagctccactaccagaagagtgagacttccttcaatgcatcttccttttctttacccatccctctgttcttgttgctctccattgcctagcgcgaatatccaacagtacagcatgtaaaatttggcacagattgctcgtagattgtgaagtagaaacagttaattcccagtaggatgttaagctgaataaggttacattgtgctgcctgcgttagtcagctaggttaatagtcattagtgtgcattgatgtatggtagaaccaaatgaattttattgccgttagcatggaaactggctattctatcatggaggagagagttgttctgtagtgcttttataagaagctatggtgttatagctatctgctcaatttgcagatattggtggaatcggcaatatggaaatgtactttcggacaaacattcttgctatagtcggaactggtgaacaggtacctcggccatattttccctgtttgcttgagtcgttcctgctgtgtgattgtctgtcatactattgaatttaatatagacgaatttgctagttaactaccgttcaaatttatctctgcagcctgtactatctcctcgctgccttcgccttatcgacaccgtagcagctgtcacaaagaaagatctgaactttaagacttcagttttggctgttcgattaagtagaacgaggtatgtcaccagtattttatatcctagaagggactacattagaaacatgttagtttttttatgatataaagatatttcttggttaacatatttgtgcaaaaatcatgcaatatataatgatgaatcccatattatacttgctcgtttttttttctgtaaaatagttgtcacatcatgtgcaggcttgttgttgtattgcaggacaggacctttatttatgatgtaaacagcactactatattggaagaaattgaaacagttcccaatacaaaaggtgaggatcctactgctgtttgttcctggcatcaagttgaaggagctagagaaaaagatcattaagcattcttgagaagctctctcaccatatttgctgttaatattgttattctttgtatatcaggtctttgtgcattcgctcctaattcagaagcatgttatttggccatcccagcaagcacatccaaaggatctgctttagtttataaggcatcagaacctgaattaatatgccaggtaatttgaatttgttgtttattggttaatcttattggctgttgtaggctattatccttccatgagattttctcacacatccccacgcattaatgttcttctggtcctggatctttcttgaaattattgatttacatgccattgcatttcattgataatttaggatctcttactgccttttcaaatcagagggaagaaaaaagaacagttatgcaaaattagccgtgtaagatatttatgttggtataataagctgaaaataacaaaataaaccattttccgaactgctttctttcactttgtattattaattattagctttgatagcttgttttgttctttctttacttatgttatgtcttttcactgtttttgtgtaattgaccaacagatagatgctcacgagtctcccttagctgcaatggcattttcttctaatggcacgtacctggcaacagcttctgggaagggtactattattagagtatttctcgttgcacaagcaaccaaggtgaattcaacgttatttattgtctgctcttgcaaccaactagattttcctaaactctttttacatacatacttcaacagtcacacagttttcggcggggaacatacccatcaacaatatattcactctcattcggaccatcggatgatctgcccgatgttcttgttgccacaagttcatcaggctcgttgcacatgtttttcctcgatgctgccagaaatcgaaggtacatagccagctcaaatattgataattcgtggacggtgtatgtaggcatgatctgatttactccacttttcaggaaccaaacgagcaaattgcttggttcaatgattcctggagcaataactcgtgctttggatccagcaaaccatcacattattcacaacgtcatccctgcaggaatcaagaggtgttgagttcatctgatttccactactttctaccttccattattgtcattctaatctaatcctttggaatttcagctgtgtagccgtacataaggtcgaaaattcacaaaattcttctaaacttcctgctttaaggtaagaaatgaaaacgccttttttctgcccctcatctttatttagcatatagctactgtgggttagtaaaatcttacccattattgtctttgcaaaaacttgcaggactgttgtctatatcataactcatgatggatacttccgcgagtactcgatcaacaccacaaagtcaaatgaatcttcctgggttttgcaacgcgagctcaatctactggataccggttgtagcactccccagcgggaggaacaacacaaggactgactagcagactagttggctcaccaatgacagaagcttcagctgtgtgtacatacaatttgtaagatagtgtgctggtagggctggtctgtggtttgggctgagattctaactccaattggacaagtgtatcatagatgtgcccaccaatggtgagggatgattcatccttcttgtggatgtaaattatagatagtaactgccaatatggcaatataattacactacaagtatatgtaactgctttgctacacgactgacagactttgccctgagtggttacaatgaaatgaaccagcatactgccatactgacagaagtccgcgcagattactccacactgggtattgttctactgctctaagcatcatgaaaccaaaagaaaaatacataagtgcaaggattttgctaatgatagcgaacattccaatttgttttcccttgcataacggcacctcgataaaaaccggcgctctgatgatcataaacagcaagatataacttgcataaaacaatacatcctttttagactaggataatgactgactgcagtccctacaatattatctctccattgtttttcttgtctgatatgccaaaagtctccatttcaactcctccaaaaaccttattgttaacacataccttctcaatccttcccgtgctgttccatatctaacagcatctccacaagatcagatctgaccaaaaagaagtatgtttgcattaagtatgcagaaatttgcatcagaacaaattagggatttctgagcatcgtgtccaatttctactgcaccaatatacactttttagaatgtcgccaaaccatatgaaaaatgttaatgagggcaaacatggtcacctgggctgcctttgctttgagcctctgtatctcgtcctgcgaacacactaacctgcagtgctccaaaatttcaggactgaagctatttaatttctttatcaattcggtctaaaaggatggggtaaaagatcattaccgccattgcagctcagtgatctcattgaccagctccttctccttttcgtgtgccgcttccaactgaaaaggtagtaatgtctttgctcttataaccaattactataacaactgacaattataaatagcagtcctgcaatgtcttaaattattttccccactctgatatgatggcactacatattaggaattattatatagaaattactagtatttggttctctataatctcgcagagttaactttgagattcatcctagtgtggttaactcaccaatgatctgtcaattgataatgctgatgatggagatgatgcgcgacttgcaggagcaatgcaggcaggtgacgtcattgccatatcgcaaccacttaactgtttcatcgcatgaagtatttgctcctgcaagtgaggccaagactaccatcaacagagctgaacgtattctagctttttttttgtgacttgtgagtttgtgtgggttgagagatttaccctctgaagcatatttgtctgtagaacattgtacagctgcatataaagggacccaccaataatggttgatgcagcctcaattgaggatggtatacttaacgaaggaaggtgcgaaattgcctacgtgaaaacaaagtggcacgtatgttagtgggggaaaaacccacaataaaaaatgacctgtatattgctcccaacagatggcatcaattcttgaatcgaacgatattgaaaatcctagagataaagctaataacctgcatgctgtgactcttctgtagtccaggtgagtgagcctgaaacgaaaaatcatgtcatcccagagttaacagaacatgcagtaagtatttatggctggaaattaccttatccaactcaacatgcccaggcgtaactttaaaacggcctctttgctgtataagaggaggtttcgatctatcgtcgtggtcctcaacatttgctgctgtattaaaacgaagcacgttaaaccgataggcaaatacaaggttttatgtagccgtaaggaacttgttctgatgagttaccactgagttagctgatgctcaaacgtgactgaattgtcactacggtgaagaaaaaataaacagatttcagggttaaatgcatttcactacctgatgatttaggcacctttggaacagcttcaggggatggttcatctgcaacttgcaagggtcctccgttgcacttgtcacggttatgaatgttaatttgatgcttcgagctgaacgaataagaggcatgctgttacagactgtttaaaaatagcacaatagcgtcatgttaccagcaccatataacaatagcttctcaagtaaaaagggattcgtcatattcatggataaactaaaacaggtcctaaaacaagatttgaatcattctcaaacaagtcagttcaatgtttctaatttttaggttgtgctgctacttgggaaaatgtgattcttcaaattagcatgcactcgtcagtctttaaagttgaacaaacctctctttggatgaaagaaatccatcagatgagcaagaactgaaagaaaacttcctttcatgaaatgagctgaatgaactggttggaatagcatctgaatctttctcttgcaagtccagttcactactttctgtggagctgtgtttcctgacctggccatttgcatgtaccccgtttgtagtcctgagcattgatgtattcctggcaatttaaattagtaaatgacagttttcagaagagaatagtacaagtacactgcagaaatagcctatataatctggcactgccactactctagtgctcgaacagaaataagaccctcttatttgcaagcaactataaaaatctgaataaattaaataccttgctaaacaaatggggtgctcaggagatgaaactgctgacttatcattgctcatcacatcattttcctaccaactttgctcggtattagatggaagcaaaactttatactaggttagaacacaaaactttatacaaaaaattatacttacggtgtccgtatcatacttaattgaaaaaactcttgacatatgaggtcctgttgctcgctctggtaaaatggtgtccaagtcatagaaacatgatgcatctgaatctttgcacgatatactgtcatcacactctgtaatctgcgaacagacagatagagaaattacatgatgtgaatcaatgactaaagaagagaacagaactagttcttacaagtgaagcttgagacttcaggtcatccatatcaaagttccagctactgatgcctcttttgtattcatcctatcaatataagaaacaagaggagcaattatttgcttgtaatacaatgtcgacaatgaaataaacatataaataccaagacaggaaaaaagaaatgacctagaatcctaaattcaggtaataaatgcctaataatatgttatagttattacactaagaatgtgtaagtttttaatgctgcaaaacagatattgcaatttccgtacaaatcgaaggaaattttctaatatggactactcacccgaggttatgatcaccattattatgttttgcacaatatgttttgggaatcctttgatttacttttttttttggcaaaaatataatagtacacaacaataacttcattgatcctcgaataaagaaactaatgagaaacaagtgtatcatttgacctgcacacctgcttagaaatgcttgattatttaatgacaccatcacatatatacaattatacaaaggcgtactgaacaggctcagtgcaagagaaaatattttatcaatttactataataatagaaccatagttaggaaaggtataaatcagatttttttttctagatgatctaacagaaatgtagaattggcacctgtgagatttcttccttctgtccatcaggcattttcttttgagaaagtaaaacttcatccttttcctataattaatagtaagctccactgttaacttagtgaagacgatcatttgcccccaaaaaactagttatagagccctaaaccagtgtaccttcagagctaaatatctggcaccaaggccaggcaatccctccaaaagctttcgactaatgaaatcactggagcgagcttgcttgaaaaagggttgcttcagcaattttttcgctgtaggcctttttgaagggtcttttaccagacacatagcaaccatttgcttgaaatgctgatataggagataatcgttgttgacaaataagaagtcatgctcatcataaaaactacaatggtaggtctgttcaaatattaaacatatttacccttgaaaatttcttatctctctcatagtcaaggcccggaggggcattctgaagtgtcataagtaagacctgacaaagtgtatgaactatataacttcagaaaagtccaccaaacccatcataagggattgtctcgaatttatctcaatgtcatgcgtttgattataccttcatgggagggaacttcgagaaaggagcatgaccatgggcaagttcaagtgcagtaattccgaaggaccatatgtctgccctgtaatatatttgtaagatcaagcttgtaaacatgccatggtgaagaaagtatccagacagttaaaataagtagtagcctacttgaaatcgtatccatgtagctgctccataacctctggtgccatcctaataaattacagtagtccacagattagatgtgtgaagacacgttaatggtgcataaatgaaagcatatttgctactttttttcagatgagtaccagcaaggagttcccacgaaagtattcctagcccgttgcctgtcaccagaatcaaaaaggcaagcagaaaccccaaaatctccaagcttgactacaccccgtgaatcaacaagtatattccctgcctatgatcgaaacaaagaatgcagcaatataacatctccataaacaactaattcgagaatatctgtgtgagatatccatgcatggctcaacagccatacataagaaaccagctgtggtgcaaaatgttcatttaccttcacatcacgatgtatatgcccatgatgatgaaggtactccaaacctttcaggacttcacgaagtacagttgcaatgacagcttcttcaaaaccatctggatagactgacttcattatgtgaaggcaagaccctccagccatgtatggcatgaccacccacaacgagtggttatttgtaaatgaacaatgtgccttcatgacgttaggctgatctatgagaatcatcgtctgagcttcacgcatgatgttgttctgcgtcaagcatatccgtgttactatcattttagacagatcaagcggcggtacgtaaatcgcaacaatccgagtataacctacttgcattacaactaaccactgcaacaatctgacatgaatgcagtcagcaaaaaaaatttgagctataattaactgtaagacaacagaaataatatatgaaaattttcgatacgatagtatgcgactcattggaccaaccgaccgttggacaatatcatccacaagtacatttgtaaaaattaaaatgcaccggaggataatagtttaattaatctgcaaatcaaacaggttaattaagcgagacgatggatctctctccctctacgcaggattgggcccaacaaacgaattggagatgatgtacgcgcaaacgtaccaggtcactgtttgtgcgctcgaagtcgagcaccttgacggcgacgatctcgtcgaggggcttgcagagcgatcggtacacgatggcgctgaccccctgcccgatctcctcgtacagctcgtagtcctccacgcggatcgggtacttgcgcctctcccccgacccacccaaccccgccgccgtcgccaccttctcccacgccttggccatgctcgatcgatcgccccttccctaccaccaccacccccacccgcatccaccgccgatcgacgaagcgtacggggacggggcgctggaattggaggagggatttcgaggtggaagtggaggcgaggagggggaggaggaggaagagcgggaagagggggacgtgtgaggtcgcgcgttgcggaggggagcgagagagagagagagagagagattgggggaggttggatcatggc

SEQ ID NO: 20905 - DNA, 10281 bp, Oryza sativa
aaatactaacggtactacatcggttacttatggtccatcggtcttagcgaaaatttgaattttaaaacttaattttagagttgattttaagaagtttcgtagtttactttttcaggattgtctttttaaattgctaacaacatataaaagtttctcatcaattatccttagctgcttcactcaatttatttattttttatatcttatcagccgtaaagaaaatgatggagttgtgattttgtaaaatgagagagttgcttgtacaatttgtattttgtttcagcgattattaatcatatcatgcaggaaagcaatcatatgaagatgacatagatggcgggattagagaaggctcacactgccccaataattatcctcatagttataggaataccttgcaaaatgttaacttttaataaaattatgaaatctattagagcaagcatccgttgtagtctagctggttaggatactcggctctcacccgagagacccgggttcgagtcccggcaacggaatttttttgttgtttctcgcaccttcggtttttatgcgttttgacccaacataaaaacggacagcatgttctgttaccttcagaagactcaaatccttctctgatttcaaacaagacgatgtccgcaccacctgctacgtttgcatgttctctagttctccacgtatttttctggttcagagttcagagtgcaattttgcacagctcgtccatgtaggacgacaatacttcacacatgcactactactctactggagtacattggcttcctaactctgaagctgtataacacttctctccgacgaaacgaaacgaaccccaaccgaagtggtaaccggcgaggtcgccttcctttggattggattggattggattgcgactgaaacccccatcagagttcagaaacgccacacgggatacgctatgctttgctttgcttcagacgcttccgatatcccccacatcctcaaggaagcaaccagacaagcaggatccaactgactggatcattggaggcaggagaccttgagctggatatgaactatgaatatgcagtgaccccaacacccatatggagtactgtactatcttatctgaagaagagaacactcacctggacgtgggctcgtggcacaagctggatatgaagaggcccatgcttcatcaatcatcggagtcttgcattgcacgtcctaaaccttagcttcagttacaggtcactttaacttgacagcaacgaccaatggctttaggttattttccctttacaggttcaagttggagccaagtgtgtaaatccaacagagaccagtacattactcgtatacaacaaaacaagatcaagtgatcaacctaaacaagttatttggctaaggccctatttgttttagcttaaaattattgtaatctaaattattaaatcagattactctaaactggattataataagttgacataaaataagctgcaagttgtttgtttctctggattattagaggcatctaaaagtagtaggtctttaaccactcaataatctgaaaaaagctcctctataggagattattggattatactaatctgacttatagattataataatctagcataataatctagttgtttgtttcagcttacttctgataatctagattataataatcataagctgaatcaaatagggtaaaaaaaaacaggatgcagttgggcttaaaataggtttcagattagcaaagcagtacactttttccgtcgttgtcctcttttattcctcgcgccattgcactctgcacgctgcgctgcagcagagcagcgggttttgttgcttccctcccattagatgggtgggggcccgacctggccattagcaacagcgagcgcactagtcctccactgcccaaagtaaagtgctccatgtcaacaggtgaggccgtccgggagatgatcagatgaatcacaattaacttctacttgtatttttattgctatcatgaaacttgtcacgactcaccaccgcacgaggcctctgatggatgcaattactgtagatatgtttatgttaatccttgtgtacgtcaaataaatcggcagtacgccagtacgtagtagggcaatgacaacggacagtccaaaccgacgtcgaatactctatagtatcccggtcgacgggtcgagagcccgaaacggtgcaggcacagcacatttggtttcaggccttttcaggttgcagatgcctcgactctactacacgcgtgtcagcgtcttgtttgcctttgcctgggttggcgcgacacagaatcggagatgccaccggccaattgatcctggactcgtgcaacccgatacaaaatgccacgggaagctcgggtttgccgaaaattcacgggaccttgctccactggtcgcacatcccgatttcacaccggaatagtagccgttttactcgtttttcccctatcctgacgtagtgcaagatcatcatttctactgcaatgtgcagagagcaactcatgctcgggttgcaaatattaattcaaaacgatgaatcatcaacggattctcttcaatttatttgctctaccagatttacaattaacagagtttggaatacaaatatttttttattaatcaaatcctgataattagaagcgcagctcatgagggtagatctcaagaacaaaacacattcttattccctatgcaataaagaaaggcagttcgggtacagctcagaacgacgagaggccaccgaccgcgttgacgggcccacccatgtggtccaacgtgggtttaggtgggccccaccccgacaatcccgccccacctccatccacagccacagacaggtggtcccacctgacgccataaagcaacccggccccaccgcccagtgccagcgacgcgggccagctggcgaccacctcacgcccttcgaggcgccactcgcttttccccttctctctctctctgcttatcttatcacattagaaaaaggcccacggttggctcatatttacaggagactgccactgcttctcctccttcctatttcttctcgcattctctccctcgtctccgggagaaaattttgcgggcggcgaaacaaactagtaatcgattcgaaatttaaacgcattgttgttttattgtttgattagtttagctcaagaaagattcatagctcagctatgaccagccagattacacacaaaaaattcgagggtgtgaaacgttatggagaacgaaatttacagaagagcatggagaagataaagggaaaaggaagagaaaaatgctgctctccattgctttcttcttcctccctcccctcccccaagaaaagaattccccccagtattccaaagaacatcctaaaatatttcccccaaaaaaaaagtcgaaataagaatgttaatgttttgatcctggagtggaatcgaccactggatggccagagaataagaagaaaaaaagaagaaagaaaaagaaaagaattagcagaagaattagggcggattatagtcacaagttcttggatcccctggtgtagccgtagtaggagaggtaccacttgacgaacttcttgagcccgacgtcgaggttggtggtcggcttgtagccgagctgctgcctcgcgagggagatgttggcgtgcgtgaatggcacgtcgccattgccgggcatctcgaccacgttcttcttggccttcacgcggaggtgcttctccaggatggacaccaggttgggcaccgtcaccggcgaggtgttgccgaggttgaagatcctgtagggcgccggcccgcgcttcttgcccccggtgccggtgctcttcccggccgtgtcgagcgagccgaggcagcccttgacgatgtcgtcgatgtaggtgaagtcgcgggcgaggtcgacgcggttcttgccgcggtacaccgtgatgggcttcccctgcaggatgttgcgggtgaaggagaagtaggccatgtccggccgcccccatggcccgtacacggtgaagaagcggagtccggtgatggagaggccgtagatgtggttgtacgtgtgggtgatctcctcgccggccttcttggtggcggcgtacagcgacgccggctggtcagtgcggtcgctctccgtgaagggcaccttgtcgttgaggccgtagacggaggaggaggaggcccagacgatggccggctgcgggtcggcgtccttgcatgcctcgaggagggtgacgaggccggcgatgttggagtgcacgtaggacgccgggttctccatggcgtagcgcacgcccgcctgcgccgcgaggtggagcacgtgcgtgaagggcacgacgtcgaagagcttggcgaggaggcggccgtcgttgatgtcgccctcgatgacgaacaccccgtgcgaggcgagcagcgacctgcgcgccttcttgagcgaggggtcgtagtaggagttgaagttgtcgatgccgacgacgcggtcgccgcgcttgcggagcgcgagggagcagtgcgtgccgacgaacccggcggcgcccgtcacgagcaccgacatccccgcgcccgccgccgacccgggcggccgcctcggcgcggcggacgcgcggatctggcgctcccagtgcagcccgccccaggaggcggcgaagtacttggacgaggtgtcgacgaaggactggaagctgaggtacgacgcggtcatggcgacgaggaagagcgcccagaggaacatggtgctggtcgacgcgaagcagcggtggagctggcggttcatcgccgtcgccctctcgatcttcaccttccccggcgtcgacgggaacatgtcgtcctccagcacccgcatcctcctcgcccgtctagaaccttctagattaccaaaatcggcggtgccttttggatcgagggagttcttggggggggaattcggggattggaaaaaaatattattattagggtggggaaaggaggggggcaggggctagatgtgcgcctgcctgaggaaagggtggagatgggacgaggccggatataaatagggggggaggagacgcgtgagcgccgccgcggcagctgctcgctgacggtggcggccggccgcctggctggttgggtgggtggttggttggttgaggggagggtgatcggtttccgtttcctttccttccttttctttccttcctctctttgttgtgtggaagggagtatttatttatagtagtttgttgctatttttgatggatttattttatcatatattgatcgattgggaatggctggttttgtgtagtgatttgtgtttccgcgtgaagagtgtgtgaattaatctgctgtgaatggcattgcgtcgtgcggtaataatggtggtgaaatgaattcacgcgtgtggagaattcgacgagtttaatggaggaagcttccattgactgggattttatttatttttggataagttgtttttggaatttatttattgggggggggggggggggacaataattctgcccgtagaaatcgtgtcacatggggggtcagatttgtgtgttttagtttatctggaagcggtgtttaacgtggtcatgcaatggcaatagcgtggacagtgtgattcatcttattatttccaggtcttcaggagcagattattttacggtgaatagctaattcggtcattaaacttttgttacgtgttaaattagttcttgatgtttcacatattctgaacaagctttaaaagattctcgtgtggcttaaaacagttctcgaacaccattaaaaatgccacgtggtattaccaagttattttgcacataaaagtcagcatttaaatctccatatttacctgttacaactatgggtgtgttcggaaccctggttcccaacactaagtgcccgcacggaaaacggagcaacgattagcaggtgattaattaagtatttgttatttttttaaaaaaatggattaatttgatttttttaagcaactttcgtatagaaactttttacaaaaaaaacgcaccatttagtagttcgaaaagcgtgcgcgtgaaaaatgagggaaatgagttgagaagagagacggctgaacacagccatatatggtgcacaatgtttagctttatattttgagtaggaaaaaaaagtgggtgagagaagaaaaaggagaccccgaacataaaacaaaggaagatgtcacattgtttaattaccaatgcaacatctgtttcgccaatgaccaaaaactgaagacccaaagggcaaaagtatctgccaggcagggagtccttttgattcaactatactaagaataacaaacccttggcgacccccaccaaatggttgggcaaaatcaatatggatggggctttctcctctaatgaaggaaatggagcaataggaattgtgattagaaatattgacgggagagtaattctaacgtcctagagatttttcagaaaatgtgtggcagcagaggaggttgaattatttgcttgtcgtgaaggcctaaaatgtaccaatatcggtcgagtattgagtctgactgtggcacggtaattggaagtaagcctgctaatggattgagttggaatggcttaaatggactggattctagtttggattatctttgattgggtgaaaatgggttgctatttcaaatggattggatcggttttggtgacacataagtggattggtgtggcctggatttgatttggtgatatcgggttgaaagtggatttaacccatggatggcaagtggattcctttaacagaccgagtttgactactccttgttgccgtcctcttcgtctcgggagaggtcacacatgacctggacttggtggcgacagtcagcggagaggccgcgcatggcggcaccgtattcgtgggagtcgaggcagttggaacgtgtctcgttgcatctcttcgatctcctcccgtctcgccgctagagctacccgctcttgtgccgactaggcttcttgttgttgccccactgctcccacatggcgattggatttccttgccgtggctggtgatggcccgtgctgagcctagacaacatctactacggcggggatggtgccgctgggcatggtcaccatagctaactgcaggtgtgcgatatgtacaagggagcagttgtgtcgtcggcccatcgctcaccgccgccaccgccgaggagacggccttagcgagctggctggcctcacgatgctcctgcgcctacgtcgacgtgaccgtagctgagaacggcgctggcgtcatgtcctctgccgtcaccacgacgccacagttacatgcatgcaacatttgctctatccagctgcgtcgccgccggtgagtacggcatgactattgaaggatcgaagtggatttgatgtaggtttaaatggtttgggaggtggattgaggccataaaagaagaataggttggttcggtttagactaatgaggaaaatggattggtctggtttggattttatgggatggctagtggattgggatggtttgggataacattgctagctgttgtggattggattgaatatggggtggatcttgcccaattggtaggcttaatttgggaggttattggctagagaggaagaaagatcaaggtggacctttctgctgcgcgcaacgaatgatacaatgtcatttgtttaagaagtgtgatctgtcacactgtaaaatagagtgtaataggttagctcatgatattgcacagcttgcaaaataatcaagtcagaacgcagtttggtgtgagactatcatggcttgtgttatgtatatgggcagcatgattgtaatccagttacttatcgataaaactctcttttccaaaagatatgccgttatgttttgtttgtttgttcttcattgtttttccttttttttatgaaaaatgtaatagtagaacaaatattaaatgctaaatttgtatgaatggatgatgtggaatgaccattggcgtttctagtaagcccgaagactatattaagccacgtcagggaccaaaatgacgttgaagtgaaagttctagggttatcaaccccgttattttgtccacggcggatgacatcttttttctcgttttcttgttccaacttccaaactcacacagagccgacagaggttgctcatgcagtcatgctccagtgctccacgctagtcagtgccatcgtggcaatggatctgaaggccgggggttgaggaaatccaatttagaattcatattgttagacagaccttgctagttgcctttcttgttggacccataccgcacgatcttctccgtgtgctaatcgcctatcactgaaaccttcccctgcgtttgtttgctccagcctccaggattttatggcgagtactcattctatcctataaaaaactaacttaatagctaatggcatgtatggttagaacattagtccattagtccctataagagaagcttatagggactgagttgtttctttccacctgctgcccccactcacaaccctatcctctctctctctgcattgttttagaggtaacatgttctttttacagtgcaattaataatctttagtctttttttaatccctgtatccaaacagacatggactaaagttttttaagtcctacgactaaaggatgcaaacaccaccctaagattgatatattctactaaaaatttagcggtttttttttatggaaagactacatgcgccagccggccggctagatcgtttgctagatttgtgtctcgcccacgatcgtgtacagttggaagtcgcccacgatgcgttgtcgtaaacgacctcatctacctacgcgcagcccagcaaccgatcgagagagagctcacggttgatggccgccgcctcctgcattcattcaggtaacagtagtagtgagctacctagcctccctaccagcagcacgagaaaaaagaagagaccacatataatgttgggttgttggagagaagccttggattcacttccaaacaaaggatccgtcccaaaattccccaatccaatcaacacagaaccagccagaacccctagagggatcatctcatgtgcgtcctcttgacgacctttccacaccccccaagccaccattgctgccaaagtggcaaatgtttgcatcccaagcctgcaatgccaagcactggctgtgcacggatacgtactgcccatgtgacgcctcctacccaaccctgctgcaagtgctcttgctgagtcgctggtggtggcctagtgcatgcatgtctcagcctttcttactgactagtctctctgtttcataatataacaacatgatatgaaatgagatgcatcatattgttacaaaagtgattcatcgtactaggataagtttaacacgtactagattgttgtattatgggaggtggcctagcgcatgcatgtctcagcctttatcactgactactctactctgattatataacaacctaatagggaatgagacatattctaatattacaaatgtgaacatgagatttgcacagattcatagtactatgatatttttttattttatactaaattatcactccctccgtctctaaatatttgatgccattgattttttttacacatgtttgatcgttcatcttattcaaaaacttttgtaaatattatttaaaaaattgagtagtagtagtatatttaacaatgaattaaataatagaaaaaaattaataattacttaattttttttaaataagacgaacggttaaacatatttaaaaaaccaacggcgttaaatatttaaggagagagggaggagtattatactataggatagaggatggagggaatactcccctagctaactgggtgtccccagcctaatcaacactgcgtcaagcgaccgtaatgtgaagcacggggggcttttccccgtgtttgggtggtcaaaagctggcttgatctgtcgttgggacgtgagtgcccacatggagtaaacagtgggacgccgataggatcacttgtgaactctgatgcgtgcatgcgtgaatggatgcttttttggagattgcttccttatgagtggcgattaattaagccagtgatatactccgatgagtgagagggtgacgtggcactaaccaggaacatttgtagttgtaggtggggggaaagaggagaagagcattggtcatcatagctcggtggatatggaggccgatcgaacttattcttctttttttggttcggttctgatttctttttcatcattcctgcgtgacacatgag

SEQ ID NO: 20906 - DNA, 538 bp, Oryza sativa
cccccacattctcactctcactgaagctagctttctttctttcttaagctttttttctcgctttcgactgctgctttggttggccgagccagtgaagtagtgaagctgagctctcttgcttcctcttctcctccagtagctgctgctgcctttatgctgctttccccctcctttgacgtgagaggagatcctctcctcctcgctcttcttccttctcctgctcctcctcagctggggggtgggcccaccaccaccaccaccccaaatctccttttcgctgccctcaccacctccaatggcgcctcctcctcctctgcttcttcttcttcttcttcttcgccgtctcctccaatcttcactctctcctccatgctgctgctgctgcaactgcaagaaaaaagagaaaggcaatgtaaaagaaagcgaaagccagcacagctcaagatatattctataaacaaatccatggacaatgcaatgcagttgccgacgacgttgcactctctccctacaagagcacgctttagaccaaaagatc

SEQ ID NO: 20907 - DNA, 504 bp, Oryza sativa
aattcctgcagccccaatcagtttttgctcttgaaaatgtaagggttggcaatgcctaaaacttgccagaaaatatttggttaattgggccttgtcccaaatagtggcggttttggtccctggatccttggcttcttcaccaaggatggtctacttatgtcattataaatcctttgaaaaaccgttcgttggtcttgacctgatgtatgctaacaagttatcaggctgtcatgatagcaaaacacactctgaaattaaagaacttccatataatcatgtagttataatgttcacctgtatgcattaaattttagctagagaagtgcactgactcttgaatctgactaacaatatgtatgttccagccaatggccggagcttgcaacaagaacttaacaaagaggctgctgatgaacaactgaacaatcaggctcatgaagaggccatgaaaatagatgatgcaaatgcagtaagtactgacgacgatgttcatccagatccaaa

SEQ ID NO: 20908 - DNA, 1577 bp, Oryza sativa
agcttaaagtatactcacaaactggattctcgtggttatacagtttaaataagttataaggatgtttcagatttgctatgatgtttttgcctttccatttctattaaatgtactgagaaagccaattttgtaggtgcttgttttgtattatggaagttataacagaatgatatgaatagcttatgacatacgaatatatacttatgtttcctaaagtttattactgagttagtgttttgtcttttagctgccacaatggaatgaaatgttgctgaaagagaatctcggatatattcaatggaaattaaagtctagagaaaaaaagtagttcatgccctagttggattctcccatatcagtatgtggaaattgaaatgttaacatgcataaaataaaattggctttatttaagaattccaagtttgattttttatgggtatattgggtgctgtgctctgattggatttgctaactgttgtgctgactcactttctatataatttacattattcaataatttccttaaggatttatcttttctagcctgcctgtaactattgaaatggaagggagtcttaatgttatactatatttactgccccaaatatctaatctgttctccacccacaagaccacaactaaacagtaatgcccattgctcatcatgtcggagaatgaggttttcttctatttgaacacccattaactttcactcacccatcatgtcagttgcactacttgaacacccattaaatttcatatcttgatctcaagctacattttatttcattcatgatgatagcaagaatacccaagtatctggtgacttgtttggcattgatttgggtttctacaacacttacagcttcagctttgattatttgcatttaaatgtcttgtgtaatgatccatttctgcatttctgcatgcacgacaccatgacatcgaccgctgccgccaaccaaattaacccttaattacttaatgtcgatcgaccatgcatcagctgacagtgttggtactagttcaatatgatgaaagctaattgattccgtgtccatgtagtggactcatgcggcagggcagattaattagcatgcagctgtatgtatagtgtatagtggtagtagtatacatactgcattcttatgctcactagaccgctgcatgcatatgcatatgcgccggtggatcgatgcgcacatgcatattgttcaattcttcagttgaaaaataaatctgagtattttacttccataaaagtacattttggtagtattaaattacgtggtttgacttattgttgaattttgaaaatatgaattgtagaattttggcatggctggcaatcacattagtttggaggagattgcagagcatgagagtgtgataaccaaggagtttagaagcgaggcagaaggatataagttctataatgattatgcttggtcgaaaggttttagcatcagaaaggacaatgttacgtacaatggagatggtaaggtggtatggaggcattcatgttgctcatatgaaggctataggttgttgaaatactttgaaagaacagaccaaat

SEQ ID NO: 20909 - DNA, 11225 bp, Oryza sativa
tttggaggtgttgtggtttttgacgccacttaccatgtcaaccgtacaaccttccttttgttccttttattggtgtaaaccatcaccgtagcatggttgtctttgggtgttgtctttcaaatgagacggtttcttcatatgtgtggctgctggagacctttattaaggcgatgggtggcaagtgccctaaatcgtttatcaccgattgggacctttccatggcaaatgccattgccaaggtctgtcctgatacagatcatcggttatgtacatggcatattaattgaggagaacgcaaaacgccatctccgtggggatgcgctcactgaatttcgtagactcatctacgaagtaatgatggccgatgaatttgagagacgatggtgtgcctttaaaaacagtgataatgtaccggagaaggagttatggttagccatgatgtatgcactaagggaaaagtgggccgcagcgtataccgataggagatatttcttagggatgaggactacacagatttgcagcaacagaaataaagaacaactaatgagacacttacatacaatatgatggctcccatcattcaaagttatttctaccattccagcataaacaagggatgacaaagtacatatgttctatacaacactaggttttcaagccttgcagattttttcttcttcagcacattaaacatggctgacatgttttcatcggcacatgataaatcatctagctgcacttgaagaaaaaagaaatcaacggcttagttgaagcaagatgcaaactgaaatcaataggcagtacacataatattgtgtgttaaaacggcttttggtcaaaacagtgtaggtagcacatgcttgagcatttttaatctgtaactttacattcaggaactgcattttcaggacaactggaactgaagttttcatgtgccctatactgatgagtatattggtcaaatctgttctttttgtgaattcataatgtgaatgaaattaaaacggtgcgatataataatggaatgtgcttacataagttattactactgaattgtgtcacttagctagtatgtatttatgtgatcactaattaatagatgaaatagaatgtagtatgtgaagcactacggtcacaactgtggtgctgctggcgaggaaacggctgcagaccgcagctttgatgggctttatcagcgtgcggcaaaattagggtcacatgaaaagggtttagctgttcaagcgccaaggcattccgtgggatatgcaggcctccgtctagctggccgcagcagcgccgccgccaacgaacgttcgacaaaaactattccctatttttctaggttttttttaattagttggttttctagaaaaactatttggtgcatgtatatatggctatacatctacatggctattggatctaactggggtcatgtatcgtgaatcgatagtaattatacaaaagtaattacaaataccttaagatgcgtctttgctgtagagttgagagcaggactgtcatcttcacccgtattaaccgtagaaaattactgcgattgacgcctctatgcagatggtggtgatggaccggtcaagggatccatgatggtgaatgaagatgcaaaatattgtgagaagaagagaggagaaaataagaacggatgtgcaccgaagacaggagaaagaatgccttttgtgtcgttgctcggttgcctttctgttttttttctgttgctgcagatttagtaatagataaagctaataaccaactgccagattgatgcgtgtttttagcagaagtccaggcgtcgggtgcctgacggggagtggaaaaatcgggcgcccacgtcatgctgatgtcagcatgacgcatgtgtgcaaaactattttaaactattttttctcttaaattatttatccaaatcatgatccaattgcaccattaaatttgttgcaattaaatctttaaaacaagaccatatatggatatattccgatgaaaaaatagcttattattgaattatttataaatattgcacgttgttccaccaagtatactggaattatttcactaagtagatagaaaatgtttcaatcttttaaaatcgtgcgctatttcaccttttataaaaacaattttcagcaaatagtaaaagaatgtttcaattcattgcaacattagatctatatatagtaaaatattttgagtacactaggtgaaatatttttggtggaacaagaaataaaacgaattcccttgatagatggattatgtgggtgattttgttgcaaaagaatgtttcaattcattgtaacatttaatctatacttagtgcaacatcacgagtatactagatgaaaaaaattgttggtggacacgtggcggcgtacggacacgcgtggtggggccacgtggcagcggcgcgtgtaggcgcccgacgctgaggattatcggtgtttatagtagtaatagtctgattattttcgttggtcagatggatcgtactattgtttcctatataagttaaactaatcccgagatcaacgttttgtacctccgcatgatgccgagttatctgtttttttagccgcggatttagaatagctaataaccgtctaacagaactttttatctccgcatgatgccgaattatctatatttcccaaccgggtcgatttttagaaacatagttttccggcagatccttcatagaataaagcggaactgtttattttggacagataaaaaattaagtccgggagaccgggtcgatttttataaaacatggttttccggtcgaccacgcatagaataaagtggaacggattattttgaacaaataattattaagtccgggaccgtttgggaagggtcgatttttaaaaatcatggttttccggtcgatcgctcatagaataaagcggaacggattattttgaacaaataactattaagtccggtaccgtccgggccgtgtcgatttttaaaaaacatggttttccggtcgaccactcctagaatatagcggagctgtttattttggcagaaaagaataagtttaggttagttttggtcgatcgctctagaatatagaatatagcagaatggtttttttggcatacaagaataagtccgcgaccgtccgaactaggtcgaatattaaaaaccatggtttcccggtcgatcactcatagggtatagcagaatggtttattttagcataaaataataagtccgcgaccatccggaccaggtcaaatattaaaaaccatggtgggtcaaatattaaaaaccatggttttccagttgagcgctcctagaatattgccgaacggtttttttttacagaaaagaataagtttgggtcagttcggatcgggtcaaatattaaaaatcgttgattttcggtcgagcgcgcatatattatagccgaacggtttattttggacagaaaagaataagttcgggtcagtgcggaccaggtcgaatattaaaaatcattgattttcagttgagcgcgcatatattatagcagaacgtttttattttttacagaaaagaataagttcgggtcagtctggaccgggtcgaatattgaaaattgtcgattttcgctcgagcgtgcatacattatagtcaaacggttttttttttgacaaataaaaagttaagtccacgaccgtccggaccgggtcaatttttaaaaactatagttttccggtcgatcgctcatatattattttgacatatattattttaggacatgattggtgtccgaacgtaatttcctagaacttagtctgtagttggacccactctagctttttttacacacaatttatccgtatcacctttaaaaaaatcaataaatcaaccgtgaatatctgaaacgattgggcctgtagttcaggagtcccaacacctgacgcatgcaatactttgtcaccctaatgattacgccgtcagtgccgccgtcattaaccataatattggatttcttccagacaaacgccgttgcggcgtcgccaggtggctttcttccagagaaacgccgttgcgacgaccagcgacacctccaccccggaaggatctacatgtggctttaactcaaggttagtcttctcttcatttttaactagatgattaccccgccgcgttactgtagaaaattaagttgcgtaatatatacaaataagatgtaatttgattatcaaaacaaaaacagtttgatacaattttgagattaaaaataattgagatggcatgtttttaagagagaaggaagaagagacaatttggaccatagatctatcatccaaaggttagaaataattaggggtgatgtggcttaatgagataagtgagaaattgcattaactacgtttagtggggatgaactatataactatgtatgattactcctagttaattaccatacttaatcacattgttggacggacttgtgtgtcattcgcgtgcatggaaatggatcaagttaaatgacgatgtactacatataaaccacaggaagtgtccaggaaacatcacctacttatttacttattatgctaattacattcacacaaattacacgaggtagatggttgttgtggctgtaattatttacaattcgtggcatgttgtacacaacaaactagaaattaaaccactgttaatatatgaccgaattaattctccagaaccagtccctgttctacgcttttgaattttcatagttagaaagtaaacccttggtcttattttagattttgaattttcgtagttgctgaagtaatggctcatcagcaaccgccatacttcatctcttaattaacattgtattaatgcatgcattactatttaaatgtttttaaatgatttaattattccaatcgcatcacagaatataatcctcgatgatacccaactatgagccgccaccgagaatgactaggaataatattcgagccaacaaaccggtgagcaactattctttcgacttaacgatcgctctctatgcaataatgaactaaattgtgatgtttattattgcagggaacacaagtatgctcacaagtagcctactggaaattcatacagactttggacaaagaacagctgcaagccagagatgatctaggttttgggggcttaacaaaaatgaatggagtccagattcgccggcttttctgcaagcaaattgctaggcaatatgacgagtagactagagctttcaatataaatggaaccatgctggagataaccattgaagatgtggatcacatactcggcgtgccatcggaaggtgctgaactggttgaagtcccacaagcaatccaagctgacgttgatgccccaaaggacaaagatgaaaacaaagctctacagacaacaaaggccgctttgtttgcattatataaagacaaaaggggaataagataactctgtcagccttgcaggattcattgaatttgaacaaatcttgtgacgatcactttaaaaggcagtttgtgctatatacaattggtctgatcctatgtcctacaactgagagatttgtccattcagattacctaaatctgctcataaatataccagatataaagagaaccaactaggctagcttaaccctaaaccatctcaagaggtctatcgtcagtttccagcatgataaggtcaatcttaagggcaaccaaattcttctactggtaggtgtaatttcaattcaagttatggtttaagtttgtatgatgtgactacaaaatttttttaaaaatttttcttgcagctttggtactgggagaagtttcgagtgagtcacatagatccttccaaagattacatcggacgtgtcagaccactgatacaatgctaggatgagaagaaggccagaaaacgtgaaaaaatcatgtatggagtaggataggtaattcgtgtgttgtaatttttgtacacataattaggacaatgtctagtattaacaatttgtacacatgttcgaacatagattgtgaatgatatcaagatccctatcgaggccaccaaagagtataccactgaagatcactctggaacagatgccaaccaaccaagtaacatggtacatactgaattgtttttctaaaaaattgaaagttgttttcttattatttttccacgtaggataatactaaggcacatacaacagaaatggcggatgtctagttgcagcttaaatcaatgaatgaacatttaatcatattaacaaaagaaattcaggtacgagttgtgaagtacaactatcagttatcatgaactaactattttaagttttaacatttgtgcatgctagtaaatcaataatgtttgaaggcaagaaaaacaaaccttaaggggtcgttgcaagtcgacacacctggtgttaggataagtccaacaaaaaacatggcatgacacaggcatcgtccccccaacaaaaggtatcaacaaatttctataataataagtaactctatacgatttacaaacttgttgttaccgaaaattgttcttcataacttgccgaagcaggccaagaagaaaaaagatacaagtaactcgcctattgcaccacgggtgcgaacaacaggaagggtcctcacatcaacgatacaattaaacactaactttgtgtacccagagaaccccaagaacaagcagaaggcaactccaaccccccccccaatacattccgaagttatgcctcgcacaaatgcttaaaaattttcctaacacagcattttatatttgtgactatgtaattaattgggtagtgattgcagagtttacatgcaccgaagaggatgagttcctcatcgactacattaacacttcaccgcatcaccgtgttatggtgagaatggaaggattgctccttacaagggaacaattgcaaccactgacaaatcggttcttgcccgatggtgaagctagatacgtcattgacgaagtaacatcctacttaccctctattgtatcattaaattatatttgttatgcatactaaattgttcaaaatgtagatcatcgatacatacatcatgcacctggaacataaataccttgaagagtcacaagctctcagaagagtatatatgatgaaaacgttcatcacaggtaaaatatcgattgactgcgtgcacgaaatctccaagcggcagtaggaaaagggatacatcttaagaattactaaccaaatttcccaaaacgaacaggtaaaactagaaatctccaagcggcagttggaaaagggatacatctcaagaattactaaccaaattgcccaaaacgaacaggtaaaactattttacttcagttaatgacaatttgttcggcataaaagaactaaacaaagcttgaaaatgcagatctttatccctattaatagaaataagaaccattggtacctggtggtggtccatgttaagcaacgtcagattcaactactggactcatcacctagcaccgataaacaagacacgaaactgacattagtggtgagcctataatgtcccgtaccgctttctatctataaataacatccttataatcttagttcatatttggatctcctgcatgatcaaaagctgataggaatggtaagatatttcgaaatatctggatacaatgaaagatctaaccaaaccattttggccgagattttgatttgtcgacttggcatgtgttcagtgtgacaagcatacccaggcagaaagatttgtatgttacccttcttggattaaatgcaattatctttcttacacaaataattgttatgttaaggaacatctttctataggtcttcatgtggcactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccatcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggctttttttatctaacccgtttgaggtgtgttggctctataaatacccccaaactgccaactgctttccatcccgaccattgtactgttcacaaatcggttgggagggcaaggggggcgattttttgctaaaattcaaggtaaaaaacacattattctccatttattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgcagcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaaagacccaagaaacatgcgtttcgcaatatgtacggacggcattaatccttttggtgatttgagcagtcgtcacagtacatggccagttctgattgttaactataaccttcctccctggttgtgtttcaaaagaaagtacattatgcttgccatgctcattcaaggaccgagacaacctggcaacgatatcgatgtgttccttgaaccgataatcgatgactttgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacaaaggtgcacaacttattgatgggaataaccaacgagtttggaaaaaagaggaaagttggaaagcgaaaagagaagagcacatcgaaggaaaaaatagaggagcatgtggaaaaacaaaagacaaaagagaggagcatgtggaaaaaaaagtcaatattttggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattaccacgttcttatcacacagctgttgcccgttgcaataaggaatattttgcctcctaaggtgcgacacacgatccagcggttctgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttccgtggttgtcacagggtcctgaatggagtgccaccacctggcaaggatatgacataaatggat

SEQ ID NO: 20910 - DNA, 1853 bp, Oryza sativa
ccgtacgtctgacgaacaccgttgcagttatccgacaagagaacccaggccgatcagagagttgggtcaggaatagagcacatgtcttctttcaacgagtggctgaagaaccgaattgccaggttgcagaacttgcctagtgaaacacttccgtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgagccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcgaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcaccctctagaagtgaaataaaataattaagcaagtataagcattggaaataatataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacgggctctatctgtagggccgtcacaggtgacctcacctgtgacggcccagagtgttgggcccgtcacaggtggtcttacctgtgacggctccacggttggcgcccgtcacaggtgaggccacctgtgacggccacatagttggagcccgtcacaggtgagtttgactagggttgacctagggttggacatcttctagatcgatccagatccggcgcccactctcactcactcactctctcgaccgccgcctcgcctctctcgacctctctgccgccctctacgcgccctcctctccaccgccgccctcgccgccgccaaatccgccgccctctccgccctctccgccaccctctacgccctcctctccaccgcctcgacctcgacctctccgccaccatctctgccgccgccctctacgccgccctccccaccgccgcctcgacctctctgccgccctctccaccgccgccgcctcactcactctctcgaccgccgccgtccatctccatcgacctctccgccgccatctccgccgccctctctaccgccatctccgccctctacgccgccctccccaccgcctcgacctcgacctctccgccaccatctctgccgccgccctctacgccgccctccccaccgccgcctcgacctctctgccgccctctccaccgccgccgcctcactcactctctcgaccgccgccgtccatctccatcgacctctccgccgccatctccgccgccctctctaccgccatctccgccctctacgccgccctccccaccgccgcctcgacctctccaccgctgccgcctca

SEQ ID NO: 20911 - DNA, 3297 bp, Oryza sativa
ccactccccccgcctcccctcgtttactattggtcgccgattacccccctcttctcctcctcagcgccgccgtgccaagaagccgccgccgcgccgccgtgctgagaagccgtgcgcctgccgggactcgtcgtcgccgtgtgccgcctcctctgctcgtcgtctcctctccaggtacccctctctctctgatgcccatgaatggaatggtgcagtggatggatgaataaatgatgcaatggaatggatgaatgaatgatgaactttggatgaatgatgaactttggatgaatgatgcaatggaatggatgaatgaatgatttaagtgccattttgacatgtaaccattcatggagtgtgtaccgctttatatgttgttttgttcccttttgctagaactattgaattttggggataatgtttacatttagctgaaaaaggatggattgatagattggcaacagtgtttctagcttggtagggtagctagctagaaatagtttatctagctagctagttaggggttatgttcccttttcctataaataaagcatatacagggtttgaaatttagttcaaatggaaaatacaaaatgcatggggagttttggtggattggttagtgtagtccatggacggaaccgacctagtcaccaaaatttttcatgcattttgttttctgtcattctttgataattaaggaactttattaggtttagggtttgaaatttagttcaaatggaagaattgattgattggccgcagatttaatgttgttccgaggttatcaaaccatcacagaatacaaaatgcatggggaattttggtggattggtcagtgtagtccatggacggaaccgacctagacaccaaaattctccatgcattttgttttctgtcattctttgatgattaaggaactttgcagattatctaaacttgtggatttatataccctttttgtctatgaataggtgaattgcatgaattgttgtttatatacatgatttatatacccttgctgctgctgccacataaatgattgtgggctgttttattatctacacttgattgaattgaatggatgaattgctgtttacatgaagttagtagtactgtctcattttttttgatgaaatatatgcatatttgagatgtgaaatatatgaggtgatgaatttggactatttgtggatgaaatatatgcagtattagatgaattagtctttttgtattagatgattttaggattaattttgctgcattggttgaattttgcatgattttaactagataaatggccagtgatgttttatgttaatacacccctattgttgctgcccctgtggagtatctttgcccctgttgctgctgcccaatgtgttccttgttaaatgcccagtgatgaattgctcaataagaacaaattatctacacttgttttttttttatgcataagaacagattttctgcacttgctcttttttctggattgataagaggagactatatacacttgttttctgtcattctttgatgatttatatacccttgctgctgctgcccaatgtgttccttattaaatggccattgatgaattgctcaataagaacagattatctacacttgttcatttttttgcccctacacttgttcatttatatacccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttgtgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgattttctcttttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcg

SEQ ID NO: 20912 - DNA, 9319 bp, Oryza sativa
cggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaagcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttataacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccgctatcagaggcgaattgtgtgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtacgtctcatctgttttctcctttttttttttccttattgacaggttgtgcaggtcgatgacatcatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatgttatatgcagtgatctgcatatatgtgttgttggggatctgtgactggaatatatctgtgatgtttctatttttcagagggcatggctagcaaatcctgaggctagccaatatttagcatttattttttttctggaattaactcatcagtgacgggtcagaacaaaaatccgtcaaaggtaacataacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtggtctcttcatgctgaagtgcatggaacactggaatggatgaaagtcaaccacaaaattgaagcaggtatgtagtttactacaaaagcatgtatgtaaacccatcaattcaaatttaaggctaaaaaactacatctgcatactatacaaggtgatatagacatcttcagacgcaagctagcggcaattttggttggctccgtattgaatgataacatcaaaatcccaacatacaagaaataggcaggtggcgagaagggtgtttggccgggagaataataacagcaggatttacaaataactgcatctaaatatttcagacgtattcttatttttataatttaaacaaattatggatattagtatattcactgtacttggctcaattttgattaatattttggtgttagagaaaatattagttaggtgacaattagtactcaactcctgcactgtattactgttcaatgttcagaatcacgatgagtgatatcaggatattatgttttcaggctacattgttgcaatgtacgcatatggattttcttcatttttttctactcactcttcgtcctgctctattgctgctactggacaaaggccccagttttttcaggtttttattttctttcttttgggttgttttctgatggcatgatgatccaaatcacccatttcgattatttcctacagccgtgctttcagtttcatgaacacttgcatctaaatacacggtaagctttataaacctcatggctaattgtcagtacatagcaagatcgtcataaaaaaggattattctaatgaaatggccaataacatatcccacagggtcttttagttgaggagctacacaatgcatacaccaactgatagcagaaagtatagagcatgcaattacagtctggtacaggacacaattccaaataatataattgtttcaatattcaccaatggccagacgagcatatcatgagacttcaggaccctcaagttttagcactatcaaggttttcttcagttttgccacgttggatggaaaagactgtcccatctcctataaatttcaaccacagaatgtcagtcatacaccgccattgattacttattcactatatgcgcattcgcatgtgttacgccgataaccagtttgcaatctaacagaaaattcaaaatgcgaataccaactcatattttcatgtgtactactcataaacctgaactacataattataattcatgtacaaccagtaaattttttaacataaccatatttttatgtgtacaaccagtaaacctgaactgcataattataatttacgtacaaccagaaaaatttctgaacagaaccatatttacatgtgtagtactcactggttgcagcttacaaactatacatgcaacagtcacagatcattaattagttcaatcaaaattaccagaaacatactatatatatgacctagcgaggagtgatagctactggagtactcaaaataaatgagtcttctacaggttatatcaacatatcttgtatatattcacaccctgaagactgaaaaggtactgatctccttaacagaaaataaacagcgtcccagagcatgcccacggcgtcgtcattaaacctccacagacagtagaacaaccaccgcgaatctacggaacgtcccacccgcgtcagccttgatggcgaccacaacctcccttgccagcgcgtgttcctgcttgtctgcgagggtgacgtgcataagcacagtcccctccacctgccgcgtgatgtggctgccgatgaagcggaggaggcatgcagcagatgagacgaggaggagctggtaggcgagcgtggggacgtcctgggcgtcagcgatgaggagggagacaaacttcgcaacgaaggcgggttgacggaagctgtaggccgcgggtaggtcgtaggctctccgacctttcattatatttaagggataaagtaaataattcaagtcatcaaacaaatataataaaatatccgacgtcttaatagaagaatattgaaaatattgtggggcctttaacctgcccgtcaacttcaaactgagatgcgcccgttaaacaactcgaaggccacgaccagatgtgttacacatttaggagacttgacaaaatagctaaagatctacaacatctcaaatattcttaactcatactcatatgaatctaattcccagaatgtgcactagattcacgatgtgcactagattcacactttcatcttaagcatggacatacatagcaaacacatttaagacgaaagggacttgaagacttacatcaacctaatagttacataggccgaccggccaaatatatatatgagagaacaacggaaacttgtctacccaaaccacaagcacaccgattaggggtttacccccattaagttcaagtcctagaagaagcagacgattacccgcgtcactcgaaagactaagtctaagacctacaaacaaatagttaatccaatagcaagagtcagcacattattagaaataacgtactggcaagcaccaagacaagtctaacaccctacttgtaaggcatataatcaaggaaggtataatatggttctttttagcataaagcaagttttatttgcataaaacactttcaaatcatatttactttcaaataaatttcagcaagctaatacttagcatatggacatcaaagtaggcattaatcatgtgtaaatatgcacctcattgccatccatggtagcaaggagatcattctcaaatctcaacataatttgaaggtaaatttcagcatttagaagaataaacacaagtcaatactcaatgcatatccacacgccgctcatgaccacgagcatgtctaatcgattagtttttactctgcagagtttgtatactttacccacatgatacgaaataataatcatgcaagagcatggtacgatttattacctgcaacaaagctgttccaaaattcatgatttagacaccagcacgatacatgtctctctatcataagccatacacattatatgacctagaactgttaagtggcgggcccacgccttaaacttaagtggcggccgcaacgggaacccaccacgtggcacaataccattgtattgaacagacttagtcacctaaactaccacgtcggggtaaatagaaagttcatctgagttatccgaactcatacacaccggtctaccagaatgtaaagctaaaccataaataatttagtaatcttgggctatcccatactagcatatgtggttgtattgtatacgaaatgaactgacattgagtgaagtccttaggacggtttgggcacactctccccctatcggtacacaactaatcaccatatatgcaccacttgagacccaaacctaaaatccatgttttccatcattttatttgtcaaatacttcatttaatcatctttgtccagaatcttaataaaatcattttccatgttaatatgagcccaagagataagtaaaactattctaagcttggctaagcaatataagtaaactagtgataatgtaactcatattccaagtagtaataggatataattcctaattaaggttaggaatgagggatatggatatatgtgaggttaaggtgataatgcaagtaatgggtgttggtctaacaagtttaacaaaattttaatttattagtgtacaattgacatgcaagatttgcaaacattttcaataacctccaaaacataggatcaacttgatcaaagagagagggaggtgggacttgccttgtaactggaaaatgtcagcacctaaatcacttcttcaccgcttaagaaattatctatataaagtacacgttatgccattaaacatcgaattatgcgaaaaatccaaaatgctctaaaatgcatgatttgtgcacagtggatatgtactggtctaagatgaatttaggtgaaagaatttctattttatctctttttatttgtgaattatgaattttagaagtttacatcggtatagggtagtatttacttaggcagtttataaaatatttttgcaaagtgatgtttattaattttgacttcacagaggtgtaaagaagtgttttctcaaactaacacatttggtttcacaatttttggagttaatctgaattctttatgtattttacaagttgtaccgtgttatagacgtatagtgtctatgtgtacatggctttggagatttaggtctagaacttgctccatcttgctagttatatttaaaatgagtattttagttaactaatataatcttaattcataattttagagtttatattattttactacacattttataaatagggatgttctatgttagttatttaacataccaacctagaaattgttatatgagttaagtttgcaaagtctttgggaattaaggtttgaactatgacctctctggtctaacaagttttattttggtttattcatagctagagtgcattttaaatatttctatagatatattttgcttaaccattactaggtgattaactcctaggttatctatttaaagattagagctataacttagtacagaaaattccatatttcattttactatgttgaagctcacaatttgctggttctatagaaacttggttcactccatttggacaaaagatgaattggttattacttgcataaatatttagaggcttttgttatacattaagtatatacttttattttacaatctggaaatacatattttggtggttctacagaacttaggtttactcaaaaaggatataagatgaattttatataaacttctaaagttcaggttatgtaaaactagttattttaattataatagtttagaggcatttgatgtaaagtgtgtatatgttttactttagtttgtttttagagaacatgttagtggatctgtagaaactaagtttgctctaaaatgagttgaaatgaattttgtaagcattttataactttatgcatgctttatgtataatttttcttagataaattttagaggtgaaatgtgtactgtgagtgcaagtttttatttcataaccttaaattcataacttggtgagttcacagaaatttgaatcatctcaaaaagagttatatttgattttatatggattttacaagcttgtgcatttttctgttaaacatatattagtttgagtatttcttttatcatttcccagattttaaaggatggggtccacgtggcagtgagagaccaatatgcagaaaggtccctggggttttagaaatcaacccgcgatcctgtgactgttctctgtgtgaggtagttttacaaagtagtacctaaagttttgtttcttctccacagaggtccctggttcgagctgaaacagggctagccatggctgagctcgatctcaagcttgccagcagcaaacggtggctcgtttgaggttgaggtaaaaatatgaaatgaagagcacgctctcgcgattccatttctctacttttctcggattgcggacatcggagtaacgccggcggcgagtccgagcggcggctgtgcacaggctgctactgcatgtgcgcctatagccatgtagtgatcaaatggatgcatgcatgtgtttatttcatgtactacgacgctcaccgaagcttgatcgcggcttggagtggcttgaacagcggtgacagtggagaagacggcccggcggcggcggaaatcggcatggcaacggtgacgatcaccatccggtctccgggctgccagaaaaagagtgaaacggctcaaagaccatctaaggatgctacacgagtgaggaattgcgccgaagctcacccgggatcaaggaatcgacgaccacggtcggcggccggagttgaagaagaagggctcgatctcctcgatggcgacgcctcagctcgattccttcgatgggcttgctactggcatcttggcaactctcgtggcgcgacggttcggcctaagatccaccggatttgacgggaacagcggcgcgatccacggcggcgctccgggcttgctcagaacagcgatggcgaggtccgcgttcccgaatatccactgcatgaaatcgactgaacttaagggggatggaaccagcactgagaggagacaagggaacgaacaagatatcgagacaaccgcggctcaaacggcgatggcgacggttgtcatccttgcggccggcggcaagaacttgagcggcggagaggcagaggctctccct

SEQ ID NO: 20913 - DNA, 1254 bp, Oryza sativa
aacagagaagataattctaaaaaaattatatttactcattataaatgacctagtatttgaataatttatttaccctatacacttccatgcagttaaacaaagtatggttttagccgattgagaatcataattagtctattatttgactggtttgactgatttatttcaggtaccaaatttagttattaaattgtaccaaaattacagtgagttgcatgagttaagtagagcctacatgaattttcccatgattttatcttgcacaaattattttaggtatttagtaagatttatctttatatatgtttcctcctcataaatgcatctagctatttataaaaattatatttggactctcttgacctaaggtgatattatttaacctcattttcatgtctttataattatttctcaagagtggttataggtttgattagtgaaattttatcttttatttatgctcatgagacctaatatgcaatgccaacaaaaaatccaaatgcacgagaaagactcaagtcaaaacatgtcttatgcaagtatgcatgcttacacttgtgtttgtatttttttcctaggttataaatgaaaaggttttaatttgccctcgaattttattcatgcaagagttagatcaacttcacctaggtttaaaaaggaaatttttggttcacaaaatttgaagaactttcctttcaactagtttggatggaaattccttaatcctagaatttgggtatgttacagggtaggtcttggacgagggaggcgatggtggccagggtcggggatggctggctagagctgggcgtcacgaagagggcaaaaaatgctgccgcgaccagccgagccgcgccttgccgaggtccaccgtcgcgtatagccgcgtcccaccctgcccaaccccggtcgtcttctccaccccttcccagcactgcacacataaacacaaacaccatgagaatgcagccaagaagcagaaaaacatcggcaaggtttgatcgatctagctccatggacgccatcactgaccttgtggatgccctcgggggcgttggcaacttcagcggcgcggatgcgggagcggtaggtaggaatgggcaggaggcgccgggagtggcgacgagaggaagaagaaggcgggggcgagcggcactggcgagcggcgacgagaggaagaagaaggaggcgtgcggcggcgcggcgctgtggacgtacaattagatgggccaaccctatctggaatccatgcgc

SEQ ID NO: 20914 - DNA, 4548 bp, Oryza sativa
atgatctctatgtgctgaaggttttgctaatgattacgtacttcatatattttcttggcatattggttatacagtcatttatagtgagcatatttaacacaaatatcatgtcctccttatactcactaggtacatgattttttaggtccaacggtaccgtgcggtaccaaatcatggccattggatctggcccaatccaacagctggtagtgtttgctaccgcgaggtaccaaatatgtccttattgtggtacctcgcatagcagagacgtggaagggcaaaaatgtaacttcgcgtgcaatagatgggaggaatagacggacggaaccaattttctcgcattttacatcctcttctgtgctgccaccgtgtttctctcctcccctcccgccgccgtgttcctcctcctccccgctgccgtgttcctcctccagtgccgcgactttaatctcgggccttgcgctgaagcgaaatcgattgcggcgcgactttgtggtcctcctccagtcgccgcctggatggacgccgccgccaccgggaacaatgacttggacgccaccgctgccgggaacgatgactcgaacgccgcatccatccttgcttatcttttctctcctgatcctacccattccggatttaatggatagatgtgttttggtaccgagcggtaccagtaccgactggtacaacctgctggacagtaaagacactctttctaatatagatcccaacccattgtgtgggtcaccatctgaatttcaacttcaagtgtcctacttgctccatgaagtttcagtctgcaggagaactcggaaagcacgaaaagtttttccatgaagacgaagaaggtaaaagtaatccaatatattgataggaaatgctctttttccctatatcttgatgtctattttttttctacctgttataatcttcaaacggctcaatatttttttgttttggtgcagattggtggctcaaagtgtagtagatctagtcatctagattgttgttttatgtgttcatcctatggtacagataattaatctggtgtctttggcatgtcttttattccccatagttatgtttatatacggctcaatctggcttcgtgagctttgttaccgtctatcatgctttctagtacctcacggtacttgtaatcagggccatccattgagcctgatccaatgatttagcagcctcggtaccgcgaggtacaagaataccctgcggcggtacgtctcccttcctccgcaggcattggaacaggtggaagagcaaattcggattttcgcataatgcatccattttcgtagagtccatacggctggctctcacctgaatcgccccatctatcctcctgaggagaagtttgtttggtttcaaactccgattcaaacaagaggagtacgccatgctaatgtgacttggatgatccacatcttcgggtcagacgctgatgggccattgaactatccatgtggctgagagccctcacagcccagacacaacgacacaattattaggggtgcgctctaccactgagctaatagcccgtcgcgcagacctcgctacgccaaaagcgagaaaaactctatccctttccttttgacatcctcatgccgccacaccacaccggggggggggggcatggggacgtcaaaaaggggatcctatcactatcaactaatttgttccgacctaggataataagctcatgagcttgatcttacttcaccctaaacgaaagaaaacttccatatccaagacttttatgaaaaattgtatagggagtgtacgtgcctcacatgtatggcttaactgcccatacccggtttccacaggacatagcgcccatgcatgctgtttactggtacgaagcgcatagcgaatagggagcagcagctgaccttcgaaccacgtgccaccagttctgctagcccaatcgaggagcactgttgcacaaaggacaatgtggcagccattccaaggagccaaaaaaaattcaaaaaaaccagaaaaacggtagcactaggggttttattaattgatgattgccataggtgagaaaaaaaaaactcccatcctctagtagaggactaaagagtaccatgacgacgactacaaaatgctatacggttgaaccaacggaatactactttatatgtggcatcaaacacggtatcatagtatcaaacctggtaccagatttggtatcttggtaccatagtacgtcatcgacgccttcagcaacataaactataccacccaacgctgtagtgttttgtagtctttctggtatatcatgcatgatttattttttgaggctacaaagtttagagggcacatgatcaaatcttgagaaatccattctacttcctgtgcaataactagtagtatgatgctcaaactgttacactatccacagttggccattaaaacaacagactacactgttccggtaaattaaggagaagacaggttgcgttccccttggctgctgttttcacaacgccatgtacaacagccgatccacgtttggttacacgttattttcacacctgttcaacagccgaatttcatggatgccttcagagttcatagtgatcagtatgactgaaacgattataaggaccaccggagcagcgtcactggacatccacttcaacttctggtgttatttcctgcacacagcacagtactggtataaaacaatatactccggaaaggtatccagaacaccgtcacgtgtttcttttgatttaaaacttaatcccacttcatgttttcaaagaaaaatggctgacaactaaaatacacaataattaatgtctaaactccggatacacaagagtatttatacaccgatgtcgtggaacgagagtcgtttttggtatgtataacatactctccctctggaattattccaccttaaaacaatcacaggtttgatcaaacaacagatatttgataatgcactggcaaattttggataaaatgcaaataaaaaattatctagtattatcacgtacatagtagataatagggccattaagcatggagggataattatgtacgagttgagttaggggataattgatgataaaaatgctactagtactaaagcattttactgatccttgattccttggtaatttagtggactaattgacttattttgacagtcaacataggcaaatcttttatgtatgagtggttaattagcatacatatatacatacaaactggaaaaaaaatagcgaaatgcggtaagatctacctaaatgttaattaagctccatatcaaaacaaaaaatctgttgtacacatcattgcacgtgccagttaagctatcaatttcgaactcattggcaacatatgccatgggacataagaacagaataactaaacctatgcatgatttgcgttcttcagacaggaaagcaaaagctcagggacatatgccaggacgcatcatgttgatattattactaagtcttagtatatatataccttttatctatttgaagcaaatttggctttggtttatttctgcagcactcccttcttgatgaaaatcctaaggcaataagaagagaatttccagagcgcaatatgttcaaatgatcctactggtaatgaaacctattttggtctggttcttaggcgaaagctaattccttgcattatcaacttttgctgaaggtaaagaatacataccaacccactggccttgctttctggaaatggatctttcatcagattcttttgatctcatcacataaacctagatccacctagtttgcatattcaggcaatgcagagctgcatgtaccaaacttatgggacttcatggctttcttcgtattcaccaatttggttagtgttaatgtgagaattttacactagccacatcaaacagcacttgccagatcacctatcctcacatggtggttcagccgttttagcagaaaacgtcccatttatcctatcctgctcccataattcaagaatttctgatgctgacggcatctctccgcatgaaccatcaccatacaaattcattgaatcaagtacttcgtcaactgcagatactcctgtccccaaccagccgagatcatgttgttctttctgttcactctcaaaatgtgaacctataacaatgtcctcgctcaagccagcattagcatcagattgtggagtattcataatgtaatcagagaactcactgctaactttctcatcgggaaatacatttgtgtttagcgaattcatgcaagaaagctgatctagattgctatttgaagacttggttatattctctggcagagagagttgagactgtccagtatatgtaccatcagccacaaaagaagtgtcgttcacaaaagttgtcccacattgagattgcagtgcacttacaaaacaaagttcgggatccgatttgatgatatcactggtactgaggtactttaaaagatctttcaaagcattcacgctgaatcgatgcatattttgctcaagtagcttgctccactgaagttcact

SEQ ID NO: 20915 - DNA, 8847 bp, Oryza sativa
atcttaaaaataactctctgatgcctatagattacttattcctgtcagtcctaataagagaactaaagcttttgcaacggataaaaatgttatgctgaacaaataacagtaatgatttcttaaattgatagagagttagatttcacgtttgactgccgcacattatattataaaatgacatctattggagaacatcatctagagtcaaatacaatagttttcaaatcatacaggtaaacatgacttattagaaaatttaatgctgtggcaataaaactctaaagctaaataggaaaccaattgcatctaagatttgtcaggcaaagtcagagactcgaatttcaactgttggcatgccacttgaggtggtatgaactcctaatgcggaaaaaggcatgcctaatggctttaccagagacctggtaaggtaatttccatttagattggaaaaaaaataaaaaatcgttttcttaaatcttaatctagttcaaccacccaaagagtacagtcgtattttatctcaagcttgtgggcacatacgacattgttcatgagttggtgcaagttatgtttttggaggttggtcatcagcatagcaaatgttctggttttgtactgctgcatgtccaaattttgctatgatctgtttattttcatttttccaaattgtgatatgactagtacaaagttagcacaatttattcccttccaagtctatgttgagatagaataaaactgggtagcaagatgagagttaagggataagaaagaagacaatgatatgtgatggtgggaccattgcccactggacagtcctgagccaacaaggatcctagtcggtggcacatagtaccaaaagaagggctgtttacttagagaggcttaagttaaattttcttgaagtttaagatgaaaattaaactcactcaagagttagtgaccaaaattttagttttgccaacagattatttcgataggcagagatgatctcgttgattcacatgaaaaagatttttgtaatacaacaacttctgattgttttttactaaagtgctcatataaaatgtaatagatttaccattcctttatcggatctttatctactacttaaaatgacaaattggtggtggtaattttgctatgtactccttcactttagatattccatagatggattcatgtagacttggttgatttgtttgctagaccttttgcaaaatgaatgcattatctgcacttgtggatatgtggttgctgattgatgtaacatgatttacatacacaacttagtaggcacttaggcttgagaataactatgtctgtgtttaaattgggagttacagtatatttatttgagacccactacaaaacaggaacactatgctagtcaaagttatgtgttagagatcatgttgatgttgaaataataatacttttgaacggagggagtaaaatcacataagtagcaactatcctacaaggtataaatgtttgtttcgttacactagagagatgacagaagtatagtttgcacttaattgcatatgaatgaatgatcattcacaaacctgtgacaaagcatctctccaccttcctttattgcagagacagcaagctagttcataataaacacttgcagctccaacaattcccctttgttccatgtccttaactgcttcaactgcttcatttactttcccttgttcccagtaggctcttactagaactgagcacataattaggaaaatgacatgaatctcaataccaaagaagtcaaatgaactttatctgaattgctacctttataagttattgctcttggaggtaccccacttttttgcatcttctgaaagaacttttggacaaagtcatacttcttggctttaagcatgacctaaagtaactccagtaagtatgatagaatgccatatcaaagtttagtaagaaagaacatgtctttattatgattgactgactgcgtatgcaataccacactatatacttgagattacaacccactggactacacggaggcacttaagggtatctttatgaactattaggctaaatctaccgacatttgacatgaatggaatgcacagaacaagaagacgacgatgagtgtgagctaatgcgggaaataaaggcatttagttcagagaagaggaaactttgcatcacctcttttttgcaagcttctttgacaaggaacgttggcagaaaaatggcgttacatgtagcagtacggtggatgctatgtttacggatataatcatcactggatggcatgtttgaaagagaaggaatggtacaaaaaaaatgctaagagggttaaagaggtagcgacaaactcagtctcaacactcctggctagctctttttggttttacatttcttcctagctcttctataaaataaaattaaaaactacttatattgtttatatcatggcaggagcatctcccaatatttcccaaaaagaaaaggagaatgtgatgatcagaggactacaataatatggtttcgatccccagacttctaaggcagatgcatgtaaaacaagacaggaatcataagctgatctaacctaatttccatcaggagcagacccagctaaactggacttgtgaacctcacacacgcatgctttgcaaataaatttcaccttccataaagtgttcccaaatatgtacaacacatttccaaaatacccatagaacagtaccaatcagccaaatgacaaaatggacagttaaaaagcatacctccatcgctaacccaaatgttgctcctgtaggtatcaaactattccttctcatttgctgaaacacccaaaatacccctttccactgctgtgatagaacgcatgcattaaggacctataaaaacaatggtcaaagtgaagacatgcaaaagttatacagttaaaaaaaataaaagacgtgcaaggttatgaacaagacttcttccaagagagtgcaggaaaacagaaataaaacaaaaacatcaggcgccatccttaccgagttataaatcagaacatctggctccaaggaaggatcccaatctttgcgacgcatcttcattacccttttcgaaggcttctgtctcatatactctataatcttgattagctcgtttagaaggccagctcgaccaagtgtaacagcaatactatggtatgcagccatatcagggtatatttgagcatcactctgatttaacgtaagatataatgcttataccattatgttttctcaattttaggctggaatataagagacaaatggagtaaattctaaatgggcaacaaataaattctacccgcatgatggtgaaaactcgaagtgcttcagttggcctccatgcttttccaaggattgatagtaattttgtatacacgaaccttgatatgttatattccattagtcaagcatcagtacttgagttcaatttcattagataacttgtgcttgcagcgatctgaaacctagtaaactaggatatacctgctttttcgatgcttgtagatgttctcattgtacacccactcagtaacagataaagcctgcctccaatttcctcttgcctcaagcccttccagtatttgtagcagattatcttcattatatattaggtcagcttttttcatcaatctagtaagcctccaatcacgcatacttagatcatcttcgttcagcctgacaaaaaaaacttacttatgcaatatggaacaaagacaacatttcacgcaattcaattcattgtgaacgatttaactcaataatggcattggcatttaggataatgaagagtgcaatgaagttaaatgcacataaggtgaatcctaaaccgctatctatctaaattctgccatatctcatattcttgtaaatgtgattattaaaatcataaagcaaccaccactactcgaaagcagtgaaaggccaagaacgcctgaaacagcaagagcacgaacagggagggattcttcgcttatacctcctcaccagcgactcaatcctcctctcctcatcccgaaaatccgaattccagccgacgccagcacgcccccgcctccccaccgccgcttcctcttcaccctcctctacgtcatcatcctccagtagccactcgaacttgccggccctcctcgccgcgagcatctcgcggaggccgtcgaggccctcgccttcgcctcggagggccccacgcgggggtgccgaggcgccgccgtgccacggccggcccatgagcgcgcggtactcggcgacggccgcgcggaagcgggcctcgtcgtcttcgcccaccaccgcggcgccgtcctcctccctgggcagcgcattgctggccgcctccgcggccgcggcggcggcggcggtgtccttcctggcgcggcggagggacttgagggcctccttcttgcggagcgcgtggaggattttgggggtcggggagacgcccttgcggaggaggcggcggcggagcgtctcgctcgtcggggcggggcgcggccggcggcggggactcgggatggcgctggggttgtggagttggagggagaggtggaggcgaggcagggggaaggaggggataaccatggccgcgcgaggagacgagcctctgccgaggcggcagcgggcgcttccaaagcgtcactcataaacgctggacaggaaggaagagaaatatctgaaattttaaaaaatatttaaaaatatataaacagggtaaaaagaaacttattccaaatataccgtgacctcaatagactattggctattggacaggagaggatagccattgccaagagcacatgaggcgagtcggcagtggcactttaaagtttaaagtttagagttagtgtcactaatacgtgccaaatgctcggacgggaagagaaatataggtaggaggtttatgaaaaaaaagacaaatatccttaatttgataattatagttttagccttttagtttcccagaacattttatattatttattcatgaatatgcacagaaacacatggcactacacacatactacacgttagcaaatgtgcaccttaacaaaccaccacgagaattaaggccaatggcttaccatccttactaaagtcttattaaaagatcatctgcatatgtgtaaatgtcggtattaaaatttatggtaatttggaaccataccattataattttgcaaagtttgatatatgtcatcggtatctcaatgacatgtaggacccacatgagtcaatgacatgtgtgtcaggatggcatatctcaaattttgcaaaattataatggcatggttctaattttccctaaaattttttaaactatggtgtctacaactccattgtcacactagtattgtttccccgctgcatttcatatgctcgattgtgaatctataattttatttattaaaacatacaaataattatatttaactcatctaaattcatctctttagggcagatccatgtatttacaacctaataactcaatattaataatgtattacttggcatgagtattaagttagactatacgataaaaggagatacatgagatacttggcatttttttcctgcatctgcctttttctaaggtgatggtatagttcaaggctatgttcctgaaattggagagaagtttagggaaagttggtagtttgaaaaaaaaagttgggagtttatgtgagtagaaaagttttggatgtgatgtgatgtgatggaaagttgggagtttgggggaagtttggtgtgaactaaacagggcccaattcaaaagccatagagcattcaatagagggaaaccacgtttttcaaagccttctttaatctccaattctccatcataaccttcataccatcagtgttgtgcagaattattctctcctaatctaacattggccattataaaaagggcattcacatgcttatcatgccaaagagagaagacattatatttcaaatacaggtaacaacaactacatcatcatcatgttacaagaagacattgtatccattggcatccatgagagtagattcctaagtcgatggcattgatgcccctgcttgaagagcgttggaagatggttggtggctatccatatctatcctagatttggcaaagccacataaggaaattttcataggttgattatggcgcattggcacctagttgagccgtgaaggattaattacggggtgtgtggatacatatttagctgccacaaccactcgcctctcttggctcgactctagtcataatgggcattgtcgaagggcaaaacctatcttccttattttgctatgagggaaagcacatttaccggtgtaacacacagccatagtattggtacttttctccataaatctatctcaagttcatagatctggctgatcaacaaaggcatttttcctactttagctttggtgggtctatttttttcaaacgacatatctcatcctaccaccgagtagactaactcactgcttttcttagaagatttctcaatttttttctacattcgaagctgatggtaatcaagcagtattagctatgcggacaacccctgattccctaatgaaatcattctacgagaagcttcatagatgtgttaggtgggttgtaggacagtaagggagtaagctatcaaaatgatatatgatatgttcaagttgtcttagtttttttttctttgctgttcttttctttattagttatggtaatatattaatataggtgtagaggccgaatgtaatttatcttcttgataaagtatatgtattctaaatatatacatgacatatatatatacaccttggtttgtccacctcaaccaaaataggatgtaaacaaaagtattagaagcgagtaaaacagaagatatcgtgcacgggaagtccataagaaggtcaaaagatcaatgcatatcatatggcactagtactacccaaatataatcccaagctacctcgctagatgcaggatatgagaaacaacattatgggtgtctatcttgatagggatggatatatatagaaaatgccagtttatgagtgtaactaacttaaatggagtgatattgctttaaggcttctttgaaatgcatgatttcaaaaaacacatggataaaaaaaatacagaatgttgagtatgttgaatcccattggatctataatcatatgatttctcaaaacatgtgtttacatggctcaaaggaaaatatatgatttttgagattatgtattacttagattaagattaaaagaagacagaaatggagatgttgctttggaattctcttaaaatatgggttggagctcatgtttaaagttctttagaattggggtatatgaataaattgcaaaggaattttgcaagcccaaatcccacaaaccaagcaacctccttatgatttttttttcctaagaatctaatccttcaatccaaagaaacataaatattatcataacatctttggttgtatatagaatatatgataaaatcatgaaaaccagattaaagaaaatctataaatcgtttggaggatgttatgaaaatgagattctgtggtacgaagatagtgtagcgagttatgataatttgaacgtattgtactatagggactactcgaaaacattggctacaacagcatagcctacagccatgtagcttggctatcttcaaggcaaccatccagactggctacagtagtataagtgtagcagcattgttgtacaatctaatagttgtttaagattatcatatatatatatatatatgacaatcactatttatatatatgatatctattttcagtatctacgtaagttagatctttctatgatacacgatgagccgtttgtttttgggatccttggaacttgtattgtgtgatgtccactggagtatagctgggtggggtagtaacccattcggaaaaccccactaatccagtccccaactcccaagccgcggccaagccatttttcaccgttcaccgtggattcgagttgactcgcagcgtgccgcgtccgagtccaaagccaaactgtcatccatccgcatcacctcaccggtataaaggcgcgcccctcccctcgccgccccgcgtcggatgccgccgccgcgaccgcgaccgccatggcgtaccgccggaagccgcagcctccgcagacgccgccgtccttggaccaccaccaccaccaccacaccccctccgtgggcccctcgtccccgccgcaggactccctcgccgcgcaggccatgcgcgcctccgccgcgcaccgcgacgcctcctccctctcctcggcctactcctcctcctccgcctccgcggccgccgccgccgccgcggctcgccggggccaccacgagccctccgtctccacgccttcccccgtaagcttccccgctgagactcccccccaccccttagatgtgtctgatgcgtggcccggatctggtccgctcggggcggtttgtctccccgtcctagccgcttcttgaaatccatggtggtgaatcgattagggatatcgatttagggccgcatctcttcgttttgattccagttaggttcgcgattaactaacttgtgatgcttgactacttctgtttagtggttttgccgccgcctctgctgttcttgggttgggtctccctgacatcatcggaccaaattgttgtatttcttgatttggggagcgaagattctatgtttatactgtcgcttttgttctgtgttgtagggttcttcgggttatgaatacacatccatgaagaacttgaatgaggctaagtacggattttggggggcccttgctcggaaagcca

SEQ ID NO: 20916 - DNA, 10964 bp, Oryza sativa
  unsure (1)..(10964): unsure at all n locations
ctattctaaaaatatcctggtagcattagcaaaccatgtgttagaagtatagcaccatggaaatacttttatctttcttcttttacctttgtctcaacttggaaaatatgaagcattttacgttgttgtctatttcatatcacaacagcactagaataatggtgatatgactggttaatttattttatgattgaggcatccttctgttatgcttttatgttatttacccatgctaacatgttttaaatcttctttccaggaaggccggacgattgtagaaaataaaacagccgacattattcatgaaacacgcaaattgaacataagaagaaaaggagctggctcaactacacaaggagaagctccacaaagatttactcaaaggaatcttccacaaaatccacttgactacgaaactcaattgaaggcatctcgcgacgtaaggtggccaatatgtgtcactagatatgttgcttagtgctacattttgcatcttggaatccacgtggtttccaaatttaatctggtggcatttttgataaacatcatttttacctgatagctgttcaagttttttttttgtgttgagcgtgatatctgtgtgattatattctttgcaaagtatttttcattaaacatagcctttcagtgcttatttcatcctgccctttattttttctctggttgacgaacagtggcatcagtttagtaatcttttgtctctcatcgccctttctgttggagtggattagtgacccatattttgcacttgcaggttgcaaatgccatggcagcaaaagcaaagctgctattacgtgagctgaagactgtgaaggccgatttagcttttgcaaaggaacgttgcgctcagcttgaagatgaaaataagattttgcgggaaagtcacgataagggtgataaccctgaagatgatgatctggttagtaatttttctttaaaacggacaagcaattatgaaaatcatcagattcttgattgctggagttatgtattaaaatgttttgggcttcttctgtgcatctaaagttttactaaataactactcttttgacttgaacacctgtagtccaactttctgaactaataataaatagctgttgagtctacaaattatagcttcacatgctcaattcaaacttatcttggaactgcctaaaaaaattatcatggattttgactcttatataatgtatgttcatcagtgtgaaatgtggccgactcatgcttatcttaccatagtttattaaaaattgcccctgaggggtctaattacattttgtattatattccgagtttttttttgtcatattagttactacctctgtcccaaaataagttcatttttcacctaccccacacataccaatacaaaagcaaaaggactagaataccctccactttaccaaatctcaatggaattgtcccccactttatctactcccaatgtatttatccctactttcacaaactccgatgcaatgatcactaaacatgaacttgttttgggacaaacaggagggggcaatgaacttattttgggatggagagataatgttgatatcttttttgtgaatggaacctgtaattttctgtgccttagagcaagtttaatagtatagcccactactaactcaaaatcatctatagccaatgtaatagtcaattcatacaatagttgcttactatactattaatacctggtcccacctgtcatacatacattacgtcttggagtccgtgctgcagctggctacagatctgtagctcgctgctcttctctctcttcttttatctctttaaaatatgtttatagctggcttatagcctgctattgtacctgctcttaccaatatgacaggagtccagggtggtacctgttaccttccgctgtggttaatcatacttttttttttaaaatttgcagatccgcctccaactagagacactattagctgagaaggcacggctcgcacatgagaattcggtgtacgctcgagagaatagattcctacgagaaattgttgagtaccaccaacttactatgcaggatgttatatatgtggatgaaggcattgaagaggtcactgaggtctaccctacacaagtattaccacctgcaccttctcgggctggttcaggccttggtcgctctgtaaccccagctactcccaagactgccagctcatcaccttcatcaacatccattgttgtaccagaaacttgtccggtcgttccagcctccccaaagtcgctttctcggacttcatctaagcaatagatcaagcccggcaccaccaaccatgctgaagattaaaaggtggttagtggtgcgatacaatccggatgccattgcaaatgtaaaaccaaagctgcgccgttgctgtgccctgtatgttagtctctgatgagttgtgtcctggaaatgtgcggacaaatgatgttcatgcctgagatgtttgtatgatccggtgtaacttacacagtatttataattttactgcatcatcgatttggtactggcaaggtgtgcatgcaattggctttgttttgcccgtgtcaatttgcactctgaaacgaacacatgttgatgcaacccttcgtgattatcttggcagtttctttggttggcgaatcgaagtggttagctttcttgtgatagaaccaattcacctgtgattaagtcttagatttgacacaggtgctcatctttacagctaattattctttgtggtgcgatagcgaggtgcccgtggtgtctccatcaattttaaggtccattgtctagtcctccgaagatgcttataagggggtacatcgttccaatcttccgaagatacttataagggggtacatcgtctcaatcttccgaagatgcttaaaagggtagtatgtgcggggagtgtgcacgtgttgtgagcgtgtgtgtttctattgtgttatataaaatagttaattcaaaatttgggtgggggttttttgaatgggggtaatggtgttgttggcttcttgccctaattttatgttgcaattgtggatttacctacttctttctttgtagggtttatgatttgccctcacgtttttaaatgaagtggatgtttaccatgttttggatggtaattaggtaggcctggaactattgaatctaccttataattcaccaacaacagtcctacattctacatacttcatacttcattgatcggtcaggattgtttcactcaaatccgacgttccagatcgtaaacttaaaacatgcacaaacttataaaatgcataaaaaaaattcattacaattcaaaatgaagcaaactcaatttctacagaatcaccatcttatactcttttgaaaagtaaaataaaatagtatacatactttacatcaaaatgcccctaaaaatattatctacaaaataattagttttagataagctaaattttggaaattcatataaaatacatttcaactcatttttgagtaaactcaagctctggagaatgaccataatatgtacttacaagttatgaaataaaaaaatatacccagagtacaataaaagcccctaaatatttatataaggaataaacaacttagggtacactttaacttgtaaaatctgtagaaaattcattcttaatccaaatggagtgaactaaatttatatagaaccagcaagaggtgaactttcccattataaaataaaatgtacaaccttctgtaacagaaacatcactaaactttaattgaagtaatagtcacttaattatgaactatgaactatgcaatttatataaaaatgcaaccaagctaaaataaaccaaaataaaacttgttagaccagagaagtgataaatccatcctccaccactaaaacttgacacacttaagttatataaggattcataggataatacatcaagtcatcaacataaaacaccctctagttcatataaggtaaagcaacaataatacaatctttaaagttatgaactaaggttagattagttaaaaagatcattttctttattcatctcaaacaaagtagaatatattctggacttaaaacgccagagccttgtacatacagaacactatgcacctacaacacgttataacttgtaaaattcataaagaattcataattactctaaaaattatgaaaccaaatgtgttaagtcttagaaaacacaccactacacctctgtgaagtcaaatctaataaaaatcaaatagcaaaaatatttcataacactactcagtaaaaactactatataccaacataacttataaaatttgtaactcccaaataaaaagggataaaatggaaattcattaacctaaattcattttagaccagaacctacccaccttgcacaagtcatgcagtttagagcattttggatttttcgcctatttcggtgtttaattgcataacgtgtaaacaagatagatattgcaataacggcgaaggaatgacttaggtgctaacattttctaggaacaaggcaagtccttcctcccctcttctttgatcacattgaaacttatgtttttggagatgaaaagtgttgtttgcaaagttgcataatatttgattaaaacgatatttgaaaacttggtaaatggtagtcatgaccttattgctgcatgatctaccttgaataattgttgttatcactgtttgtttgtaaccttaagaatggttagagtactcttcttgtgctcaaatgggtctatgcttagagaagttttatggtgtttgcattccaaaaatagtaaagatccaacgctccacaattaaaggtatcatacaaaaggtatttaagtattgctatagatacttaggcaggaagggtaaaaagataattttcttaagagataaaaaaggatataattgtcataatattagtaggaggtacattgataccgcatcagtagttcattaccatcatatgctctaattctccattgcattatttgtgataagggatgtaagatcccggtcttctgataagtgttgataaacagtcgatttgggcggagtcgcgacacaactcgatccggcttctgaacgaacacgctactgagccccgcaattgcagcaccacgtctcctctggttatcaaccatgccgaaacccggttgacctcaccgagaaggctaatccctgcatgcgtatcgaagatcacaagtaagaacaagatagattgcaaccaaattgcatatgaatgattaagcactcgaatttggggttccacataccgatctagcggtgaaaccgttcttgacagaataatctaagcaaaacccgactctaaacgatgacatctactgaataaatatgactagggacattctaggttgcgcacacccccttgggctaagcccacgacataattacaagtccaaaacccaaatcagattcagactggatgaaatacgtggcttgttttccagattcctggtagcttggtaggaattttgacgtgggaccaaaaccatatgaaagtagactccataagctttccaaaaagtactcatgggccctggaattccttctatatcagcagctaggtccgtttgaaattgatgctgtcaggaggcccgaatccgaatccaaaacgtgtagaactttatctcttgtcttctatggaccaaaagtgacgcggtaagatggaagtgggcttggagaaggtcttggtttgttctccaatcaatttctttgatcatccatgaattcgttagctcggtctcttttccttcgcccaagcaagtacctctgcaaacaaaaacacacgaaacttattgtgtagcaccgtttgttcaaatatataacatgtaaatctaatatagaacatatgcaactttggttgattagtacataaggtggtcatggttatatccgagctagttgtgtcctcatcatcctccccttcttgattggaaaccgtccttggtttcaccttgtcatagagcgtattaaacttatttttatttatcacaacatctggtgaggaacatttcttgatgaccatatggttggatcctaaaatctttgtagtcgaaaactacaacactccccttcttgcaaaccaatctataactcatttaaacaactagaggaactagatagagaattacttatacgcatgcggtcctctagaccacatttcatcatgaaaaggaagtatagtcaaatttgaacaaatatatacttgatgcacattatattgtcatttactatcataattgtcaataatatgaaaaatcacatcagaagggcatggcaattcaaatctagcaaataatttcttctctaaatagttgagtggataaagatcatcaaattgaatatgaccccaagtatttaaagaagatagcaatttaagctcttcattttcgctagcaatgtgaatacatgtttaaactcaacacatagtggttctactataaaattaacatgttcattcactagttgtggcatggatataagtgaagcatcgcacaaatcttctttatcactagaaacatcaggcaaattgttttgtgacaaaggtatttcaacaattgtttccactatgggttgctctaacgtagcataagtagtggacatagttggcacatcataactatgcataccttgagtagttgcagcaccattatcattaccttttttcttaggacatgactagatagctactggtagctggtttgtcttatccagctaccactccatcaagtataaatacaatagtgtgtgtctttttttaacatctttaataacttatatcttttaaatcacatattgttcttaaaatctatttgcaccattgtgctccactcaaaatatgcgataaaacaagacccatattgaatatatttaaacattttattaatttaaaagtaatttattatatgtagaagtaggaagtaacttttacatcttatacatgattaattctcattagttactccatcaatattatttacaatccatcaatggttttatcttcttttctcatactacatgaaaaacaaaagtgaaagggaaaaaacaatcaatgtttaaaacagatttacagatttatagaaagttacttcgaattaatatcgaagttacttttaaaagttgttaaacttacttgtgctaattaaatttaatttctatctcctacaacgaatttacttctaatgttgtgacaatgttactttctttttgttttaagttacttttataatttatctaaattagttttagactttactaaatttgcttttatatgtctaagaagtaatttagtgaaatctaatagtaatttagatatattataaaagtaatttataatttttcattaaaatataatcatgtgagatcttgttataaagatttaattgttacgaacacaacggtgtaatcggatcatagatcggatgagtagtttaagagaaaattttatttgaagcataggatgaatagtatatatttgaagcataggggagaaacttctctctctggcgtagcagagtgcgtcatgtggcttaagattcggactattctggccttcttggcaatgtcggcatgtggaacggacgactataccagcgtgcgtgggatcggacggctctagatgcgttgcgtgataagaccagatcgagaggcctttcgagatagattttacgtttttcttatctttagaaattataggcgcttggtcaattgaacattcttcaagcatgcatggagctatagataggtctttttgctcttcgtctttattctcttcctcctcatcgtcttcaacgtcggaggtgctgatgtagccatcttccgtagcaacgtatgcccgttgactagggcaaaccttctgcacatggccaaatccatggcagtggtggcactgaatcttgggcgtgcgtcccgtcgaaatgacagatgaggcactcttggtggatacctgcgaagaacctttacctaaaactgcaggtcgtgggggaggtggttttagcgctacagaaactccggacgtaactggtcgcttgctcgttggtgggggtgcccaaaaagagatgggcttggaaagcctcgaagatggcttcgcccgtggcgtgtacgtgctcgccttgttcttgatctgttgatcacgcccctgcaattccttctctgcaagcattgaaaactgaaacaactagttgacagtgttaaattccttattatctactatgtcccgaatatcgcacctcaatcccatgtaaaagtgacaaatagaatcctcggttccctctactatgctacatcgtatctatcccttttgtagctcaccatagtaatcctgtacatatttattcccttgttctaaatacatctgtttcttgtgtaaatctatatgatatgatggaggaacaaatttatcacgcatagctaccttaagttcttcccaagtagtaggcaaagcaccctctgcagctaacccagtcccccaaaggaaaaagtacgaaatacccccccgaactatagcggttgtctgaaataccccctaaagtcgaaaaccggacataattcaccctcaactatcaaaaccggttacttaacctcctaaggcagaattaggggtggttttgaccggtcttcgtacacgtggcagtacagcgtggcaaggggacgacacgttagcacggggtcactatataacagcggagcgctctctctctctctctcgcaaaatttcccctttctccccgaaaccctagaacgggcggcgattccggcgacttcggcgaggctgggtgcggcggggctaggcggcgctctaggcgggtgggggtagcgcgctccaaggcggccacggcgtcgaggccggcgagctccactgcgaccacagcggcgcattgcaaggcggctgggatgaactaggctggaagaaaccgggcatttgaggtatgtgatttagctcgatttgaagtgtggattttttggtgaagtagttggagtgtgggatggattgatatttttttgagcagttcttgctagatattagtcagatgcgttgggattgttattatagtgcagaaaggtggagtaagtgggaatatgggggaggttgatttttgtgttgggattgttaggtcctgcatgcatagggattgattttgttgattttatagtaaaggtggaagtatggtggttgttttttaactgtcaatcttagggcacagatgcattgggattgattttttagtcttaactttttttaggacaattttaccatcactgcaatggatcgtctagagtatttatctgttagatttcactttggcggtgaattcattaacaattggagggaaacattttatgttggtggatctgagggtatgtcttacattgaacgtgacaaaatatccttgcctgagttaattgggtatctgaaagatcactgcgaagtgctccctggtatgcttttgcactggctttttcctgggaaagaactggcagatgggctgagggtgttggttgatgacaaggtctgtgactatatgtcaaagtgtgttgtggatggaggagtggctgaaatatatgtagaggcagtagtgggaggggagtccaatgagtctggtagcagtgatgacagtgactttgaagatgaattggaggacatgtctcttgctgatgatgaatgggatgatttaaatgatgatgctgtgtttgaattacctactgggaagcctattctgttattcagtcaacaccagagaagacaaaaagtgatttagatagattgagagcttggagtaccccaagcccaaaggataaggggaaagctgtggtactatgtgaagagagggtgaagagtgcagacttgtctggttctgacaatgattacgttggtggggactcttgttcatcaggagaagatcaagaggttgaggaaattaggaaggcatacaaggagtttaagaagaagctaaaggatggtgaggtaggaaatttagatgatgtgatctatatggggtcttcaagacagattaatgatggagccttggttcagattcagggtgaggaagataatagcccatatgagaacagcagtgcagatggtgattcatatgaagaggatagtgatggacagttggtcagaaagaagtccaaataccccatatttaatgccaaccagccccatgttaggcttgctcttgggatgaaatttgatgggaaaaaagagtttaaggaggcagtggtccagctagccttgcagaacaaaagattcataaggttccccaaagatgaaggttacaggacaagggcaaagtgtgactgggcaacctgtccatggagttttttgctatcaaggaacagcaggacaaatagctggcaaatagcaagtcttgttgatgagcacaattgtcctccaaggaaggataacaacctggtcacatacaagagaattgctcagaaatatgagaagacgatcatagataacccaacttggagtattcagagcatgcagtcaactgtctctgagcaaatgtttgcaaatgtcagtgcatcttagtgcaagagagcaaaagcatatgtcctgaagaagatatatgagtctagaagggatgaatactccagaatttttgactatcaattggaattgttgaggagtaatcctgggagtatagttgttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 20917 - DNA, 347 bp, Oryza sativa
cagacgcatatacatacagctctatgcttgaagcagctgcatctgcccaacagtgggaatactttgaaaatgtgtatagagagatgactctctctcagtaccacctagatcaaagcaaatattcatggatgctcatcaaggcatccaaagctggaaaggtaatgtttattatcagcaatctgaacattcattttcggttaccctgagatgtttggttcccctctcaaaacgaattgtctgtattttaattaatctgctctaggatagttatgctaacgtagcactacactttatttaaggtaaagttttgttcaatgtacagcatggaagtcttacattacattatg

SEQ ID NO: 20918 - DNA, 928 bp, Oryza sativa
cccaagacatcataacctactctcattcttcagtaaaattagcaaccagaaattaaatgtgaatcccacaaaggaatttaaccttctcacatcacaagaacgtgcatataatttcacattcaaaagttgcaaaatattatatccctatgaattaaattcattcttccaatataacaagcaagatgtacacctcagaacaagtaacaatgagtgtaactcatcaatagaggcagtttattaatagcaccgtattgggttcaggaatgatctcctcaggatcctaaggccattcccaaccaaaatgtactgctacattacctgaaacaaatggagagttggcgatgactgcgaatccaaatcagaaaatcttgatgcctaaggtggacgggactggaggacgacaccggcaactacttggtttcgtggcggggccgcgtaggggtgggtgaaaagggagcggcggcgcggtggagccaaagggaggggcaccgcggccgcgcgagggtggaggggcggcactgcggcgtgagaggggagggacgccgcggccacgcgaaggtggcggggcagcgcgccggcgcactgggacggaggagatggaggcgcaacaacgagacgagtgaaggggcaccttaatcggtctagcgatagagattggaacgcgaaaatacggtaatacccttccaccaaaaaaagagaaggacaaaaatacccccaaaaattaacggtcagatgtgattctactacactactacacgcagaggcgtgagctgtgtgtttcttcggtcccatgtactatcaaactactcctgttaacaaatttctgcaatcatatataagttaatctcctcaactcaatgtaaatttaacgaatcttacaccaagatttcaagaacaacaaagatcatgagaataaactaccgattat

SEQ ID NO: 20919 - DNA, 15319 bp, Oryza sativa
tttgacggctaccgcgaagaggagtttgtcattgttgttgcacaacgtctccattcccacccaagcattttctagtgacctccacttgtgccctagctagtgaaggtgtagggccgtcacaaatttctcgaggttgaggatcctcatgcaagttttgatccagttgaccttgcattttctgccagtgatgtctcgagatctggcccagaggaaacattttcgttgcttgtcgagaacttccaaggattctttgttcaccttgagggcggtgagaaggtagacaggttgcgaggtgagcatagatttaaccaaggttgttctacccgtcagacccaggttcctccctatctacccagccaggcgtcctaccgactaatcgaagaggggctagaggtgcactttgtgcaatcgaccgagcattagaggtaggcctaaatatttcagcggaaaggctgtccttgtgacttgggattcccccaggatggtgtcgatgtcaagattgtcacacctgattggtgccaccagcgatttctggaagtttgtgcgaaggctcgttgcttctccgaacttctcgagaaggctcgtgggagcatcaataaattgtgttgataaaaaccacggcgcatctgcatagagagaggttcaaaggtgtgcatgcatgcctctcaaactgctgagaatctttagctccgtagctttgcccataatttttttggagtgggtcaattgcaaggatgaagaggagaggggacagtggatcgccctgacagagtccacaaccatggcgaatctcctcccctgggatgccattgagaaggatctttgaatgggaggttacgaggagggcccctagccaatttatccaccgttgcgggaaaccctgatgctgaagcaacgccattaggtaatcccaacgaacgaagtcggaagctttggagatgtcgagcttgaacagcagtgtgggtcgcttgttcctgtggtagcttcgagctaggttgcgcacatacgtgaagttatcgtggttgctctgtccacggatgaaagcgctctggctagtcaaaaccaaggagtgccgccttaggtgtaaggtcagcagcttggagaagatttggttgtttgtttttacaacctattattcattcgtttgtctaagaatcctcattgtcggtgccgagaatgactagaaatgcaggatcactattgttgcccaaaaggtgctcgttgaattcgtgcgtaacccactggttgtccaaacattttatggttatcaattttttttaaatacgtacattcagacaaggatgatacatgtaaaagaactggtcttttattccctatatatagctaggtgcttaattgcgcagtatgaattgcaaaacgattaaaagtacaatctacaatttcaatgctatttcaaatatatgaaaaataatggtttgaaaagaaaactggtgtgtacctgtgcattgatagctgagataccagagtcaacggtccgtaagccaacaccagaagttaagtatggggcagtagttcaaccacaatccatatcattccggatccggctcctctgtctttaggtgataaaggcatacgagcatagtaatatgtgccttgtgctaaagtgggaaacaatgattttgcagtttattgtggtaacaatggcaaacagtaaaagtgttgtatatatgtaccattcatgtgctactgtagtgggctgtagccatcgatatcgttagttcgctgtaaatttgacagctgaaaatattctaaaggcacagcattgtgcttctcctctcttcactgtgtgaagtcagaggatctccttccctgccgttactctagaatttaacatttcgtatcacaaataatataaacaggtgttatgatcacaaacgagattttcgatcacagttagaaggattcaagtgatacataccaagaaatcgagaatgaggtcatgatgatcttgtcgctaattacttttccgcaaatcctatctacaccgatgaaatgtttcgtaggagatttaggatgagacggccgttgtttctgcttatcgtacatgaacttagtgagtggtctccttatttcacccaacaagttgatgcaactggtaggaatagtctttcaccgcttcaaaagtgtacagcagctatcaggatgttaggttatggaaccgcggctgattaacttgatgaagtcttgaggattgctccaagcacttgtttagaatgtttgggaaaatttgctgaaggggtgattgaaaagtttggtgacgaatatctacgcccgccaagagccgatgaattggaaaaaatcttacaagaaaatgaggctcgtgattttcctggaatgtacggaagcatcgattgtatatattggccatggaagaattgttcgaaaggttgggcaggcatgttcactgtggtaacaaaggcgttcctactatgattcttgaagcagtggaaactaaagatcttcgtatatggcatgctttttttggtaccgccgggtctcaaaatgacatcaacgttctaaacaagtcgccactgtttattcaagcaataaaagaggaagctccaacgatacactacaacggaaacggaacacaatatgacatgggttactatcttgccgatagactaaaggcattgtaatataattattatatttatggttcataaaaattattgtaatcatatatcttattctatgcttgatagtattaatcaaatatatagccacacaatggtatacataaatgcatttgcagttgatcaaagctacatgcaaagcattaaacagcttacagacagaccctctatatgtgggttgtatgagctgtctttatatttatatctgtctggatgataacttcgaggttcttggagacacacccctgtctgtgggttgtacatgcccttaggcttcatatcacataaaatttgtatgagaacacctacatactgccatagcgcaatcaatacattgcagtgcttttagcaattcagaaagtgagaaatcaacacgaaacagaagcagtgcagttccaaattgtcttcagctaatatattgatgattcaaacagatgctaacgatgcaacttagatacaagagacgttcataatccataacaactccaactacaacactgaaccatcaaatatagctgattctggtcaatcttagccaaaggcgtttggacattactaagagcgacgtagcaaagagacaatcctggatacaagaccatataactcatttcgggttcctgagcacaatgatgaccgaatccccacgtaggaacatcttgctaatgaacctgtccttgttcactggaagagccttcttcttgcctttaccagtctttggtacctgcagcaagagaaacccatgttactgaaaaatagcaggaccggaaaatggaccaaaggtttagaacttcagataacaccatgtacctcagtccacatctccctaacattctcaagaaccatgttgcaatggcgatcaaatgccctcacacgaccaagcaacttcttgttgttccggcaattgataagcacctagaaagaagagtaaatagaatcagaacagtgcatatcatacaaagcatcaactatagtcagaacaaccgtttatggtgggctaactatgtaggcaactcctaaagacaacatttacactaacactacaacagaaggactatggtcaattattcatatacattcaaaaggcttcattaacataacgggctgtaggtaactcctaaagacagcatttacactaacactacaacagaaggactatggtcaattattcatatacattcaaaaggcttcattaacataacgggacttagagagcatccttattggctaacagagttgaggaaactacagttcattcacctatcaggaaaagaacacttccttttttcagaaatccagagttcattcacccatcaggagaagggcacttccttatttcagaagtcataagcatggattctgatgttccttattcctccttcaataattccatgtaaagatgtatttttctcttccattttgaatatcgcggtgtgttgatgacttttagttactaatgatgtacataaattttagccatgtgcatatgcttgtgattacttcatacattattttcaatagctgcacaatgtatgactaagctgtatgatgttactgtgttttcttatttctacacacattcaatttttacatcgattaactttcacagtttgtgtcaaaagtagtgatacattttcacaaaaatggttaaatttagcgaacttattttatttttgtttccaatgattttacatgcatgcagtgcaaagctaatagtatggaagcaaatcctatacaggactccacgataagtactaatatttactgcataatcaagatctcaaggatatttggttggttcagttatttattttttatttagacgtaattttcttcgaagatttgatagatggccttatatcaccctgtacagcatatatatgttcaatgttaaattgttaatagaagaactacaaagtatatgttgaactttctctatgaaataccttcagtctagagcaaaaccacctcaagtcgctgtgtaatttgtatagtgaagtgatcaaatcaagtagtagtcattgcacatgcacgataactagtagttaataagttagtaacattgttcaatatttccagtttgaggatgtaaaatctttaaaaataaccattatactaatatgatatggatttatgaacatagctaacatcctggacaacttgatctacttgggatgggtaagaggcaactctaactattccacgtcatataggtagggaacaagaattctataggcatgatgacaccgttgtaatattcttcatcccctcaatccaattagttggaacatgtaaggatgtacttttgcagaagaatacgtctaagtgaggaaacagagtaactgagctaggttttaaactatatttgactaattggctagtctgccggcaagaacacgtagaacaaacgaattcccggctaggggaaacccacaagtaaagcaacagtagcaaacaccacagtaaacagtaaagaagtttggctgaatcaaactccagaagaagaagaatcccagcaccaaccaacctgggtgttgttcttcacgctcatcatcagcacggacagcggccccgtactgaattcctcctcctccttcttcccctgctgctaggagagagtaagaaacaagagaccaggtaaggttagtagtttccccagaaaaccacgcgaacggagagaagaaactttcgagggttttgggaaggccgcttacagtggcttcctccgccatcggcagcgaaggcgggcgggcggccggcgagcctggaggcgggagaggcctctggatctggagctcaggagcggagacgatgtcgacgacggcgagtggcggcggctagggcaaactcgcggcttgggcacaagtccaccaagatatatcggcgcgacggctcacggcttcgtgggctgggtttggctggcctgttaggtatatatgggctttgggccttggaggtcgctgccaagtgcaaaccccgccccgccaggccgatgcaattattaaggaggcgactccgggggtcagtcgcgcgtgtccctccccgcgcgattggacatgtgtcgcgcacgaaaaagggatggcagacgcgccacgcgggagaacgagtttcccttttttttttttgcgtttttcgtttctgttcgctttgcctttttttccgtttttccctttctattcagtttggtttttctttttttgtttctcttctgtttttttttcggtttttttaaagatgtatgaatacaaagtttgtattcgtatgtataccaagctagtttatattcgtacgtatacaaagtttttatacgcgcgtatacaaactttgtatacatgatgtaatttctttttttttattttttaatatatatatatatatatatatatatatatatatatatatatatatatatatatatatatataaagtttgtataatcgtatacaaagtttgcatacatcgtatataaactttgtatatgtgtatatattttttatgcattaaaaatatattcatatatatacacacacgtatattcatatatatacatatgtatatacgtgtgtatatgtaatatatacataagtatagtagaaacagagaagagattagaggcatagaggggggcgattgactgcgcgcgtaggggcgcgcgactgatcgcgtatcagccgccccccaactccggctcggacgtctgatgtttggaggaaaatcggacgctgacgtcagcgtccgatttacatgtaaaaactactttaaaccgatttttctcttaaattacttatccaaatcatgattcgattgcatcattaaatttgttgcaattaaattttcaaaacaagaccacacatggatatattccgatgaattttttttagcttattattgaattatttttaaatgttgcacgatgttccaccaggtatatcggaattgtagatcgaaaatatttcactcgtttaaatcgggtgttgtttcaccttgtataaaaataatgtttcagcaaatagcgaaagaacgtttcaattcactgcaacatttgatccatacatagtgaaacattataagtacactaggtgaaatattttttggtggaacaaaaaaatgaaacgaattccccttaatagggggtttctaaaatatgtgggttttttgttgcaatagaatatttcagctcactgcaacattagatctatacatagtgaaacattgtgagtacactaggtgaaacatttttggtggaacaaaaaataaaccaaatttccttaatagggttttccaaaatatgtgggtgattttttgcaacggcgcgttccataatatcaaaatccactgcaacatttgatccgtacatagtgaaacatcgcaagtacactagctgaaacatcgtaaaattactggttgaaacattgaaagagatcatatgcaatattcaaaaaaaatatcaatagaaaggctaaaatatttttttatcgaaatataatcatgtgtggtcttgttgtaaagatttaattgtaacaaatacaacggtgtgatcggatcatagattggataattagtttaagagaaaaatcgttttaaaactacttaaagtaggagcggcagaggcgcgggcgcccgaggcgtccgatatttccttctgcagtcggacgcccggcgcgcagcattctccaattattaacgtcggtaagttcgagtacatgatttccctaatctctaatcccagaaatgtttacccctcaggaattcaaaaccatataaaataggtcccatggcagtatgcataagcggtttagctgacgtagcatcttagtaaaaaaaaaaagaaaataaaaaaatagtgggacccatgtatcatcacctactacttttactgttccttttcccatgccggaccacgcacgcgccagctgtcacaaccgccgccgtgctgcagcggcaaccgaccccgcttgcgtcttcacggtgaacaccaccgtggcggctgtcgcaccgcaccacgctgaaccacctccgctcgctagcggcgatccttgtgcacgcgccttttgccatagcctaccttgttcgcgccttttgcggtgaacaatgccaggagaatgcccccacggcagccgtcaccgacaatgtactggcaccacccaccgcaaccgcagctgaccccgcccgcgtcttcatggcggtggtggcggtgaacgccccacgacgaccgtcacaccctaccgcgcatccgctcgccggtggcaaccctcgttcacgcgtctcccagcacagccatagccgatccccacccgcaccttcgtgacggaggacaaccccgcagtagccgtcaccaacccgtgctcgcgccacccactgcagccgcagccaaccgtacccgcgtcttcgtgacggaggcgacggcgaacgccccctcggcggccgtcgtaccccaccacgctagaccggcttcgcccgcaggctgtgaccctcgtgcacgcgtctcccgtcacaatcacagctaaccccacacccactccttcgtggcgaaagaccctgcgacagccgtcgccgacgtcatactcgcgcatcccaccatagccgcaaccgatcccgcctacgtcttcacgacggaggcggaggcggcggcgaatgcccccacggtggtcgtcgccgacgtcgtgctcgccatcatcagatcaacagaccaacctctgcatcttcttctcctcgccatcatcagatcaacagcttcgctcctcgccatccaatcgattttcctcttgttgatgcatgcgcagacttcacagctctactcttctataaatcaatcaatgcccacatccacaggggatgtgggcacggctggcggcatgccggaggagggcggcggcttcgctaccacgggcgggggtgcccagtggcggcttgctggcatggaggaaacgaagagaaatagatggagaagagaggaagagaggaggaagaaggagaagtcacttgacacatggatccaatatttgtttttattctgccttgttgattaaaatgccacgtcagttaaaccacctatgcatactgccatgggacctactttatatggttttgaacatttaaggggtaaacatttctggtattggagattagtgatatcttacaggctcgacgtaaagttgagggatggcaagtgaacttattccttcgttgccacaatcttgacccagcctttgtggtaatgggccctcgcgtcggccacaatcttaccacggtccaacaaataatgggctcccatttgtacgcaaacaacgactgtttgccttgttatttggattccactttgggctcattttttgtatggtcctgtcatcggtgtcatggagaaaaaagttggcgccaatttgaaccttcccgcgcgattgccactccgtgctgaccgggcgtaagatcagcaagtagtaacaaaaaagagggaggggggattttaattagtttgctggttgaaattgcaagtgtttggtatttaaaatcaacatacagcacaacaccgtccttgttaaaaatgtatgtatacatcgtaaaaatgttgtggtcggaaacacgtcatccacctcatcgaaaacttcctttgtttaaaaaaaaaacttaaaattctagttatgagtttgaacagattttatttttttagagcaagtataatagtaggctataagccggctaaatgctgaggtggagaaaagaagagaggagagagaagagaaacgggctgtaaacttacaaccggcttggacacaggaactaagaaactctgtgtgagagacaagtgggccctgtattaattataaagagctaactattatataggcaggctgagagaagtctaaaaaaaacttatagccagcaggtcagctgtattattagcctttcttatgaaggttgtatgttacaacggtgtcacgggtgcggcgcccgcggccgggctagccaaaccgatcgatccatatgcaatcagggaacaaacggtgcgcgggtgcgacttgcgaggtgcctgcaaggctggcctagcttgccacgcacaaactatactcaagggagtagtagtagggtcgtagggaccacatgcatgcgcacgggcctgttttttttgtttaatttgacacgggtgaaaaaaagaataaatataattcacaggaataaatcatcgacctaacaaattgaaatacatataccatgtcccataaaaaaatacatataccatgtgcaccatcatgtacgtcgttatagacatcacgtcggagcttacatatttaatgaacatggttgatcaagcatgtatcgctggcctatatctcgaatacatataccatggcacgatgtaattaatctttgatattgtttaatagaaatggcctatatcactggcctcaatgaatattccattaagtaatgaaattacatacggccaggatgtacgtaaaatgaaaaaaaactaaacagcatgaacacatcatatatattgtcttgtggcagctttttctctctaaatagcaatatgcctataactatccaaaacaatgtcttcaaagaagccgacatttgtccgccaatgttgcccaaccaaccaaactattagttttgagctttcattctcccatacaacactttaaacaaacaaacaacaagcaatctcgaacaataccgaagaagtcatagctttcgcgcgcccggtcggagataatcatcttaagaatatcaccatttattacagaggaaggttgtgcctcctatcaaaaggacaactagagacaaaccacacactttctcaaaaaaaaaaaaaaacagagagagaccaaccgcacagggtaagtcatggtcactgctggagaaatccacaatagtcctggtttgcaatcccctttagtcccgagttgcaaatcggaatcatgaatctgggaccagagatgccgattggtaacaatcgacatattgattttttttattgttttttgctgtttgcatattgattttaaaccaaactcaacaattaaatcatccacattcacagaaacatcacaaaattatccacaaattcacaaatcgaatgaacatattcaatttgacataaaaaattcacatcacaaatttacagatccaaatatatcgcaaatcaacaaataaatcaacaaaaatcatccactcgtcgacatcggagcaaagccgcgtgggccgccgccgcccccgcgtaggccgccttcgctcattcctcgctgcaagaaaaggagaggataagagagaggaaagagagagggagagagagaagagaggaggaaagggaggaggaggaagttaaagatgaggaggagaagtttgcgatcgaggaggagaggataagtgtgagggattatatacaatgcattgatttttagtcccggttggtaaagatagtagggggccagactctttttgaatcgggactaaaaaaaatctttagttgcagttggtaacataaagtggcgttgggctttttaaccgggacaaggatgtttattggaaccggaactaatatgatatttggccgacccacgaaagatccgttatccagtagtgtcaccaagccgctttgaacttccactgcctaatcttcccgattaaaatggagtacaccacctatgtagccccttccacttgatcgccatcaacttaaagcttaccatgaacataacctatgagtttagatagaataattgagaactttgttttttaaaaaacttcatatttgtatattacttctcaaatttatgttcataaattttcgcttcatgacacataaatttgcaatttatcacaattttggaataaaaaagattctggcctgttgcattttattttttcttggaggaggcctcctggctcgagccttgtttcttgcgtcacaaaccaggtgcaccaccactataacggcttacaagatcaaaaagacatccccgcatcgcccgcatgttccagaacccaaacacaacgaagagacatatagcaagcaggagccgataaaggaggaatccatcgccgcagctgcttactcaccgacaataccccccaccccccgtgtctctccaccgccgctgctccctccttcgatcaaccgccgctgcaacacgctccaccgactccacgcgctgggccatttcgtgcgacgacgacttccacggccgccgacgcagtgacctcgccgccgacaaccccatctctcctctccagcgccgcggttccacgaccccccctcccccccgcgctgagaaaatggacattaagccattctcaaaacgcggtttcgttggaatgccatcccgaaacagcgattcgcgaaaatgccaatttaggccacgcgcactgctactttgccattttctcccttttagccattttccgttccattttcgaaaatgcaaaggatggggagatgattttgcccctttgtcctgatgttgaaatcttgtgtgcatcgagctggtcgagccatttcagctcgccaccgtgggtaagcgccaccgctaccgtcacctgcatcgccgatccacctcgcctgcaccaccagcccacctccacagcctccatccttccccagcagccgaagatcgtcgtccgcagcagagagaagaactcaactccaacccaagcccaaaccctaactagggttagggttatggtgatgcaacgagaattcacggcaggcaaggacaacatgtctcaaggtagttcctttcgtgtttccggacgccaattttacttgttttcagcttggccccagtggacttcctgttgtcaagtgcccaagatgtgggagatgcagtagtggagtgcaaatcgtgaaggcaaggtggtcaggtgtttttcaaatgcgagaagaacgaacaatatgttactaaattctccaattttgatttgatatgagatggctggaatttcagaatggtatcagaagtaattttcttaggttttgatgttttgacaggttccagaaccttgcacattcttcaagtggtatgatagttactagagaatggttgaaggaatggaactggattatattggacataatccaataccagttgcaagagctgtggcaggtgaaggtgacatggttgatgaaggcaagatggataagctaactaagtggatccagcttcttgtgttgatgaacatagggcaaggcctactagtgctgtttggtgtgtttgttatgcttatgaaatgatgtaattgatatgttggatgtaatagatatgtagtgaatgagctgtgatgtaaaaagaatggttaatgtgttgcttttggtaatatatgtgctctgaaccatttgtattagaacctggaatgagtttatgaaaagatgcagtgtttatggctagttgatgactctgaacaaaatatgtgttattgcagtgtttaaacctgtgggcagtatgttggtagtattttgccaatattatgtcaaactattggcagcattttggcagagtagttgcatttttgaatttatcagcacaattgtaggcatagcaattttagtgtcaacacaaaacaaaatgggcagaatgtgtgcacatatgccatcagatctgacattactaatacataggttcaaattaagctggttcagtgcacataggttcaaattaatacataaaccactgatcaagctcattacacttgtcattcagtgcacatggctgcatacagtttgccaaccaaatcagttcacatagctgtagaaaagctagatccaaaagctactagatcaagcacattttcagtttcttggctttttcttgggtgtaagtttccttggtgacctgcttggctctggcacaattgcaggctgggatctagcacctggattcagtggtgccttccttggtgacctcctacttagtcctgcaactggagctggctgtgagctggagcctgcctacaattgctttccttggtgatcttctgggtggtcctgtcggctgggaggtagagcatgcctgcatagatggttgtgatggtgttttgaagtgttggctaggagctagagcatagctgtagggatggatgtgagctagctcctccatgcatgagatgtgccaacctgatgctgaagcaaacaaaatacaatttttaacaacatttctaacctaagaaaacaagttacaaaaggtcccaggttttacctccttgtcaatctgccaggattatcttcaacatttgtagccacaacaggattatcttcttgccaccaccttcaagacaacttttgaacctaagttttctatttctaccagcagtctttcatggaagtggtgcacttagtacccaggtaaatcaacttctggccggtgtgatctgtcaccaaaggttcaatcactctcttgtatgcatttttaaacatctgcactaggtaatagggattcacaaagtcttcaatattcacatccctactctgttgtgcagtaatcaaagcaagtgcatgttggaatggcttccctatatgctgccattcttcacatgaacaatactgcaagcaagctttcacaatgtacttcccatgagttgtgctattgtcaacaacttcagctgtgaaacaataagctttaaccactcataggtggcccagacccctagtcattgcctttaactgttgtgtcactgcaggtagtattttcccctgctttttttttctgatatcctcattctcttgttccataggaccatgactagttccctatacttgtcaactaactcacatacagacaattctttgtaatctttaatccagttattgaagctctctgcaaggttattggtgatgtagtcacacttaattgcagggttgaaagcacttctcatccacttcaatggatggtatgtctcaagccactctagcacacaagggcatgctattacatgctagatgtgttcttgccacactgttctcctatatgatctagctgttgggtacatgtgagagtgaccatcaccaccaaatcttttcacaaagtttttcattaaatgccagaaacattccctctgctcagcatactcaaatacaatatgtacaactttctccaaccctttgcaagcatcagtacaaatagctaatggattaacatctcctatagccttatgtaactgtctcatgaaccattcacaattatcttcagtttctgcatctatgaaaccaatagctaaaggatacatccaagtatgcccatctatacttgtagcagcagctaaatgtccaggccacttaccattcagagccgtggagtctacactaatgtatggcctacaaccctctaagaacccatcaatgcaaggcttaagggcacaaaaaaaaatctattgaagtatgctttaccatcaacctcctttatgtaattatgtcaatctctacaacactaccaggtgaagtgcttaacacttgtgccctccatctaaatagcatgtggaagctttcttcccatgatccatacaactccaacattgccctttgcctacccttacatacagtgtcataattaattgtgcatttgtgatattcttgcaacctagtctataagcttttagggcccatacctggattattcttcataattttaactgcctttgaagctacccatttactagttgcagtagtggtc

SEQ ID NO: 20920 - DNA, 2211 bp, Oryza sativa
aaaaaaagggacgcagttaaacaaaattaaatgatgcacaaactacaacgaactcgcccatcaatcgcagcaagaaaatgcaaatcgaccaacaaattttaggattgaatcacttacccgccgagtagctattgccaagtgcactccatactcacagatggccggcgacgcctacatgcgggtgacgccgacggtgagctccttctacgccgcaccctctgctcctccacagtctaatcgactccgtcgccgacgagcaaggatgaaagagagcagacggagagagagatgaactcacacccagctggatctcgatcccctttagccactgagcaggggcaaaatcttctccccatcctctgcattttcgaaaatggaatggaaaatggctaaaagggagaaaatggcaaagtagcagtgtgtgcgcggcccaaatggcattttagcgaattgttgtttcaggatggcattctagcggaaccacgttttgagaatggcttaatgtccattttctccgcacaacagcatcggccttcaccatcggcaacgcgcgcgacacgctctccaccaactccgtagctgccacctcgccgtcgacaactccatcggcgctatttcctgtttcgcgtgcgaggacgacctccgcgcgtgattgcatcaacaaacgcccccattcttggtcgttgacgcctccggttcttcccgtgcacctccgccactgccgcctcttcaccgataactccgactctccacccgcgcgtccattgccgcgacgcctctccattgacgcggctgtgcctccttgtctgagcccgttcagcaggtgatatttcactgtgtttcccacctttcctcggtagcagtagaactcgtacgccgggagttcattgttgacgatctgttcttgaaatcgtttgttattctgatgatttattatggagtagtcaagtggatgaaatcggtggtttatcctgatgaatttttgtatagtatgttgacggctgttaagtgccaaaataacgtcgtcaatacctgcataaaaccataaatgtgaaacatccaacatagtggtaggatttatttctaacaattttcacgagtgtttgtgtatatttgtatgcaggtgatcaaccaccaaagttgggagagaatgagaataaagaatggaaatatattttgcgctgatggactcacatggttttgagctacaacatataaaatgtgcaatcatttggagccaaaacatggagtaccataaagtggggcccacatgttagcatcctgaagaaggatgtgggccaggggagccaaccagggttcggccgaacccctggttcaggggttcgaccgaacacccagctggcccagtctagcccatattcggtatgacggttgtactcctcatttcaatgacggttgtggccgtttctaccggtggaaactgtcatagagaggacacttgtcaagaggagatgaagctagaaggaatatgctcaaaggatgcttggagcatctccactctcccaaggtaactctccacctataaatacccctttcctctccctcattcacacacagcaaagcatgagctgaattacaaaaagctctagtgtactttattgtatattagaatagggagatagtaaggtagaaggaatctgaggaatcccggagttgtcggtaatctcctcttacttttgtatcttgttaattactctgctttaataaaaataacattatgagtaattaaggtttgcttagtgagaattacttcttggttagttcctaattagcatacggggtcattgttcactatagtccatttatttatagtgattgttttagtgtttgatcggcactagagtagtttttaattgcgttgatgtagtgtctgggtaattaatctctagtggttgctgcgtatcccacaatacgtttgaggtgggtgtagaggtggtgatagccctcaagagcacttaaatcctccctgtccgggtacgtagtagagcgacatctgagaacagcgggttgccagtgcctgaagtattgcattaggattaaagttaagctttccctatacactgtttctcattaggaaatcctctctgccctctgcccacattaactttgtatccttggatgaacctgacgagaagataatcacacacgttcccttggattagatacccttggaatactccgtaggtgaag

SEQ ID NO: 20921 - DNA, 3041 bp, Oryza sativa
  unsure (1)..(3041): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgaagtcgtcgaggtcgcagctgtcgtagcggtagccgaattcgtcgtactccacgatctctgttggtcgtgagtcgatgccgggggagctgaggtagccttccagttgatccgtcgaaatcgtgccgagtggctggagtatgatgccgacttccctggagctaggcatgatcggtgttgaagccaacttccgcctaggcctacggggagaagacgcccttgtagtgaagactgcagccaaatcgtcggggagtttcatcatgattggcgggtaggccccatcatcttgatctggtggtgtcggagtagatgggatctcgtccaagtggtttgaagccgactcgagcgagataagcttggagtagatcttggccgagttcggaataccgaacggggctgagacctggttctttcccgactggtttggatctgagtcgaggagagagatcttaccgaagtcgttggtgatgaagttgaggctgccgaaccgaaacgcctgcccgggagggaagacgaagttgtcgatgccggagacggaacccatcgcactgatcggcgagaaacttgacgcaacccctacctggcgcgccaactgtcaaaacaagatttcggcaatacttaaagggggtggctatcaagctagaaaagtggatgggtttgaagataaggaattttatacaggttcaggccttcttattcaagaagtaataccctactcctgtccggggatgattccgccgagtgtattattgatcgtatgatctggggaaaaaaggtcgtcccgagaggagcccggacccctccttatataggggaaggggtccgtattacaaaatacagtccatatccctaatggaatatgtgattacagataaaatataatcgtaaccgactaggatctcgggtattttcttgacatataagttagaaactaacccgagtcctcataaagatattctatctatatctagtaccatgtatccaactaaactataactgccgtctagatatggaatatccataatccccacatgtagcaagcgacagcgcggcgatgcccgacgcagcccctcgtgcggagccgagatggaggtgtggatgtgtagcgtggacggcagccagggagaagtggaggcaagccgcaagcaggccgaggtcggcggcgcggcgtggcgcgaaggaggcaggcggcgccacggcggcgcgtcgcacgtggcgcgaaggaggcaggcggcggcgcgacgcggaggaagggctggcccctccggtggccgggacgaggtcccgtgcgagtcgaggctggggagcatgtgccgtcgtcgtcgaggagttgccgagttgaggataactgaataagatcgagactcccctttttcctttcttttgttcacccggacatgtggtggggaactggagattagtcatgtgggcccaatcgaaatggacggtgggctactagggcagccaatgggctggaggcctggagcaacatggaagttgatactttcggtcttcggtttcttcaatttgtagccggtactgagagcaagtacagtaagtcacctataacgatatatcaagaagaaaaaaagaaagagaagtaagtgggctataaatttaattgccagtaacaacacggacttcaacacgttgtatgtatgaggtgggaccggatattaattgtgtaggatatttgtgtaaataactattgtatgaataggctattagattagttatagatgatttggagctaacatttggctatactattaaacttgctctaaccgaaccggtctctcccatcgtgcaaccgagcaaacgaccgaagaccgctactttggttttttcggtttcggtgtcgattttttaggtacggtattcggttctcggtttttatgctcacccctaatcgtacgtacgctaaccgctgctagagcatcaccaacacatcttaaaattttattcccaaatttttagttatggggatgcaaaaacataatttgaggtgttaaaaattttctcactccaagagattaggtaaaattggtttcctaaaaattaaaagggtgggccacgataaaacctccacgaaaaaaaatatgttttgcgctccttcctcccgtcagatcacgtgtgcatctcttccccgcacgtgaagcgccgtgattaggagccaaaacaagacaacacatggatatattccgacgaaaaaaaaatttagcttattatttaattttttttaaatgttgcacgatgttacaccaggtatatcgaaattgtttcactaagtagatcgaaaatgtttcactcgtttaaatcaggtgttgtttcaccttataaaaaaacaatgtttcagcaaatagcgaaagaatgtttcagttcactgcaacatttgatccatacatagtgaaacattgtgtacactaggtgaaacattttttttgtggaacaaaaaataaaccaaattcccttaatagggggtttccaaaatatgtgagttttttttttgcaatggaatatttcgttcactacaacattagatttatacatagtgaaacattgtgagtacactaggtgtaacatttttatggaacaaaaaataaaccaaattcccttaatagagagtttccaaaatatgtgagtttttttgttgcaaaagaatattttaattcactgcaacattagaaatagtgaaacattataagtaaattaggtgaaacatcttttgtagaaaaatgagagaggaaagtgggtgggccgaggtacacacgtggggatggttgtggaaaaatgggagagggtagtaggtgg

SEQ ID NO: 20922 - DNA, 3778 bp, Oryza sativa
aaaattacgttaaaagcatttcaaaatcaacttcaaaatcaagttcaaaaattcaaattttggcttattctttggctgtttaggccaaacgatggggctatctgataagatcaattttttttcaaaaaatatcttcagattattggatagagaataatataccgattctgttggactgttggtgatgctctgaatccccgccccgagtcctccttgactatccaaaagcaccgcccgccgccgtcgccgcgacgccgcctagaaaaaatggacgcgctcgtggtgcggcggctcggggaccccacgctggcccccggcggcgaggcctccccgttcgcgccggtcaccggggaccacccggcgccggcgctcgcgtcgccgacgtccgtgcgggtgcgcgtggcggccaccagcctcaacttcgccacctacctgcaggtacagggcaagtaccaggagcgccccgcgctaccgttcgtcccgggctccgactacgcggggttcgtcgacgccgtcggccccgccgtgcggaggttccgccccggggaccgcgtctgcggcctcgccgccgtcggctccttcgcggatctcatcgtcgccgacgagaagcagctgtgagttcggtttttcgcctctcgctgcctcgtatggtgatctccgtttggaagattagcttactccaagtggctctctctttggaaatccccatttttgggttaatttatcagtacatgccttaattagtgggatacagcatcacgagttatatttggttttctctttcaattgtcggatgcattttcttgtatgtagtcgattagttgttgaagcatttctacatcggcttatatctgttcgctcttctcatgtccgatcgtagagttaaactttctgctagttcggtaggtgctatgcagattttatagcttatgagaagggttgtttgcttttgggagtaaatgtttctttttaaaaactatttattctatgatatgtctaaatatggggatgtgggagtgggagagactatgctggttttcgatgaaaaagatgagaatgttgctgtctgtctctctatagatagttaagccttgatcccctaataaagaggtggaatctttcaattgtcgggatgccttaaaaaaggcgatgttaatgttgtagtgaggactggattgtattttgttttgttatttcagcttgatttcactagcaaacaaagcgcacagtatgtctcctgtttgtttatcttagcaatatgcaatgtataaatcaactaatacaatagctgcacttgtggtggttgcagttgcagagtaaaacagttagcactgttgtgaaataaaataaaggaagcaaatgttggttagatacttgtatatatgtgaatttctgaatttttgtatatgaggggctatctgtagttaccagaatttttttgtaagtataacatgcattttaaatcgttggatcagaatcataatcagacaggcgcacatctcaaagctaatgctttgtgcaggtctgcaggaaaaaaatgaattgtacttggccaataatcagggaacttacacaatagagaaacatcttatttattctggtatgttctattgaatcagtgctatgttctttcgaatcagattttcggtgcctgatggatgtgaccttgttgctgctggagcattgcctgttgcatttggtacatcgcatttggcccttgtacacagagctgaactaaaggctggccaggtgcacccctgtgttaatctctttgtttataaaatgcctataagatatccatttggtacttgtgcattgttcatgttattgttatggacattcatcatggatacggcacaaatctcctttggaatggccatccacattctcggagcactgcattgagtaaatcagcatctctctgctgctgctccacatctctatatccataattactgttagtgtgttaagttatgtggcagtggcatcagtgtcttaccttcgtttgtgacatatcatgtacacacaatattatgagctagaccgcattacctcaaatggctcattttgatggccattattggtcaaacataggccttgtattttatatttatgaaatttattatgtcaattttctatataacttaaattctacagtttctatcatagaggtgaacttctgcaacagtacccaaacatccacaccgttctgataaggtcaaaatgttatggatgcttattcgtggataaggaagggtccacagattgggataaaggtccacagataggataccacttaactattccctatccttgaaaactaaaatcatctaggggcatatttctaatgctacagtgtacaggcactgttcatctgcagtaccgttaccatagcaccattttgttggtgtctccaattaaaacccttccatttaggacccaccatctgatgatctgatacaggggttttgattattttattctcacattaatgaaatctgtcagtactgttctgttttttaatggtactgtagcagtaggactagggaagcatttgccttccaaaataagaatatctatactatattgattaattaattagcttcctggcatagagaataattgtttgtatcctatctatttgagatatggtttattccgaaggtcaggattctaagcttgtttggttggtgacctgggcgtcatgcctgagaaaaatatgtgcctgagtgttgcatgaggtgggagtggttcatgcctgagagaaacttgtttggttggtgacctgtgcctgagaacacttaaaactaatattatctggcatttttctctttttaagcttggagtttaatcataaatccaatatagatacttaagagatttaacaaatatttttttttacatagtctcataacatatctttagctaatcaagtggagagcagttcagcacgtttgccaatcacaagatagtgcatgcaaaagaaagcaaccagctgcagcgtgagagaattactttaattcagcagttagtagagaagtacttcggctaatcaagtggcctggctctgcatgcaactgaggtcaccaaatttggtctcctgactcaggttggttgagctgccggagagcccaggcctggaaaggtatggagcgcaggagtggctcaggcactaaccaaacaaggtgtattttttctcaggcttgtctctggctaggcagatttgtctcagggtggcaaccaaacagcctaaggctgtgtttggcaccgcatgttcccaactcctctcccttctattccgcgcgcacgcttttcaaactgctaaacggtgcatttttggcaaaaactttttataggaaagttgcttaaaaaaatcatattgatccatttttgaaaaaaaaaagctaaatacttaattaatcatgtgctaatataccgctccgttttccatgcacaggagattggttcccatctcttccaaacgaattcagcctaaatcttctaatgggtgaagttactattcactcaaacctgttcagtaatataccaaatcatccctatgaaagggatgcatgcacctctattatgattaagcaataagaagaaataagttaggtctagtttgatcagaaattcagaatccctcagcaatccagcttggcaccaatgagtgcgatcccatctttgtgcaggtcttcattctccatcggtaaatcaatgtccattacagtttcccttctttgattaagagtcagctaccaaagctcctagtaacgat
